(12) United States Patent
Liu et al.

(10) Patent No.: US 12,043,852 B2
(45) Date of Patent: Jul. 23, 2024

(54) EVOLVED CAS9 PROTEINS FOR GENE EDITING

(71) Applicant: President and Fellows of Harvard College, Cambridge, MA (US)

(72) Inventors: David R. Liu, Lexington, MA (US); Johnny Hao Hu, Cambridge, MA (US)

(73) Assignee: President and Fellows of Harvard College, Cambridge, MA (US)

( * ) Notice: Subject to any disclaimer, the term of this patent is extended or adjusted under 35 U.S.C. 154(b) by 1176 days.

(21) Appl. No.: 15/770,076

(22) PCT Filed: Oct. 22, 2016

(86) PCT No.: PCT/US2016/058345
§ 371 (c)(1),
(2) Date: Apr. 20, 2018

(87) PCT Pub. No.: WO2017/070633
PCT Pub. Date: Apr. 27, 2017

(65) Prior Publication Data
US 2019/0225955 A1 Jul. 25, 2019

Related U.S. Application Data

(60) Provisional application No. 62/408,686, filed on Oct. 14, 2016, provisional application No. 62/398,490, filed on Sep. 22, 2016, provisional application No. 62/370,700, filed on Aug. 3, 2016, provisional application No. 62/357,332, filed on Jun. 30, 2016, provisional application No. 62/357,352, filed on Jun. 30, 2016, provisional application No. 62/322,178, filed on Apr. 13, 2016, provisional application No. 62/311,763, filed on Mar. 22, 2016, provisional application No. 62/279,346, filed on Jan. 15, 2016, provisional application No. 62/245,828, filed on Oct. 23, 2015.

(51) Int. Cl.

| | | |
|---|---|---|
| *C12N 15/00* | (2006.01) | |
| *C07K 14/32* | (2006.01) | |
| *C12N 9/22* | (2006.01) | |
| *C12N 9/24* | (2006.01) | |
| *C12N 9/78* | (2006.01) | |
| *C12N 15/11* | (2006.01) | |
| *C12N 15/90* | (2006.01) | |

(52) U.S. Cl.
CPC ............... *C12N 9/22* (2013.01); *C07K 14/32* (2013.01); *C12N 9/2497* (2013.01); *C12N 9/78* (2013.01); *C12N 15/11* (2013.01); *C12N 15/907* (2013.01); *C12Y 305/04005* (2013.01); *C07K 2319/00* (2013.01); *C07K 2319/09* (2013.01); *C07K 2319/80* (2013.01); *C12N 2310/20* (2017.05); *C12N 2800/80* (2013.01)

(58) Field of Classification Search
CPC .......... C12N 9/22; C12N 9/2497; C12N 9/78; C12N 15/11; C12N 15/907; C12N 2310/20; C12N 2800/80; C07K 14/32; C07K 2319/00; C07K 2319/09; C07K 2319/80; C12Y 305/04005
See application file for complete search history.

(56) References Cited

U.S. PATENT DOCUMENTS

| | | |
|---|---|---|
| 4,182,449 A | 1/1980 | Kozlow |
| 4,186,183 A | 1/1980 | Steck et al. |
| 4,217,344 A | 8/1980 | Vanlerberghe et al. |
| 4,235,871 A | 11/1980 | Papahadjopoulos et al. |
| 4,261,975 A | 4/1981 | Fullerton et al. |
| 4,485,054 A | 11/1984 | Mezei et al. |
| 4,501,728 A | 2/1985 | Geho et al. |
| 4,663,290 A | 5/1987 | Weis et al. |
| 4,737,323 A | 4/1988 | Martin et al. |
| 4,774,085 A | 9/1988 | Fidler |
| 4,797,368 A | 1/1989 | Carter et al. |
| 4,837,028 A | 6/1989 | Allen |
| 4,873,316 A | 10/1989 | Meade et al. |
| 4,880,635 A | 11/1989 | Janoff et al. |
| 4,889,818 A | 12/1989 | Gelfand et al. |
| 4,897,355 A | 1/1990 | Eppstein et al. |
| 4,906,477 A | 3/1990 | Kurono et al. |
| 4,911,928 A | 3/1990 | Wallach |
| 4,917,951 A | 4/1990 | Wallach |
| 4,920,016 A | 4/1990 | Allen et al. |
| 4,921,757 A | 5/1990 | Wheatley et al. |
| 4,946,787 A | 8/1990 | Eppstein et al. |

(Continued)

FOREIGN PATENT DOCUMENTS

| | | |
|---|---|---|
| AU | 2012244264 A1 | 11/2012 |
| AU | 2012354062 A1 | 7/2014 |

(Continued)

OTHER PUBLICATIONS

Fonfara et al (NAR Feb. 2014: vol. 42. No 4: pp. 2577-2590; IDS reference). (Year: 2014).*
Hu et al, ("Evolved Cas9 variants with broad PAM compatibility and high DNA specificity" Nature vol. 556, Apr. 5, 2018: pp. 57-63 and Extended/Supplemental data), (Year: 2018).*
Kleinstiver et al in "Engineered CRISPR-Cas9 nucleases with altered PAM specificities" (Nature; Jul. 23, 2015; vol. 523 No.

(Continued)

*Primary Examiner* — Catherine S Hibbert

(57) ABSTRACT

Some aspects of this disclosure provide strategies, systems, reagents, methods, and kits that are useful for engineering Cas9 and Cas9 variants that have increased activity on target sequences that do not contain the canonical PAM sequence. In some embodiments, fusion proteins comprising such Cas9 variants and nucleic acid editing domains, e.g., deaminase domains, are provided.

22 Claims, 19 Drawing Sheets

Specification includes a Sequence Listing.

(56) References Cited

U.S. PATENT DOCUMENTS

| | | |
|---|---|---|
| 4,965,185 A | 10/1990 | Grischenko et al. |
| 5,017,492 A | 5/1991 | Kotewicz et al. |
| 5,047,342 A | 9/1991 | Chatterjee |
| 5,049,386 A | 9/1991 | Eppstein et al. |
| 5,057,432 A | 10/1991 | Wangersky et al. |
| 5,079,352 A | 1/1992 | Gelfand et al. |
| 5,139,941 A | 8/1992 | Muzyczka et al. |
| 5,173,414 A | 12/1992 | Lebkowski et al. |
| 5,223,409 A | 6/1993 | Ladner et al. |
| 5,244,797 A | 9/1993 | Kotewicz et al. |
| 5,270,179 A | 12/1993 | Chatterjee |
| 5,374,553 A | 12/1994 | Gelfand et al. |
| 5,405,776 A | 4/1995 | Kotewicz et al. |
| 5,436,149 A | 7/1995 | Barnes |
| 5,449,639 A | 9/1995 | Wei et al. |
| 5,496,714 A | 3/1996 | Comb et al. |
| 5,512,462 A | 4/1996 | Cheng |
| 5,580,737 A | 12/1996 | Polisky et al. |
| 5,614,365 A | 3/1997 | Tabor et al. |
| 5,652,094 A | 7/1997 | Usman et al. |
| 5,658,727 A | 8/1997 | Barbas et al. |
| 5,668,005 A | 9/1997 | Kotewicz et al. |
| 5,677,152 A | 10/1997 | Birch et al. |
| 5,712,089 A | 1/1998 | Borrebaeck et al. |
| 5,767,099 A | 6/1998 | Harris et al. |
| 5,780,053 A | 7/1998 | Ashley et al. |
| 5,821,047 A | 10/1998 | Garrard et al. |
| 5,830,430 A | 11/1998 | Unger et al. |
| 5,834,247 A | 11/1998 | Comb et al. |
| 5,835,699 A | 11/1998 | Kimura |
| 5,844,075 A | 12/1998 | Kawakami et al. |
| 5,849,548 A | 12/1998 | Haseloff et al. |
| 5,851,548 A | 12/1998 | Dattagupta et al. |
| 5,855,910 A | 1/1999 | Ashley et al. |
| 5,856,463 A | 1/1999 | Blankenborg et al. |
| 5,880,275 A | 3/1999 | Fischhoff et al. |
| 5,962,313 A | 10/1999 | Podsakoff et al. |
| 5,965,124 A | 10/1999 | Feinberg et al. |
| 5,981,182 A | 11/1999 | Jacobs, Jr. et al. |
| 6,015,794 A | 1/2000 | Haseloff et al. |
| 6,033,874 A | 3/2000 | Baum et al. |
| 6,057,153 A | 5/2000 | George et al. |
| 6,063,608 A | 5/2000 | Kotewicz et al. |
| 6,077,705 A | 6/2000 | Duan et al. |
| 6,156,509 A | 12/2000 | Schellenberger |
| 6,183,998 B1 | 2/2001 | Ivanov et al. |
| 6,355,415 B1 | 3/2002 | Wagner et al. |
| 6,429,298 B1 | 8/2002 | Ellington et al. |
| 6,453,242 B1 | 9/2002 | Eisenberg et al. |
| 6,479,264 B1 | 11/2002 | Louwrier |
| 6,503,717 B2 | 1/2003 | Case et al. |
| 6,534,261 B1 | 3/2003 | Cox, III et al. |
| 6,589,768 B1 | 7/2003 | Kotewicz et al. |
| 6,599,692 B1 | 7/2003 | Case et al. |
| 6,607,882 B1 | 8/2003 | Cox, III et al. |
| 6,610,522 B1 | 8/2003 | Kotewicz et al. |
| 6,689,558 B2 | 2/2004 | Case |
| 6,713,063 B1 | 3/2004 | Malvar et al. |
| 6,716,973 B2 | 4/2004 | Baskerville et al. |
| 6,824,978 B1 | 11/2004 | Cox, III et al. |
| 6,933,113 B2 | 8/2005 | Case et al. |
| 6,962,705 B2 | 11/2005 | Malvar et al. |
| 6,969,731 B1 | 11/2005 | Tang et al. |
| 6,979,539 B2 | 12/2005 | Cox, III et al. |
| 7,013,219 B2 | 3/2006 | Case et al. |
| 7,045,337 B2 | 5/2006 | Schultz et al. |
| 7,064,249 B2 | 6/2006 | Corbin et al. |
| 7,067,650 B1 | 6/2006 | Tanaka |
| 7,070,928 B2 | 7/2006 | Liu et al. |
| 7,070,982 B2 | 7/2006 | Malvar et al. |
| 7,078,208 B2 | 7/2006 | Smith et al. |
| 7,083,970 B2 | 8/2006 | Schultz et al. |
| 7,163,824 B2 | 1/2007 | Cox, III et al. |
| 7,192,739 B2 | 3/2007 | Liu et al. |
| 7,223,545 B2 | 5/2007 | Liu et al. |
| 7,354,761 B2 | 4/2008 | Schultz et al. |
| 7,368,275 B2 | 5/2008 | Schultz et al. |
| 7,442,160 B2 | 10/2008 | Liu et al. |
| 7,476,500 B1 | 1/2009 | Liu et al. |
| 7,476,734 B2 | 1/2009 | Liu |
| 7,479,573 B2 | 1/2009 | Chu et al. |
| 7,491,494 B2 | 2/2009 | Liu et al. |
| 7,541,450 B2 | 6/2009 | Liu et al. |
| 7,557,068 B2 | 7/2009 | Liu et al. |
| 7,595,179 B2 | 9/2009 | Chen et al. |
| 7,638,300 B2 | 12/2009 | Schultz et al. |
| 7,670,807 B2 | 3/2010 | Lampson et al. |
| 7,678,554 B2 | 3/2010 | Liu et al. |
| 7,713,721 B2 | 5/2010 | Schultz et al. |
| 7,771,935 B2 | 8/2010 | Liu et al. |
| 7,794,931 B2 | 9/2010 | Breaker et al. |
| 7,807,408 B2 | 10/2010 | Liu et al. |
| 7,851,658 B2 | 12/2010 | Liu et al. |
| 7,915,025 B2 | 3/2011 | Schultz et al. |
| 7,919,277 B2 | 4/2011 | Russell et al. |
| 7,993,672 B2 | 8/2011 | Huang et al. |
| 7,998,904 B2 | 8/2011 | Liu et al. |
| 8,012,739 B2 | 9/2011 | Schultz et al. |
| 8,017,323 B2 | 9/2011 | Liu et al. |
| 8,017,755 B2 | 9/2011 | Liu et al. |
| 8,030,074 B2 | 10/2011 | Schultz et al. |
| 8,067,556 B2 | 11/2011 | Hogrefe et al. |
| 8,114,648 B2 | 2/2012 | Schultz et al. |
| 8,173,364 B2 | 5/2012 | Schultz et al. |
| 8,173,392 B2 | 5/2012 | Schultz et al. |
| 8,183,012 B2 | 5/2012 | Schultz et al. |
| 8,183,178 B2 | 5/2012 | Liu et al. |
| 8,206,914 B2 | 6/2012 | Liu et al. |
| 8,361,725 B2 | 1/2013 | Russell et al. |
| 8,394,604 B2 | 3/2013 | Liu et al. |
| 8,440,431 B2 | 5/2013 | Voytas et al. |
| 8,440,432 B2 | 5/2013 | Voytas et al. |
| 8,450,471 B2 | 5/2013 | Voytas et al. |
| 8,492,082 B2 | 7/2013 | De Franciscis et al. |
| 8,546,553 B2 | 10/2013 | Terns et al. |
| 8,569,256 B2 | 10/2013 | Heyes et al. |
| 8,586,363 B2 | 11/2013 | Voytas et al. |
| 8,680,069 B2 | 3/2014 | de Fougerolles et al. |
| 8,691,729 B2 | 4/2014 | Liu et al. |
| 8,691,750 B2 | 4/2014 | Constien et al. |
| 8,697,359 B1 | 4/2014 | Zhang |
| 8,697,853 B2 | 4/2014 | Voytas et al. |
| 8,709,466 B2 | 4/2014 | Coady et al. |
| 8,728,526 B2 | 5/2014 | Heller |
| 8,748,667 B2 | 6/2014 | Budzik et al. |
| 8,758,810 B2 | 6/2014 | Okada et al. |
| 8,759,103 B2 | 6/2014 | Kim et al. |
| 8,759,104 B2 | 6/2014 | Unciti-Broceta et al. |
| 8,771,728 B2 | 7/2014 | Huang et al. |
| 8,790,664 B2 | 7/2014 | Pitard et al. |
| 8,795,965 B2 | 8/2014 | Zhang |
| 8,822,663 B2 | 9/2014 | Schrum et al. |
| 8,835,148 B2 | 9/2014 | Janulaitis et al. |
| 8,846,578 B2 | 9/2014 | McCray et al. |
| 8,871,445 B2 | 10/2014 | Cong et al. |
| 8,889,418 B2 | 11/2014 | Zhang et al. |
| 8,900,814 B2 | 12/2014 | Yasukawa et al. |
| 8,945,839 B2 | 2/2015 | Zhang |
| 8,975,232 B2 | 3/2015 | Liu et al. |
| 8,993,233 B2 | 3/2015 | Zhang et al. |
| 8,999,641 B2 | 4/2015 | Zhang et al. |
| 9,023,594 B2 | 5/2015 | Liu et al. |
| 9,023,649 B2 | 5/2015 | Mali et al. |
| 9,034,650 B2 | 5/2015 | Padidam |
| 9,068,179 B1 | 6/2015 | Liu et al. |
| 9,150,626 B2 | 10/2015 | Liu et al. |
| 9,163,271 B2 | 10/2015 | Schultz et al. |
| 9,163,284 B2 | 10/2015 | Liu et al. |
| 9,181,535 B2 | 11/2015 | Liu et al. |
| 9,200,045 B2 | 12/2015 | Liu et al. |
| 9,221,886 B2 | 12/2015 | Liu et al. |
| 9,228,207 B2 | 1/2016 | Liu et al. |
| 9,234,213 B2 | 1/2016 | Wu |
| 9,243,038 B2 | 1/2016 | Liu et al. |

(56) References Cited

U.S. PATENT DOCUMENTS

| | | |
|---|---|---|
| 9,267,127 B2 | 2/2016 | Liu et al. |
| 9,322,006 B2 | 4/2016 | Liu et al. |
| 9,322,037 B2 | 4/2016 | Liu et al. |
| 9,340,799 B2 | 5/2016 | Liu et al. |
| 9,340,800 B2 | 5/2016 | Liu et al. |
| 9,359,599 B2 | 6/2016 | Liu et al. |
| 9,388,430 B2 | 7/2016 | Liu et al. |
| 9,394,537 B2 | 7/2016 | Liu et al. |
| 9,434,774 B2 | 9/2016 | Liu et al. |
| 9,458,484 B2 | 10/2016 | Ma et al. |
| 9,512,446 B1 | 12/2016 | Joung et al. |
| 9,526,724 B2 | 12/2016 | Oshlack et al. |
| 9,526,784 B2 | 12/2016 | Liu et al. |
| 9,534,210 B2 | 1/2017 | Park et al. |
| 9,567,589 B2 | 2/2017 | Jin et al. |
| 9,580,698 B1 | 2/2017 | Xu et al. |
| 9,610,322 B2 | 4/2017 | Liu et al. |
| 9,637,739 B2 | 5/2017 | Siksnys et al. |
| 9,663,770 B2 | 5/2017 | Rogers et al. |
| 9,737,604 B2 | 8/2017 | Liu et al. |
| 9,738,693 B2 | 8/2017 | Telford et al. |
| 9,753,340 B2 | 9/2017 | Saitou |
| 9,766,216 B2 | 9/2017 | Wada et al. |
| 9,771,574 B2 | 9/2017 | Liu et al. |
| 9,783,791 B2 | 10/2017 | Hogrefe et al. |
| 9,816,093 B1 | 11/2017 | Donohoue et al. |
| 9,840,538 B2 | 12/2017 | Telford et al. |
| 9,840,690 B2 | 12/2017 | Karli et al. |
| 9,840,699 B2 | 12/2017 | Liu et al. |
| 9,840,702 B2 | 12/2017 | Collingwood et al. |
| 9,850,521 B2 | 12/2017 | Braman et al. |
| 9,873,907 B2 | 1/2018 | Zeiner et al. |
| 9,879,270 B2 | 1/2018 | Hittinger et al. |
| 9,914,939 B2 | 3/2018 | Church et al. |
| 9,932,567 B1 | 4/2018 | Xu et al. |
| 9,938,288 B1 | 4/2018 | Kishi et al. |
| 9,944,933 B2 | 4/2018 | Storici et al. |
| 9,982,279 B1 | 5/2018 | Gill et al. |
| 9,999,671 B2 | 6/2018 | Liu et al. |
| 10,011,868 B2 | 7/2018 | Liu et al. |
| 10,053,725 B2 | 8/2018 | Liu et al. |
| 10,059,940 B2 | 8/2018 | Zhong |
| 10,077,453 B2 | 9/2018 | Liu et al. |
| 10,113,163 B2 | 10/2018 | Liu et al. |
| 10,150,955 B2 | 12/2018 | Lambowitz et al. |
| 10,167,457 B2 | 1/2019 | Liu et al. |
| 10,179,911 B2 | 1/2019 | Liu et al. |
| 10,189,831 B2 | 1/2019 | Arrington et al. |
| 10,202,593 B2 | 2/2019 | Liu et al. |
| 10,202,658 B2 | 2/2019 | Parkin et al. |
| 10,227,581 B2 | 3/2019 | Liu et al. |
| 10,323,236 B2 | 6/2019 | Liu et al. |
| 10,336,997 B2 | 7/2019 | Liu et al. |
| 10,358,670 B2 | 7/2019 | Janulaitis et al. |
| 10,392,674 B2 | 8/2019 | Liu et al. |
| 10,407,474 B2 | 9/2019 | Liu et al. |
| 10,407,697 B2 | 9/2019 | Doudna et al. |
| 10,465,176 B2 | 11/2019 | Liu et al. |
| 10,508,298 B2 | 12/2019 | Liu et al. |
| 10,583,201 B2 | 3/2020 | Chen et al. |
| 10,597,679 B2 | 3/2020 | Liu et al. |
| 10,612,011 B2 | 4/2020 | Liu et al. |
| 10,640,767 B2 | 5/2020 | Maianti et al. |
| 10,682,410 B2 | 6/2020 | Liu et al. |
| 10,704,062 B2 | 7/2020 | Liu et al. |
| 10,745,677 B2 | 8/2020 | Maianti et al. |
| 10,858,639 B2 | 12/2020 | Liu et al. |
| 10,912,833 B2 | 2/2021 | Liu et al. |
| 10,920,208 B2 | 2/2021 | Liu et al. |
| 10,930,367 B2 | 2/2021 | Zhang et al. |
| 10,947,530 B2 | 3/2021 | Liu et al. |
| 10,954,548 B2 | 3/2021 | Liu et al. |
| 11,046,948 B2 | 6/2021 | Liu et al. |
| 11,053,481 B2 | 7/2021 | Liu et al. |
| 11,124,782 B2 | 9/2021 | Liu et al. |
| 11,214,780 B2 | 1/2022 | Liu et al. |
| 11,268,082 B2 | 3/2022 | Liu et al. |
| 11,299,755 B2 | 4/2022 | Liu et al. |
| 11,306,324 B2 | 4/2022 | Liu et al. |
| 11,319,532 B2 | 5/2022 | Liu et al. |
| 11,447,770 B1 | 9/2022 | Liu et al. |
| 11,542,496 B2 | 1/2023 | Liu et al. |
| 11,542,509 B2 | 1/2023 | Maianti et al. |
| 11,560,566 B2 | 1/2023 | Liu et al. |
| 11,578,343 B2 | 2/2023 | Liu et al. |
| 11,643,652 B2 | 5/2023 | Liu et al. |
| 11,661,590 B2 | 5/2023 | Liu et al. |
| 11,702,651 B2 | 7/2023 | Liu et al. |
| 2002/0132327 A1 | 9/2002 | Hay et al. |
| 2003/0082575 A1 | 5/2003 | Schultz et al. |
| 2003/0087817 A1 | 5/2003 | Cox et al. |
| 2003/0096337 A1 | 5/2003 | Hillman et al. |
| 2003/0108885 A1 | 6/2003 | Schultz et al. |
| 2003/0119764 A1 | 6/2003 | Loeb et al. |
| 2003/0167533 A1 | 9/2003 | Yadav et al. |
| 2003/0203480 A1 | 10/2003 | Kovesdi et al. |
| 2004/0003420 A1 | 1/2004 | Kuhn et al. |
| 2004/0115184 A1 | 6/2004 | Smith et al. |
| 2004/0203109 A1 | 10/2004 | Lal et al. |
| 2005/0100973 A1 | 5/2005 | Steward et al. |
| 2005/0136429 A1 | 6/2005 | Guarente et al. |
| 2005/0222030 A1 | 10/2005 | Allison |
| 2005/0260626 A1 | 11/2005 | Lorens et al. |
| 2006/0088864 A1 | 4/2006 | Smolke et al. |
| 2006/0104984 A1 | 5/2006 | Littlefield et al. |
| 2006/0112447 A1 | 5/2006 | Bogdanova et al. |
| 2006/0160222 A1 | 7/2006 | Rozwadowski et al. |
| 2006/0166319 A1 | 7/2006 | Chan et al. |
| 2006/0246568 A1 | 11/2006 | Honjo et al. |
| 2007/0015238 A1 | 1/2007 | Snyder et al. |
| 2007/0264692 A1 | 11/2007 | Liu et al. |
| 2007/0269817 A1 | 11/2007 | Shapero |
| 2008/0008697 A1 | 1/2008 | Mintier et al. |
| 2008/0051317 A1 | 2/2008 | Church et al. |
| 2008/0124725 A1 | 5/2008 | Barrangou et al. |
| 2008/0182254 A1 | 7/2008 | Hall et al. |
| 2008/0220502 A1 | 9/2008 | Schellenberger et al. |
| 2008/0241917 A1 | 10/2008 | Akita et al. |
| 2008/0268516 A1 | 10/2008 | Perreault et al. |
| 2009/0130718 A1 | 5/2009 | Short |
| 2009/0215110 A1 | 8/2009 | Gibson et al. |
| 2009/0215878 A1 | 8/2009 | Tan et al. |
| 2009/0227463 A1 | 9/2009 | Reif et al. |
| 2009/0234109 A1 | 9/2009 | Han et al. |
| 2010/0076057 A1 | 3/2010 | Sontheimer et al. |
| 2010/0093617 A1 | 4/2010 | Barrangou et al. |
| 2010/0104690 A1 | 4/2010 | Barrangou et al. |
| 2010/0273857 A1 | 10/2010 | Thakker et al. |
| 2010/0297180 A1 | 11/2010 | Shone |
| 2010/0305197 A1 | 12/2010 | Che |
| 2010/0316643 A1 | 12/2010 | Eckert et al. |
| 2011/0016540 A1 | 1/2011 | Weinstein et al. |
| 2011/0059160 A1 | 3/2011 | Essner et al. |
| 2011/0059502 A1 | 3/2011 | Chalasani |
| 2011/0104787 A1 | 5/2011 | Church et al. |
| 2011/0177495 A1 | 7/2011 | Liu et al. |
| 2011/0189775 A1 | 8/2011 | Ainley et al. |
| 2011/0189776 A1 | 8/2011 | Terns et al. |
| 2011/0217739 A1 | 9/2011 | Terns et al. |
| 2011/0301073 A1 | 12/2011 | Gregory et al. |
| 2012/0128649 A1 | 5/2012 | Chaddock et al. |
| 2012/0129759 A1 | 5/2012 | Liu et al. |
| 2012/0141523 A1 | 6/2012 | Castado et al. |
| 2012/0244601 A1 | 9/2012 | Bertozzi et al. |
| 2012/0270273 A1 | 10/2012 | Zhang et al. |
| 2012/0322861 A1 | 12/2012 | Byrne et al. |
| 2013/0022980 A1 | 1/2013 | Nelson et al. |
| 2013/0059931 A1 | 3/2013 | Petersen-Mahrt et al. |
| 2013/0117869 A1 | 5/2013 | Duchateau et al. |
| 2013/0130248 A1 | 5/2013 | Haurwitz et al. |
| 2013/0158245 A1 | 6/2013 | Russell et al. |
| 2013/0165389 A1 | 6/2013 | Schellenberger et al. |
| 2013/0212725 A1 | 8/2013 | Kuhn et al. |
| 2013/0309720 A1 | 11/2013 | Schultz et al. |

(56) References Cited

U.S. PATENT DOCUMENTS

| | | |
|---|---|---|
| 2013/0344117 A1 | 12/2013 | Mirosevich et al. |
| 2013/0345064 A1 | 12/2013 | Liu et al. |
| 2013/0345065 A1 | 12/2013 | Hassibi et al. |
| 2014/0004280 A1 | 1/2014 | Loomis |
| 2014/0005269 A1 | 1/2014 | Ngwuluka et al. |
| 2014/0017214 A1 | 1/2014 | Cost |
| 2014/0018404 A1 | 1/2014 | Chen et al. |
| 2014/0044793 A1 | 2/2014 | Goll et al. |
| 2014/0065711 A1 | 3/2014 | Liu et al. |
| 2014/0068797 A1 | 3/2014 | Doudna et al. |
| 2014/0127752 A1 | 5/2014 | Zhou et al. |
| 2014/0141094 A1 | 5/2014 | Smyth et al. |
| 2014/0141487 A1 | 5/2014 | Feldman et al. |
| 2014/0179770 A1 | 6/2014 | Zhang et al. |
| 2014/0186843 A1 | 7/2014 | Zhang et al. |
| 2014/0186919 A1 | 7/2014 | Zhang et al. |
| 2014/0186958 A1 | 7/2014 | Zhang et al. |
| 2014/0201858 A1 | 7/2014 | Ostertag et al. |
| 2014/0234289 A1 | 8/2014 | Liu et al. |
| 2014/0248702 A1 | 9/2014 | Zhang et al. |
| 2014/0273037 A1 | 9/2014 | Wu |
| 2014/0273226 A1* | 9/2014 | Wu ................ C12N 15/907 435/455 |
| 2014/0273230 A1 | 9/2014 | Chen et al. |
| 2014/0273234 A1 | 9/2014 | Zhang et al. |
| 2014/0283156 A1 | 9/2014 | Zador et al. |
| 2014/0295556 A1 | 10/2014 | Joung et al. |
| 2014/0295557 A1 | 10/2014 | Joung et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0349400 A1 | 11/2014 | Jakimo et al. |
| 2014/0356867 A1 | 12/2014 | Peter et al. |
| 2014/0356956 A1 | 12/2014 | Church et al. |
| 2014/0356958 A1 | 12/2014 | Mali et al. |
| 2014/0356959 A1 | 12/2014 | Church et al. |
| 2014/0357523 A1 | 12/2014 | Zeiner et al. |
| 2014/0377868 A1 | 12/2014 | Joung et al. |
| 2015/0010526 A1 | 1/2015 | Liu et al. |
| 2015/0031089 A1 | 1/2015 | Lindstrom |
| 2015/0031132 A1 | 1/2015 | Church et al. |
| 2015/0031133 A1 | 1/2015 | Church et al. |
| 2015/0044191 A1 | 2/2015 | Liu et al. |
| 2015/0044192 A1 | 2/2015 | Liu et al. |
| 2015/0044772 A1 | 2/2015 | Zhao |
| 2015/0050699 A1 | 2/2015 | Siksnys et al. |
| 2015/0056177 A1 | 2/2015 | Liu et al. |
| 2015/0056629 A1 | 2/2015 | Guthrie-Honea |
| 2015/0064138 A1 | 3/2015 | Lu et al. |
| 2015/0064789 A1 | 3/2015 | Paschon et al. |
| 2015/0071898 A1 | 3/2015 | Liu et al. |
| 2015/0071899 A1 | 3/2015 | Liu et al. |
| 2015/0071900 A1 | 3/2015 | Liu et al. |
| 2015/0071901 A1 | 3/2015 | Liu et al. |
| 2015/0071902 A1 | 3/2015 | Liu et al. |
| 2015/0071903 A1 | 3/2015 | Liu et al. |
| 2015/0071906 A1 | 3/2015 | Liu et al. |
| 2015/0079680 A1 | 3/2015 | Bradley et al. |
| 2015/0079681 A1 | 3/2015 | Zhang |
| 2015/0098954 A1 | 4/2015 | Hyde et al. |
| 2015/0118216 A1 | 4/2015 | Liu et al. |
| 2015/0128300 A1 | 5/2015 | Warming et al. |
| 2015/0132269 A1 | 5/2015 | Orkin et al. |
| 2015/0140664 A1 | 5/2015 | Byrne et al. |
| 2015/0159172 A1 | 6/2015 | Miller et al. |
| 2015/0165054 A1 | 6/2015 | Liu et al. |
| 2015/0166980 A1 | 6/2015 | Liu et al. |
| 2015/0166981 A1 | 6/2015 | Liu et al. |
| 2015/0166982 A1 | 6/2015 | Liu et al. |
| 2015/0166983 A1 | 6/2015 | Liu et al. |
| 2015/0166984 A1 | 6/2015 | Liu et al. |
| 2015/0166985 A1 | 6/2015 | Liu et al. |
| 2015/0191744 A1 | 7/2015 | Wolfe et al. |
| 2015/0197759 A1 | 7/2015 | Xu et al. |
| 2015/0211058 A1 | 7/2015 | Carstens |
| 2015/0218573 A1 | 8/2015 | Loque et al. |
| 2015/0225773 A1 | 8/2015 | Farmer et al. |
| 2015/0252358 A1 | 9/2015 | Maeder et al. |
| 2015/0259721 A1 | 9/2015 | Van Brunt et al. |
| 2015/0275202 A1 | 10/2015 | Liu et al. |
| 2015/0291965 A1 | 10/2015 | Zhang et al. |
| 2015/0307889 A1 | 10/2015 | Petolino et al. |
| 2015/0315252 A1 | 11/2015 | Haugwitz et al. |
| 2015/0344549 A1 | 12/2015 | Muir et al. |
| 2016/0002301 A1 | 1/2016 | Je et al. |
| 2016/0015682 A2 | 1/2016 | Cawthorne et al. |
| 2016/0017393 A1 | 1/2016 | Jacobson et al. |
| 2016/0017396 A1 | 1/2016 | Cann et al. |
| 2016/0032292 A1 | 2/2016 | Storici et al. |
| 2016/0032353 A1 | 2/2016 | Braman et al. |
| 2016/0040155 A1 | 2/2016 | Maizels et al. |
| 2016/0046952 A1 | 2/2016 | Hittinger et al. |
| 2016/0046961 A1 | 2/2016 | Jinek et al. |
| 2016/0046962 A1 | 2/2016 | May et al. |
| 2016/0053272 A1 | 2/2016 | Wurtzel et al. |
| 2016/0053304 A1 | 2/2016 | Wurtzel et al. |
| 2016/0074535 A1 | 3/2016 | Ranganathan et al. |
| 2016/0076093 A1 | 3/2016 | Shendure et al. |
| 2016/0090603 A1 | 3/2016 | Carnes et al. |
| 2016/0090622 A1 | 3/2016 | Liu et al. |
| 2016/0115488 A1 | 4/2016 | Zhang et al. |
| 2016/0138046 A1 | 5/2016 | Wu |
| 2016/0153003 A1 | 6/2016 | Joung et al. |
| 2016/0186214 A1 | 6/2016 | Brouns et al. |
| 2016/0200779 A1 | 7/2016 | Liu et al. |
| 2016/0201040 A1 | 7/2016 | Liu et al. |
| 2016/0201089 A1 | 7/2016 | Gersbach et al. |
| 2016/0206566 A1 | 7/2016 | Lu et al. |
| 2016/0208243 A1 | 7/2016 | Zhang et al. |
| 2016/0208288 A1 | 7/2016 | Liu et al. |
| 2016/0215275 A1 | 7/2016 | Zhong |
| 2016/0215276 A1 | 7/2016 | Liu et al. |
| 2016/0215300 A1 | 7/2016 | May et al. |
| 2016/0244784 A1 | 8/2016 | Jacobson et al. |
| 2016/0244829 A1 | 8/2016 | Bang et al. |
| 2016/0264934 A1 | 9/2016 | Giallourakis et al. |
| 2016/0272593 A1 | 9/2016 | Ritter et al. |
| 2016/0272965 A1 | 9/2016 | Zhang et al. |
| 2016/0281072 A1 | 9/2016 | Zhang |
| 2016/0298136 A1 | 10/2016 | Chen et al. |
| 2016/0304846 A1 | 10/2016 | Liu et al. |
| 2016/0304855 A1 | 10/2016 | Stark et al. |
| 2016/0312304 A1 | 10/2016 | Sorrentino et al. |
| 2016/0319262 A1 | 11/2016 | Doudna et al. |
| 2016/0333389 A1 | 11/2016 | Liu et al. |
| 2016/0340622 A1 | 11/2016 | Abdou |
| 2016/0340662 A1 | 11/2016 | Zhang et al. |
| 2016/0345578 A1 | 12/2016 | Barrangou et al. |
| 2016/0346360 A1 | 12/2016 | Quake et al. |
| 2016/0346361 A1 | 12/2016 | Quake et al. |
| 2016/0346362 A1 | 12/2016 | Quake et al. |
| 2016/0348074 A1 | 12/2016 | Quake et al. |
| 2016/0348096 A1 | 12/2016 | Liu et al. |
| 2016/0350476 A1 | 12/2016 | Quake et al. |
| 2016/0355796 A1 | 12/2016 | Davidson et al. |
| 2016/0369262 A1 | 12/2016 | Reik et al. |
| 2017/0009224 A1 | 1/2017 | Liu et al. |
| 2017/0009242 A1 | 1/2017 | McKinley et al. |
| 2017/0014449 A1 | 1/2017 | Bangera et al. |
| 2017/0020922 A1 | 1/2017 | Wagner et al. |
| 2017/0029844 A1 | 2/2017 | Ball et al. |
| 2017/0037432 A1 | 2/2017 | Donohoue et al. |
| 2017/0044520 A1 | 2/2017 | Liu et al. |
| 2017/0044592 A1 | 2/2017 | Peter et al. |
| 2017/0053729 A1 | 2/2017 | Kotani et al. |
| 2017/0058271 A1 | 3/2017 | Joung et al. |
| 2017/0058272 A1 | 3/2017 | Carter et al. |
| 2017/0058298 A1 | 3/2017 | Kennedy et al. |
| 2017/0073663 A1 | 3/2017 | Wang et al. |
| 2017/0073670 A1 | 3/2017 | Nishida et al. |
| 2017/0087224 A1 | 3/2017 | Quake |
| 2017/0087225 A1 | 3/2017 | Quake |
| 2017/0088587 A1 | 3/2017 | Quake |
| 2017/0088828 A1 | 3/2017 | Quake |

(56) References Cited

U.S. PATENT DOCUMENTS

| | | |
|---|---|---|
| 2017/0107536 A1 | 4/2017 | Zhang et al. |
| 2017/0107560 A1 | 4/2017 | Peter et al. |
| 2017/0114367 A1 | 4/2017 | Hu et al. |
| 2017/0121693 A1 | 5/2017 | Liu et al. |
| 2017/0145394 A1 | 5/2017 | Yeo et al. |
| 2017/0145405 A1 | 5/2017 | Tang et al. |
| 2017/0145438 A1 | 5/2017 | Kantor |
| 2017/0152528 A1 | 6/2017 | Zhang |
| 2017/0152787 A1 | 6/2017 | Kubo et al. |
| 2017/0159033 A1 | 6/2017 | Kamtekar et al. |
| 2017/0166928 A1 | 6/2017 | Vyas et al. |
| 2017/0175104 A1 | 6/2017 | Doudna et al. |
| 2017/0175142 A1 | 6/2017 | Zhang et al. |
| 2017/0191047 A1 | 7/2017 | Terns et al. |
| 2017/0191078 A1 | 7/2017 | Zhang et al. |
| 2017/0198269 A1 | 7/2017 | Zhang et al. |
| 2017/0198277 A1 | 7/2017 | Kmiec et al. |
| 2017/0198302 A1 | 7/2017 | Feng et al. |
| 2017/0211061 A1 | 7/2017 | Weiss et al. |
| 2017/0226522 A1 | 8/2017 | Hu et al. |
| 2017/0233703 A1 | 8/2017 | Xie et al. |
| 2017/0233708 A1 | 8/2017 | Liu et al. |
| 2017/0233756 A1 | 8/2017 | Begemann et al. |
| 2017/0247671 A1 | 8/2017 | Yung et al. |
| 2017/0247703 A1 | 8/2017 | Sloan et al. |
| 2017/0268022 A1 | 9/2017 | Liu et al. |
| 2017/0275648 A1* | 9/2017 | Barrangou ......... C12N 15/8509 |
| 2017/0275665 A1 | 9/2017 | Silas et al. |
| 2017/0283797 A1 | 10/2017 | Robb et al. |
| 2017/0283831 A1 | 10/2017 | Zhang et al. |
| 2017/0306306 A1 | 10/2017 | Potter et al. |
| 2017/0314016 A1 | 11/2017 | Kim et al. |
| 2017/0362635 A1 | 12/2017 | Chamberlain et al. |
| 2018/0023062 A1 | 1/2018 | Lamb et al. |
| 2018/0057545 A9 | 3/2018 | Liu et al. |
| 2018/0064077 A1 | 3/2018 | Dunham et al. |
| 2018/0066258 A1 | 3/2018 | Powell |
| 2018/0068062 A1 | 3/2018 | Zhang et al. |
| 2018/0073012 A1 | 3/2018 | Liu et al. |
| 2018/0080051 A1 | 3/2018 | Sheikh et al. |
| 2018/0087046 A1 | 3/2018 | Badran et al. |
| 2018/0100147 A1 | 4/2018 | Yates et al. |
| 2018/0105867 A1 | 4/2018 | Xiao et al. |
| 2018/0119118 A1 | 5/2018 | Lu et al. |
| 2018/0127759 A1 | 5/2018 | Lu et al. |
| 2018/0127780 A1 | 5/2018 | Liu et al. |
| 2018/0155708 A1 | 6/2018 | Church et al. |
| 2018/0155720 A1 | 6/2018 | Donohoue et al. |
| 2018/0163213 A1 | 6/2018 | Aneja et al. |
| 2018/0170984 A1 | 6/2018 | Harris et al. |
| 2018/0179503 A1 | 6/2018 | Maianti et al. |
| 2018/0179547 A1 | 6/2018 | Zhang et al. |
| 2018/0201921 A1 | 7/2018 | Malcolm |
| 2018/0230464 A1 | 8/2018 | Zhong |
| 2018/0230471 A1 | 8/2018 | Storici et al. |
| 2018/0236081 A1 | 8/2018 | Liu et al. |
| 2018/0237758 A1 | 8/2018 | Liu et al. |
| 2018/0237787 A1 | 8/2018 | Maianti et al. |
| 2018/0245066 A1 | 8/2018 | Yao et al. |
| 2018/0245075 A1 | 8/2018 | Khalil et al. |
| 2018/0258418 A1 | 9/2018 | Kim |
| 2018/0265864 A1 | 9/2018 | Li et al. |
| 2018/0273939 A1 | 9/2018 | Yu et al. |
| 2018/0282722 A1 | 10/2018 | Jakimo et al. |
| 2018/0298391 A1 | 10/2018 | Jakimo et al. |
| 2018/0305688 A1 | 10/2018 | Zhong |
| 2018/0305704 A1 | 10/2018 | Zhang |
| 2018/0312822 A1 | 11/2018 | Lee et al. |
| 2018/0312825 A1 | 11/2018 | Liu et al. |
| 2018/0312828 A1 | 11/2018 | Liu et al. |
| 2018/0312835 A1 | 11/2018 | Yao et al. |
| 2018/0327756 A1 | 11/2018 | Zhang et al. |
| 2018/0346927 A1 | 12/2018 | Doudna et al. |
| 2018/0371497 A1 | 12/2018 | Gill et al. |
| 2019/0010481 A1 | 1/2019 | Joung et al. |
| 2019/0055543 A1 | 2/2019 | Tran et al. |
| 2019/0093099 A1 | 3/2019 | Liu et al. |
| 2019/0185883 A1 | 6/2019 | Liu et al. |
| 2019/0218547 A1 | 7/2019 | Lee et al. |
| 2019/0219575 A1 | 7/2019 | Gray et al. |
| 2019/0225955 A1 | 7/2019 | Liu et al. |
| 2019/0233847 A1 | 8/2019 | Savage et al. |
| 2019/0241633 A1 | 8/2019 | Fotin-Mleczek et al. |
| 2019/0256842 A1 | 8/2019 | Liu et al. |
| 2019/0264202 A1 | 8/2019 | Church et al. |
| 2019/0276816 A1 | 9/2019 | Liu et al. |
| 2019/0276873 A1 | 9/2019 | Dong et al. |
| 2019/0309290 A1 | 10/2019 | Neuteboom et al. |
| 2019/0322992 A1 | 10/2019 | Liu et al. |
| 2019/0352632 A1 | 11/2019 | Liu et al. |
| 2019/0367891 A1 | 12/2019 | Liu et al. |
| 2020/0010818 A1 | 1/2020 | Liu et al. |
| 2020/0010835 A1 | 1/2020 | Maianti et al. |
| 2020/0063127 A1 | 2/2020 | Lu et al. |
| 2020/0071722 A1 | 3/2020 | Liu et al. |
| 2020/0109398 A1 | 4/2020 | Rubens et al. |
| 2020/0172931 A1 | 6/2020 | Liu et al. |
| 2020/0181619 A1 | 6/2020 | Tang et al. |
| 2020/0190493 A1 | 6/2020 | Liu et al. |
| 2020/0216833 A1 | 7/2020 | Liu et al. |
| 2020/0255868 A1 | 8/2020 | Liu et al. |
| 2020/0277587 A1 | 9/2020 | Liu et al. |
| 2020/0323984 A1 | 10/2020 | Liu et al. |
| 2020/0399619 A1 | 12/2020 | Maianti et al. |
| 2020/0399626 A1 | 12/2020 | Liu et al. |
| 2021/0054416 A1 | 2/2021 | Liu et al. |
| 2021/0115428 A1 | 4/2021 | Maianti et al. |
| 2021/0196809 A1 | 7/2021 | Maianti et al. |
| 2021/0198330 A1 | 7/2021 | Liu et al. |
| 2021/0214698 A1 | 7/2021 | Liu et al. |
| 2021/0230577 A1 | 7/2021 | Liu et al. |
| 2021/0254127 A1 | 8/2021 | Liu et al. |
| 2021/0315994 A1 | 10/2021 | Liu et al. |
| 2021/0317440 A1 | 10/2021 | Liu et al. |
| 2022/0033785 A1 | 2/2022 | Liu et al. |
| 2022/0119785 A1 | 4/2022 | Liu et al. |
| 2022/0170013 A1 | 6/2022 | Liu et al. |
| 2022/0177877 A1 | 6/2022 | Church et al. |
| 2022/0204975 A1 | 6/2022 | Liu et al. |
| 2022/0213507 A1 | 7/2022 | Liu et al. |
| 2022/0220462 A1 | 7/2022 | Liu et al. |
| 2022/0238182 A1 | 7/2022 | Shen et al. |
| 2022/0249697 A1 | 8/2022 | Liu et al. |
| 2022/0282275 A1 | 9/2022 | Liu et al. |
| 2022/0290115 A1 | 9/2022 | Liu et al. |
| 2022/0307001 A1 | 9/2022 | Liu et al. |
| 2022/0307003 A1 | 9/2022 | Liu et al. |
| 2022/0315906 A1 | 10/2022 | Liu et al. |
| 2022/0356469 A1 | 11/2022 | Liu et al. |
| 2022/0380740 A1 | 12/2022 | Liu et al. |
| 2022/0389395 A1 | 12/2022 | Liu et al. |
| 2023/0002745 A1 | 1/2023 | Liu et al. |
| 2023/0021641 A1 | 1/2023 | Liu et al. |
| 2023/0056852 A1 | 2/2023 | Liu et al. |
| 2023/0058176 A1 | 2/2023 | Liu et al. |
| 2023/0078265 A1 | 3/2023 | Liu et al. |
| 2023/0086199 A1 | 3/2023 | Liu et al. |
| 2023/0090221 A1 | 3/2023 | Liu et al. |
| 2023/0108687 A1 | 4/2023 | Liu et al. |
| 2023/0123669 A1 | 4/2023 | Liu et al. |
| 2023/0127008 A1 | 4/2023 | Liu et al. |
| 2023/0159913 A1 | 5/2023 | Liu et al. |
| 2023/0193295 A1 | 6/2023 | Maianti et al. |
| 2023/0220374 A1 | 7/2023 | Liu et al. |

FOREIGN PATENT DOCUMENTS

| | | |
|---|---|---|
| AU | 2015252023 A1 | 11/2015 |
| AU | 2015101792 A4 | 1/2016 |
| BR | 112015013786 A2 | 7/2017 |
| CA | 2894668 A1 | 6/2014 |
| CA | 2894681 A1 | 6/2014 |
| CA | 2894684 A1 | 6/2014 |
| CA | 2 852 593 A1 | 11/2015 |

(56) References Cited

FOREIGN PATENT DOCUMENTS

| | | | |
|---|---|---|---|
| CN | 1069962 | A | 3/1993 |
| CN | 101460619 | A | 6/2009 |
| CN | 101873862 | A | 10/2010 |
| CN | 102892777 | A | 1/2013 |
| CN | 103224947 | A | 7/2013 |
| CN | 103233028 | A | 8/2013 |
| CN | 103388006 | A | 11/2013 |
| CN | 103614415 | A | 3/2014 |
| CN | 103642836 | A | 3/2014 |
| CN | 103668472 | A | 3/2014 |
| CN | 103820441 | A | 5/2014 |
| CN | 103820454 | A | 5/2014 |
| CN | 105602987 | A | 5/2014 |
| CN | 103911376 | A | 7/2014 |
| CN | 103923911 | A | 7/2014 |
| CN | 103088008 | A | 8/2014 |
| CN | 103981211 | A | 8/2014 |
| CN | 103981212 | A | 8/2014 |
| CN | 104004778 | A | 8/2014 |
| CN | 104004782 | A | 8/2014 |
| CN | 104017821 | A | 9/2014 |
| CN | 104109687 | A | 10/2014 |
| CN | 104178461 | A | 12/2014 |
| CN | 104342457 | A | 2/2015 |
| CN | 104404036 | A | 3/2015 |
| CN | 104450774 | A | 3/2015 |
| CN | 104480144 | A | 4/2015 |
| CN | 104498493 | A | 4/2015 |
| CN | 104504304 | A | 4/2015 |
| CN | 104531704 | A | 4/2015 |
| CN | 104531705 | A | 4/2015 |
| CN | 104560864 | A | 4/2015 |
| CN | 104561095 | A | 4/2015 |
| CN | 104593418 | A | 5/2015 |
| CN | 104593422 | A | 5/2015 |
| CN | 104611370 | A | 5/2015 |
| CN | 104651392 | A | 5/2015 |
| CN | 104651398 | A | 5/2015 |
| CN | 104651399 | A | 5/2015 |
| CN | 104651401 | A | 5/2015 |
| CN | 104673816 | A | 6/2015 |
| CN | 104725626 | A | 6/2015 |
| CN | 104726449 | A | 6/2015 |
| CN | 104726494 | A | 6/2015 |
| CN | 104745626 | A | 7/2015 |
| CN | 104762321 | A | 7/2015 |
| CN | 104805078 | A | 7/2015 |
| CN | 104805099 | A | 7/2015 |
| CN | 104805118 | A | 7/2015 |
| CN | 104846010 | A | 8/2015 |
| CN | 104894068 | A | 9/2015 |
| CN | 104894075 | A | 9/2015 |
| CN | 104928321 | A | 9/2015 |
| CN | 105039339 | A | 11/2015 |
| CN | 105039399 | A | 11/2015 |
| CN | 105063061 | A | 11/2015 |
| CN | 105087620 | A | 11/2015 |
| CN | 105112422 | A | 12/2015 |
| CN | 105112445 | A | 12/2015 |
| CN | 105112519 | A | 12/2015 |
| CN | 105121648 | A | 12/2015 |
| CN | 105132427 | A | 12/2015 |
| CN | 105132451 | A | 12/2015 |
| CN | 105177038 | A | 12/2015 |
| CN | 105177126 | A | 12/2015 |
| CN | 105210981 | A | 1/2016 |
| CN | 105219799 | A | 1/2016 |
| CN | 105238806 | A | 1/2016 |
| CN | 105255937 | A | 1/2016 |
| CN | 105274144 | A | 1/2016 |
| CN | 105296518 | A | 2/2016 |
| CN | 105296537 | A | 2/2016 |
| CN | 105316324 | A | 2/2016 |
| CN | 105316327 | A | 2/2016 |
| CN | 105316337 | A | 2/2016 |
| CN | 105331607 | A | 2/2016 |
| CN | 105331608 | A | 2/2016 |
| CN | 105331609 | A | 2/2016 |
| CN | 105331627 | A | 2/2016 |
| CN | 105400773 | A | 3/2016 |
| CN | 105400779 | A | 3/2016 |
| CN | 105400810 | A | 3/2016 |
| CN | 105441451 | A | 3/2016 |
| CN | 105462968 | A | 4/2016 |
| CN | 105463003 | A | 4/2016 |
| CN | 105463027 | A | 4/2016 |
| CN | 105492608 | A | 4/2016 |
| CN | 105492609 | A | 4/2016 |
| CN | 105505976 | A | 4/2016 |
| CN | 105505979 | A | 4/2016 |
| CN | 105518134 | A | 4/2016 |
| CN | 105518135 | A | 4/2016 |
| CN | 105518137 | A | 4/2016 |
| CN | 105518138 | A | 4/2016 |
| CN | 105518139 | A | 4/2016 |
| CN | 105518140 | A | 4/2016 |
| CN | 105543228 | A | 5/2016 |
| CN | 105543266 | A | 5/2016 |
| CN | 105543270 | A | 5/2016 |
| CN | 105567688 | A | 5/2016 |
| CN | 105567689 | A | 5/2016 |
| CN | 105567734 | A | 5/2016 |
| CN | 105567735 | A | 5/2016 |
| CN | 105567738 | A | 5/2016 |
| CN | 105593367 | A | 5/2016 |
| CN | 105594664 | A | 5/2016 |
| CN | 105624146 | A | 6/2016 |
| CN | 105624187 | A | 6/2016 |
| CN | 105646719 | A | 6/2016 |
| CN | 105647922 | A | 6/2016 |
| CN | 105647962 | A | 6/2016 |
| CN | 105647968 | A | 6/2016 |
| CN | 105647969 | A | 6/2016 |
| CN | 105671070 | A | 6/2016 |
| CN | 105671083 | A | 6/2016 |
| CN | 105695485 | A | 6/2016 |
| CN | 105779448 | A | 7/2016 |
| CN | 105779449 | A | 7/2016 |
| CN | 105802980 | A | 7/2016 |
| CN | 105821039 | A | 8/2016 |
| CN | 105821040 | A | 8/2016 |
| CN | 105821049 | A | 8/2016 |
| CN | 105821072 | A | 8/2016 |
| CN | 105821075 | A | 8/2016 |
| CN | 105821116 | A | 8/2016 |
| CN | 105838733 | A | 8/2016 |
| CN | 105861547 | A | 8/2016 |
| CN | 105861552 | A | 8/2016 |
| CN | 105861554 | A | 8/2016 |
| CN | 105886498 | A | 8/2016 |
| CN | 105886534 | A | 8/2016 |
| CN | 105886616 | A | 8/2016 |
| CN | 105907758 | A | 8/2016 |
| CN | 105907785 | A | 8/2016 |
| CN | 105925608 | A | 9/2016 |
| CN | 105934516 | A | 9/2016 |
| CN | 105950560 | A | 9/2016 |
| CN | 105950626 | A | 9/2016 |
| CN | 105950633 | A | 9/2016 |
| CN | 105950639 | A | 9/2016 |
| CN | 105985985 | A | 10/2016 |
| CN | 106011104 | A | 10/2016 |
| CN | 106011150 | A | 10/2016 |
| CN | 106011167 | A | 10/2016 |
| CN | 106011171 | A | 10/2016 |
| CN | 106032540 | A | 10/2016 |
| CN | 106047803 | A | 10/2016 |
| CN | 106047877 | A | 10/2016 |
| CN | 106047930 | A | 10/2016 |
| CN | 106086008 | A | 11/2016 |
| CN | 106086028 | A | 11/2016 |
| CN | 106086061 | A | 11/2016 |
| CN | 106086062 | A | 11/2016 |
| CN | 106109417 | A | 11/2016 |

(56) References Cited

FOREIGN PATENT DOCUMENTS

| | | | |
|---|---|---|---|
| CN | 106119275 A | 11/2016 |
| CN | 106119283 A | 11/2016 |
| CN | 106148286 A | 11/2016 |
| CN | 106148370 A | 11/2016 |
| CN | 106148416 A | 11/2016 |
| CN | 106167525 A | 11/2016 |
| CN | 106167808 A | 11/2016 |
| CN | 106167810 A | 11/2016 |
| CN | 106167821 A | 11/2016 |
| CN | 106172238 A | 12/2016 |
| CN | 106190903 A | 12/2016 |
| CN | 106191057 A | 12/2016 |
| CN | 106191061 A | 12/2016 |
| CN | 106191062 A | 12/2016 |
| CN | 106191064 A | 12/2016 |
| CN | 106191071 A | 12/2016 |
| CN | 106191099 A | 12/2016 |
| CN | 106191107 A | 12/2016 |
| CN | 106191113 A | 12/2016 |
| CN | 106191114 A | 12/2016 |
| CN | 106191116 A | 12/2016 |
| CN | 106191124 A | 12/2016 |
| CN | 106222177 A | 12/2016 |
| CN | 106222193 A | 12/2016 |
| CN | 106222203 A | 12/2016 |
| CN | 106244555 A | 12/2016 |
| CN | 106244557 A | 12/2016 |
| CN | 106244591 A | 12/2016 |
| CN | 106244609 A | 12/2016 |
| CN | 106282241 A | 1/2017 |
| CN | 106318934 A | 1/2017 |
| CN | 106318973 A | 1/2017 |
| CN | 106350540 A | 1/2017 |
| CN | 106367435 A | 2/2017 |
| CN | 106399306 A | 2/2017 |
| CN | 106399311 A | 2/2017 |
| CN | 106399360 A | 2/2017 |
| CN | 106399367 A | 2/2017 |
| CN | 106399375 A | 2/2017 |
| CN | 106399377 A | 2/2017 |
| CN | 106434651 A | 2/2017 |
| CN | 106434663 A | 2/2017 |
| CN | 106434688 A | 2/2017 |
| CN | 106434737 A | 2/2017 |
| CN | 106434748 A | 2/2017 |
| CN | 106434752 A | 2/2017 |
| CN | 106434782 A | 2/2017 |
| CN | 106446600 A | 2/2017 |
| CN | 106479985 A | 3/2017 |
| CN | 106480027 A | 3/2017 |
| CN | 106480036 A | 3/2017 |
| CN | 106480067 A | 3/2017 |
| CN | 106480080 A | 3/2017 |
| CN | 106480083 A | 3/2017 |
| CN | 106480097 A | 3/2017 |
| CN | 106544351 A | 3/2017 |
| CN | 106544353 A | 3/2017 |
| CN | 106544357 A | 3/2017 |
| CN | 106554969 A | 4/2017 |
| CN | 106566838 A | 4/2017 |
| CN | 106701763 A | 5/2017 |
| CN | 106701808 A | 5/2017 |
| CN | 106701818 A | 5/2017 |
| CN | 106701823 A | 5/2017 |
| CN | 106701830 A | 5/2017 |
| CN | 106754912 A | 5/2017 |
| CN | 106755026 A | 5/2017 |
| CN | 106755077 A | 5/2017 |
| CN | 106755088 A | 5/2017 |
| CN | 106755091 A | 5/2017 |
| CN | 106755097 A | 5/2017 |
| CN | 106755424 A | 5/2017 |
| CN | 106801056 A | 6/2017 |
| CN | 106834323 A | 6/2017 |
| CN | 106834341 A | 6/2017 |
| CN | 106834347 A | 6/2017 |
| CN | 106845151 A | 6/2017 |
| CN | 106868008 A | 6/2017 |
| CN | 106868031 A | 6/2017 |
| CN | 106906240 A | 6/2017 |
| CN | 106906242 A | 6/2017 |
| CN | 106916820 A | 7/2017 |
| CN | 106916852 A | 7/2017 |
| CN | 106939303 A | 7/2017 |
| CN | 106947750 A | 7/2017 |
| CN | 106947780 A | 7/2017 |
| CN | 106957830 A | 7/2017 |
| CN | 106957831 A | 7/2017 |
| CN | 106957844 A | 7/2017 |
| CN | 106957855 A | 7/2017 |
| CN | 106957858 A | 7/2017 |
| CN | 106967697 A | 7/2017 |
| CN | 106967726 A | 7/2017 |
| CN | 106978428 A | 7/2017 |
| CN | 106987570 A | 7/2017 |
| CN | 106987757 A | 7/2017 |
| CN | 107012164 A | 8/2017 |
| CN | 107012174 A | 8/2017 |
| CN | 107012213 A | 8/2017 |
| CN | 107012250 A | 8/2017 |
| CN | 107022562 A | 8/2017 |
| CN | 107034188 A | 8/2017 |
| CN | 107034218 A | 8/2017 |
| CN | 107034229 A | 8/2017 |
| CN | 107043775 A | 8/2017 |
| CN | 107043779 A | 8/2017 |
| CN | 107043787 A | 8/2017 |
| CN | 107058320 A | 8/2017 |
| CN | 107058328 A | 8/2017 |
| CN | 107058358 A | 8/2017 |
| CN | 107058372 A | 8/2017 |
| CN | 107083392 A | 8/2017 |
| CN | 107099533 A | 8/2017 |
| CN | 107099850 A | 8/2017 |
| CN | 107119053 A | 9/2017 |
| CN | 107119071 A | 9/2017 |
| CN | 107129999 A | 9/2017 |
| CN | 107130000 A | 9/2017 |
| CN | 107142272 A | 9/2017 |
| CN | 107142282 A | 9/2017 |
| CN | 107177591 A | 9/2017 |
| CN | 107177595 A | 9/2017 |
| CN | 107177625 A | 9/2017 |
| CN | 107177631 A | 9/2017 |
| CN | 107190006 A | 9/2017 |
| CN | 107190008 A | 9/2017 |
| CN | 107217042 A | 9/2017 |
| CN | 107217075 A | 9/2017 |
| CN | 107227307 A | 10/2017 |
| CN | 107227352 A | 10/2017 |
| CN | 107236737 A | 10/2017 |
| CN | 107236739 A | 10/2017 |
| CN | 107236741 A | 10/2017 |
| CN | 107245502 A | 10/2017 |
| CN | 107254485 A | 10/2017 |
| CN | 107266541 A | 10/2017 |
| CN | 107267515 A | 10/2017 |
| CN | 107287245 A | 10/2017 |
| CN | 107298701 A | 10/2017 |
| CN | 107299114 A | 10/2017 |
| CN | 107304435 A | 10/2017 |
| CN | 107312785 A | 11/2017 |
| CN | 107312793 A | 11/2017 |
| CN | 107312795 A | 11/2017 |
| CN | 107312798 A | 11/2017 |
| CN | 107326042 A | 11/2017 |
| CN | 107326046 A | 11/2017 |
| CN | 107354156 A | 11/2017 |
| CN | 107354173 A | 11/2017 |
| CN | 107356793 A | 11/2017 |
| CN | 107362372 A | 11/2017 |
| CN | 107365786 A | 11/2017 |
| CN | 107365804 A | 11/2017 |
| CN | 107384894 A | 11/2017 |

(56) References Cited

FOREIGN PATENT DOCUMENTS

| | | | |
|---|---|---|---|
| CN | 107384922 A | 11/2017 |
| CN | 107384926 A | 11/2017 |
| CN | 107400677 A | 11/2017 |
| CN | 107418974 A | 12/2017 |
| CN | 107435051 A | 12/2017 |
| CN | 107435069 A | 12/2017 |
| CN | 107446922 A | 12/2017 |
| CN | 107446923 A | 12/2017 |
| CN | 107446924 A | 12/2017 |
| CN | 107446932 A | 12/2017 |
| CN | 107446951 A | 12/2017 |
| CN | 107446954 A | 12/2017 |
| CN | 107460196 A | 12/2017 |
| CN | 107474129 A | 12/2017 |
| CN | 107475300 A | 12/2017 |
| CN | 107488649 A | 12/2017 |
| CN | 107502608 A | 12/2017 |
| CN | 107502618 A | 12/2017 |
| CN | 107513531 A | 12/2017 |
| CN | 107519492 A | 12/2017 |
| CN | 107523567 A | 12/2017 |
| CN | 107523583 A | 12/2017 |
| CN | 107541525 A | 1/2018 |
| CN | 107557373 A | 1/2018 |
| CN | 107557378 A | 1/2018 |
| CN | 107557381 A | 1/2018 |
| CN | 107557390 A | 1/2018 |
| CN | 107557393 A | 1/2018 |
| CN | 107557394 A | 1/2018 |
| CN | 107557455 A | 1/2018 |
| CN | 107574179 | 1/2018 |
| CN | 107586777 | 1/2018 |
| CN | 107586779 | 1/2018 |
| CN | 107604003 | 1/2018 |
| CN | 107619829 A | 1/2018 |
| CN | 107619837 A | 1/2018 |
| CN | 107630006 A | 1/2018 |
| CN | 107630041 A | 1/2018 |
| CN | 107630042 A | 1/2018 |
| CN | 107630043 A | 1/2018 |
| CN | 107641631 A | 1/2018 |
| CN | 107653256 A | 2/2018 |
| CN | 107686848 A | 2/2018 |
| CN | 206970581 | 2/2018 |
| CN | 107760652 A | 3/2018 |
| CN | 107760663 A | 3/2018 |
| CN | 107760684 A | 3/2018 |
| CN | 107760715 A | 3/2018 |
| CN | 107784200 A | 3/2018 |
| CN | 107794272 A | 3/2018 |
| CN | 107794276 A | 3/2018 |
| CN | 107815463 A | 3/2018 |
| CN | 107828738 A | 3/2018 |
| CN | 107828794 A | 3/2018 |
| CN | 107828826 A | 3/2018 |
| CN | 107828874 A | 3/2018 |
| CN | 107858346 A | 3/2018 |
| CN | 107858373 A | 3/2018 |
| CN | 107880132 A | 4/2018 |
| CN | 107881184 A | 4/2018 |
| CN | 107893074 A | 4/2018 |
| CN | 107893075 A | 4/2018 |
| CN | 107893076 A | 4/2018 |
| CN | 107893080 A | 4/2018 |
| CN | 107893086 A | 4/2018 |
| CN | 107904261 A | 4/2018 |
| CN | 107937427 A | 4/2018 |
| CN | 107937432 A | 4/2018 |
| CN | 107937501 A | 4/2018 |
| CN | 107974466 A | 5/2018 |
| CN | 107988229 A | 5/2018 |
| CN | 107988246 A | 5/2018 |
| CN | 107988256 A | 5/2018 |
| CN | 107988268 A | 5/2018 |
| CN | 108018316 A | 5/2018 |
| CN | 108034656 A | 5/2018 |
| CN | 108048466 A | 5/2018 |
| CN | 108102940 A | 6/2018 |
| CN | 108103090 A | 6/2018 |
| CN | 108103092 A | 6/2018 |
| CN | 108103098 A | 6/2018 |
| CN | 108103586 A | 6/2018 |
| CN | 108148835 A | 6/2018 |
| CN | 108148837 A | 6/2018 |
| CN | 108148873 A | 6/2018 |
| CN | 108192956 A | 6/2018 |
| CN | 108251423 A | 7/2018 |
| CN | 108251451 A | 7/2018 |
| CN | 108251452 A | 7/2018 |
| CN | 108342480 A | 7/2018 |
| CN | 108359691 A | 8/2018 |
| CN | 108359712 A | 8/2018 |
| CN | 108384784 A | 8/2018 |
| CN | 108396027 A | 8/2018 |
| CN | 108410877 A | 8/2018 |
| CN | 108410906 A | 8/2018 |
| CN | 108410907 A | 8/2018 |
| CN | 108410911 A | 8/2018 |
| CN | 108424931 A | 8/2018 |
| CN | 108441520 A | 8/2018 |
| CN | 108486108 A | 9/2018 |
| CN | 108486111 A | 9/2018 |
| CN | 108486145 A | 9/2018 |
| CN | 108486146 A | 9/2018 |
| CN | 108486154 A | 9/2018 |
| CN | 108486159 A | 9/2018 |
| CN | 108486234 A | 9/2018 |
| CN | 108504657 A | 9/2018 |
| CN | 108504685 A | 9/2018 |
| CN | 108504693 A | 9/2018 |
| CN | 108546712 A | 9/2018 |
| CN | 108546717 A | 9/2018 |
| CN | 108546718 A | 9/2018 |
| CN | 108559730 A | 9/2018 |
| CN | 108559732 A | 9/2018 |
| CN | 108559745 A | 9/2018 |
| CN | 108559760 A | 9/2018 |
| CN | 108570479 A | 9/2018 |
| CN | 108588071 A | 9/2018 |
| CN | 108588123 A | 9/2018 |
| CN | 108588128 A | 9/2018 |
| CN | 108588182 A | 9/2018 |
| CN | 108610399 A | 10/2018 |
| CN | 108611364 A | 10/2018 |
| CN | 108624622 A | 10/2018 |
| CN | 108642053 A | 10/2018 |
| CN | 108642055 A | 10/2018 |
| CN | 108642077 A | 10/2018 |
| CN | 108642078 A | 10/2018 |
| CN | 108642090 A | 10/2018 |
| CN | 108690844 A | 10/2018 |
| CN | 108707604 A | 10/2018 |
| CN | 108707620 A | 10/2018 |
| CN | 108707621 A | 10/2018 |
| CN | 108707628 A | 10/2018 |
| CN | 108707629 A | 10/2018 |
| CN | 108715850 A | 10/2018 |
| CN | 108728476 A | 11/2018 |
| CN | 108728486 A | 11/2018 |
| CN | 108753772 A | 11/2018 |
| CN | 108753783 A | 11/2018 |
| CN | 108753813 A | 11/2018 |
| CN | 108753817 A | 11/2018 |
| CN | 108753832 A | 11/2018 |
| CN | 108753835 A | 11/2018 |
| CN | 108753836 A | 11/2018 |
| CN | 108795902 A | 11/2018 |
| CN | 108822217 A | 11/2018 |
| CN | 108823248 A | 11/2018 |
| CN | 108823249 A | 11/2018 |
| CN | 108823291 A | 11/2018 |
| CN | 108841845 A | 11/2018 |
| CN | 108853133 A | 11/2018 |
| CN | 108866093 A | 11/2018 |

(56) References Cited

FOREIGN PATENT DOCUMENTS

| | | |
|---|---|---|
| CN | 108893529 A | 11/2018 |
| CN | 108913664 A | 11/2018 |
| CN | 108913691 A | 11/2018 |
| CN | 108913714 A | 11/2018 |
| CN | 108913717 A | 11/2018 |
| CN | 208034188 U | 11/2018 |
| CN | 109517841 A | 3/2019 |
| EP | 0264166 A1 | 4/1988 |
| EP | 0289479 A2 | 11/1988 |
| EP | 0321201 B2 | 6/1989 |
| EP | 0519463 A1 | 12/1992 |
| EP | 2 604 255 A1 | 6/2013 |
| EP | 2840140 A1 | 2/2015 |
| EP | 2877490 A2 | 6/2015 |
| EP | 2 966 170 A1 | 1/2016 |
| EP | 3 009 511 A2 | 4/2016 |
| EP | 3031921 A1 | 6/2016 |
| EP | 3045537 A1 | 7/2016 |
| EP | 3 115 457 A1 | 1/2017 |
| EP | 3144390 A1 | 3/2017 |
| EP | 3199632 A1 | 8/2017 |
| EP | 3216867 A1 | 9/2017 |
| EP | 3252160 A1 | 12/2017 |
| EP | 3450553 B1 | 12/2019 |
| ES | 2740248 T3 | 2/2020 |
| GB | 2 528 177 A | 1/2016 |
| GB | 2531454 A | 4/2016 |
| GB | 2531454 A1 | 4/2016 |
| GB | 2542653 A | 3/2017 |
| HK | 1208045 A1 | 2/2016 |
| JP | H0937764 A | 2/1997 |
| JP | 2007-501626 A | 2/2007 |
| JP | 2008-515405 A | 5/2008 |
| JP | 2010-033344 A | 2/2010 |
| JP | 2010-535744 A | 11/2010 |
| JP | 2010-539929 A | 12/2010 |
| JP | 2011-081011 A | 4/2011 |
| JP | 2011-523353 A | 8/2011 |
| JP | 2012-525146 A | 10/2012 |
| JP | 2012-210172 A | 11/2012 |
| JP | 2012-531909 A | 12/2012 |
| JP | 2015-523856 A | 8/2015 |
| JP | 2015-532654 A | 11/2015 |
| JP | 2016-525888 A | 9/2016 |
| JP | 2016-534132 A | 11/2016 |
| JP | 2017-500035 A | 1/2017 |
| JP | 2018-521045 A | 8/2018 |
| JP | 6629734 B2 | 1/2020 |
| KR | 101584933 B1 | 1/2016 |
| KR | 2016-0050069 A | 5/2016 |
| KR | 20160133380 A | 11/2016 |
| KR | 20170037025 A | 4/2017 |
| KR | 20170037028 A | 4/2017 |
| KR | 101748575 B1 | 6/2017 |
| KR | 20170128137 A | 11/2017 |
| KR | 2018-0022465 A | 3/2018 |
| RU | 2016104674 A | 8/2017 |
| RU | 2634395 C1 | 10/2017 |
| RU | 2652899 C1 | 5/2018 |
| RU | 2015128057 A | 3/2019 |
| RU | 2015128098 A | 3/2019 |
| RU | 2687451 C1 | 5/2019 |
| RU | 2019112514 A | 6/2019 |
| RU | 2019127300 A | 9/2019 |
| RU | 2701850 C2 | 10/2019 |
| SG | 10201707569 Y | 10/2017 |
| SG | 10201710486 | 1/2018 |
| SG | 10201710487 | 1/2018 |
| SG | 10201710488 T | 1/2018 |
| TW | I608100 B | 12/2017 |
| TW | 2018-29773 A | 8/2018 |
| WO | WO 1990/002809 A1 | 3/1990 |
| WO | WO 1991/003162 A1 | 3/1991 |
| WO | WO 1991/016024 A1 | 10/1991 |
| WO | WO 1991/017271 A1 | 11/1991 |
| WO | WO 1991/017424 A1 | 11/1991 |
| WO | WO 1992/001047 A1 | 1/1992 |
| WO | WO 1992/006188 A2 | 4/1992 |
| WO | WO 1992/006200 A1 | 4/1992 |
| WO | WO 1992/007065 A1 | 4/1992 |
| WO | WO 1992/009690 A2 | 6/1992 |
| WO | WO 1992/015679 A1 | 9/1992 |
| WO | WO 1992/018619 A1 | 10/1992 |
| WO | WO 1992/020791 A1 | 11/1992 |
| WO | WO 1993/001288 A1 | 1/1993 |
| WO | WO 1993/015187 A1 | 8/1993 |
| WO | WO 1993/024641 A2 | 12/1993 |
| WO | WO 1994/018316 A2 | 8/1994 |
| WO | WO 1994/026877 A1 | 11/1994 |
| WO | WO 1996/004403 A1 | 2/1996 |
| WO | WO 1996/010640 A1 | 4/1996 |
| WO | WO 1998/032845 A1 | 7/1998 |
| WO | WO 00/71694 A1 | 11/2000 |
| WO | WO 01/05950 A2 | 1/2001 |
| WO | WO 2001/036452 A2 | 5/2001 |
| WO | WO 2001/38547 A2 | 5/2001 |
| WO | WO 01/61049 A1 | 8/2001 |
| WO | WO 2002/059296 A2 | 8/2002 |
| WO | WO 2002/068676 A2 | 9/2002 |
| WO | WO 2002/103028 A2 | 12/2002 |
| WO | WO 2004/007684 A2 | 1/2004 |
| WO | WO 2005/014791 A2 | 2/2005 |
| WO | WO 2005/019415 A2 | 3/2005 |
| WO | WO 2005/081632 A2 | 9/2005 |
| WO | WO 2006/002547 A1 | 1/2006 |
| WO | WO 2006/042112 A2 | 4/2006 |
| WO | WO 2007/025097 A2 | 3/2007 |
| WO | WO 2007/037444 A1 | 4/2007 |
| WO | WO 2007/066923 A1 | 6/2007 |
| WO | WO 2007/136815 A2 | 11/2007 |
| WO | WO 2007/143574 A1 | 12/2007 |
| WO | WO 2008/005529 A2 | 1/2008 |
| WO | WO 2008/108989 A2 | 9/2008 |
| WO | WO 2009/002418 A2 | 12/2008 |
| WO | WO 2009/082488 A2 | 7/2009 |
| WO | WO 2009/098290 A1 | 8/2009 |
| WO | WO 2009/108180 A2 | 9/2009 |
| WO | WO 2009/134808 A2 | 11/2009 |
| WO | WO 2010/011961 A1 | 1/2010 |
| WO | WO 2010/012902 A1 | 2/2010 |
| WO | WO 2010/028347 A2 | 3/2010 |
| WO | WO 2010/054108 A2 | 5/2010 |
| WO | WO 2010/054154 A2 | 5/2010 |
| WO | WO 2010/068289 A2 | 6/2010 |
| WO | WO 2010/075424 A2 | 7/2010 |
| WO | WO 2010/102257 A2 | 9/2010 |
| WO | WO 2010/104749 A2 | 9/2010 |
| WO | WO 2010/129019 A2 | 11/2010 |
| WO | WO 2010/129023 A2 | 11/2010 |
| WO | WO 2010/132092 A2 | 11/2010 |
| WO | WO 2010/144150 A2 | 12/2010 |
| WO | WO 2011/002503 A1 | 1/2011 |
| WO | WO 2011/017293 A2 | 2/2011 |
| WO | WO 2011/039518 A2 | 4/2011 |
| WO | WO 2011/053868 A1 | 5/2011 |
| WO | WO 2011/053982 A2 | 5/2011 |
| WO | WO 2011/066747 A1 | 6/2011 |
| WO | WO 2011/068810 A1 | 6/2011 |
| WO | WO 2011/075627 A1 | 6/2011 |
| WO | WO 2011/091311 A2 | 7/2011 |
| WO | WO 2011/091396 A1 | 7/2011 |
| WO | WO 2011/109031 A1 | 9/2011 |
| WO | WO 2011/143124 A2 | 11/2011 |
| WO | WO 2011/147590 A2 | 12/2011 |
| WO | WO 2011/159369 A1 | 12/2011 |
| WO | WO 2012/054726 A1 | 4/2012 |
| WO | WO 2012/065043 A2 | 5/2012 |
| WO | WO 2012/088381 A2 | 6/2012 |
| WO | WO 2012/125445 A2 | 9/2012 |
| WO | WO 2012/138927 A2 | 10/2012 |
| WO | WO 2012/149470 A1 | 11/2012 |
| WO | WO 2012/158985 A2 | 11/2012 |
| WO | WO 2012/158986 A2 | 11/2012 |
| WO | WO 2012/164565 A1 | 12/2012 |

(56) References Cited

FOREIGN PATENT DOCUMENTS

| | | |
|---|---|---|
| WO | WO 2012/170930 A1 | 12/2012 |
| WO | WO 2013/012674 A1 | 1/2013 |
| WO | WO 2013/013105 A2 | 1/2013 |
| WO | WO 2013/039857 A1 | 3/2013 |
| WO | WO 2013/039861 A2 | 3/2013 |
| WO | WO 2013/045632 A1 | 4/2013 |
| WO | WO 2013/047844 A1 | 4/2013 |
| WO | WO 2013/066438 A2 | 5/2013 |
| WO | WO 2013/086441 A2 | 6/2013 |
| WO | WO 2013/086444 A2 | 6/2013 |
| WO | WO 2013/098244 A1 | 7/2013 |
| WO | WO 2013/119602 A1 | 8/2013 |
| WO | WO 2013/126794 A1 | 8/2013 |
| WO | WO 2013/130824 A1 | 9/2013 |
| WO | WO 2013/141680 A1 | 9/2013 |
| WO | WO 2013/142578 A1 | 9/2013 |
| WO | WO 2013/142578 A2 | 9/2013 |
| WO | WO 2013/152359 A1 | 10/2013 |
| WO | WO 2013/160230 A1 | 10/2013 |
| WO | WO 2013/166315 A1 | 11/2013 |
| WO | WO 2013/169398 A2 | 11/2013 |
| WO | WO 2013/169802 A1 | 11/2013 |
| WO | WO 2013/176772 A1 | 11/2013 |
| WO | WO 2013/176772 A2 | 11/2013 |
| WO | WO 2013/176915 A1 | 11/2013 |
| WO | WO 2013/176916 A1 | 11/2013 |
| WO | WO 2013/181440 A1 | 12/2013 |
| WO | WO 2013/186754 A2 | 12/2013 |
| WO | WO 2013/188037 A2 | 12/2013 |
| WO | WO 2013/188522 A2 | 12/2013 |
| WO | WO 2013/188638 A2 | 12/2013 |
| WO | WO 2013/192278 A1 | 12/2013 |
| WO | WO 2013/142378 A9 | 1/2014 |
| WO | WO 2014/004336 A2 | 1/2014 |
| WO | WO 2014/005042 A2 | 1/2014 |
| WO | WO 2014/011237 A1 | 1/2014 |
| WO | WO 2014/011901 A2 | 1/2014 |
| WO | WO 2014/018423 A2 | 1/2014 |
| WO | WO 2014/020608 A1 | 2/2014 |
| WO | WO 2014/022120 A1 | 2/2014 |
| WO | WO 2014/022702 A2 | 2/2014 |
| WO | WO 2014/036219 A2 | 3/2014 |
| WO | WO 2014/039513 A2 | 3/2014 |
| WO | WO 2014/039523 A1 | 3/2014 |
| WO | WO 2014/039585 A2 | 3/2014 |
| WO | WO 2014/039684 A1 | 3/2014 |
| WO | WO 2014/039692 A2 | 3/2014 |
| WO | WO 2014/039702 A2 | 3/2014 |
| WO | WO 2014/039872 A1 | 3/2014 |
| WO | WO 2014/039970 A1 | 3/2014 |
| WO | WO 2014/041327 A1 | 3/2014 |
| WO | WO 2014/043143 A1 | 3/2014 |
| WO | WO 2014/047103 A2 | 3/2014 |
| WO | WO 2014/055782 A1 | 4/2014 |
| WO | WO 2014/059173 A2 | 4/2014 |
| WO | WO 2014/059255 A1 | 4/2014 |
| WO | WO 2014/065596 A1 | 5/2014 |
| WO | WO 2014/066505 A1 | 5/2014 |
| WO | WO 2014/068346 A2 | 5/2014 |
| WO | WO 2014/070887 A1 | 5/2014 |
| WO | WO 2014/071006 A1 | 5/2014 |
| WO | WO 2014/071219 A1 | 5/2014 |
| WO | WO 2014/071235 A1 | 5/2014 |
| WO | WO 2014/072941 A1 | 5/2014 |
| WO | WO 2014/081729 A1 | 5/2014 |
| WO | WO 2014/081730 A1 | 5/2014 |
| WO | WO 2014/081855 A1 | 5/2014 |
| WO | WO 2014/082644 A1 | 6/2014 |
| WO | WO 2014/085261 A1 | 6/2014 |
| WO | WO 2014/085593 A1 | 6/2014 |
| WO | WO 2014/085830 A2 | 6/2014 |
| WO | WO 2014/089212 A1 | 6/2014 |
| WO | WO 2014/089290 A1 | 6/2014 |
| WO | WO 2014/089348 A1 | 6/2014 |
| WO | WO 2014/089513 A1 | 6/2014 |
| WO | WO 2014/089533 A2 | 6/2014 |
| WO | WO 2014/089541 A2 | 6/2014 |
| WO | WO 2014/093479 A1 | 6/2014 |
| WO | WO 2014/093595 A1 | 6/2014 |
| WO | WO 2014/093622 A2 | 6/2014 |
| WO | WO 2014/093635 A1 | 6/2014 |
| WO | WO 2014/093655 A2 | 6/2014 |
| WO | WO 2014/093661 A2 | 6/2014 |
| WO | WO 2014/093694 A1 | 6/2014 |
| WO | WO 2014/093701 A1 | 6/2014 |
| WO | WO 2014/093709 A1 | 6/2014 |
| WO | WO 2014/093712 A1 | 6/2014 |
| WO | WO 2014/093718 A1 | 6/2014 |
| WO | WO 2014/093736 A1 | 6/2014 |
| WO | WO 2014/093768 A1 | 6/2014 |
| WO | WO 2014/093852 A1 | 6/2014 |
| WO | WO 2014/096972 A2 | 6/2014 |
| WO | WO 2014/099744 A1 | 6/2014 |
| WO | WO 2014/099750 A2 | 6/2014 |
| WO | WO 2014/104878 A1 | 7/2014 |
| WO | WO 2014/110006 A1 | 7/2014 |
| WO | WO 2014/110552 A1 | 7/2014 |
| WO | WO 2014/113493 A1 | 7/2014 |
| WO | WO 2014/123967 A2 | 8/2014 |
| WO | WO 2014/124226 A1 | 8/2014 |
| WO | WO 2014/125668 A1 | 8/2014 |
| WO | WO 2014/127287 A1 | 8/2014 |
| WO | WO 2014/128324 A1 | 8/2014 |
| WO | WO 2014/128659 A1 | 8/2014 |
| WO | WO 2014/130706 A1 | 8/2014 |
| WO | WO 2014/130955 A1 | 8/2014 |
| WO | WO 2014/131833 A1 | 9/2014 |
| WO | WO 2014/138379 A1 | 9/2014 |
| WO | WO 2014/143381 A1 | 9/2014 |
| WO | WO 2014/144094 A1 | 9/2014 |
| WO | WO 2014/144155 A1 | 9/2014 |
| WO | WO 2014/144288 A1 | 9/2014 |
| WO | WO 2014/144592 A2 | 9/2014 |
| WO | WO 2014/144761 A2 | 9/2014 |
| WO | WO 2014/144951 A1 | 9/2014 |
| WO | WO 2014/145599 A2 | 9/2014 |
| WO | WO 2014/145736 A2 | 9/2014 |
| WO | WO 2014/150624 A1 | 9/2014 |
| WO | WO 2014/152432 A2 | 9/2014 |
| WO | WO 2014/152940 A1 | 9/2014 |
| WO | WO 2014/153118 A1 | 9/2014 |
| WO | WO 2014/153470 A2 | 9/2014 |
| WO | WO 2014/157820 A1 | 10/2014 |
| WO | WO 2014/158593 A1 | 10/2014 |
| WO | WO 2014/161821 A1 | 10/2014 |
| WO | WO 2014/164466 A1 | 10/2014 |
| WO | WO 2014/165177 A1 | 10/2014 |
| WO | WO 2014/165349 A1 | 10/2014 |
| WO | WO 2014/165612 A2 | 10/2014 |
| WO | WO 2014/165707 A2 | 10/2014 |
| WO | WO 2014/165825 A2 | 10/2014 |
| WO | WO 2014/172458 A1 | 10/2014 |
| WO | WO 2014/172470 A2 | 10/2014 |
| WO | WO 2014/172489 A2 | 10/2014 |
| WO | WO 2014/173955 A1 | 10/2014 |
| WO | WO 2014/182700 A1 | 11/2014 |
| WO | WO 2014/183071 A2 | 11/2014 |
| WO | WO 2014/184143 A1 | 11/2014 |
| WO | WO 2014/184741 A1 | 11/2014 |
| WO | WO 2014/184744 A1 | 11/2014 |
| WO | WO 2014/186585 A2 | 11/2014 |
| WO | WO 2014/186686 A2 | 11/2014 |
| WO | WO 2014/190181 A1 | 11/2014 |
| WO | WO 2014/191128 A1 | 12/2014 |
| WO | WO 2014/191518 A1 | 12/2014 |
| WO | WO 2014/191521 A2 | 12/2014 |
| WO | WO 2014/191525 A1 | 12/2014 |
| WO | WO 2014/191527 A1 | 12/2014 |
| WO | WO 2014/193583 A2 | 12/2014 |
| WO | WO 2014/194190 A1 | 12/2014 |
| WO | WO 2014/197568 A2 | 12/2014 |
| WO | WO 2014/199358 A1 | 12/2014 |
| WO | WO 2014/200659 A1 | 12/2014 |
| WO | WO 2014/201015 A2 | 12/2014 |

(56) References Cited

FOREIGN PATENT DOCUMENTS

| | | |
|---|---|---|
| WO | WO 2014/204578 A1 | 12/2014 |
| WO | WO 2014/204723 A1 | 12/2014 |
| WO | WO 2014/204724 A1 | 12/2014 |
| WO | WO 2014/204725 A1 | 12/2014 |
| WO | WO 2014/204726 A1 | 12/2014 |
| WO | WO 2014/204727 A1 | 12/2014 |
| WO | WO 2014/204728 A1 | 12/2014 |
| WO | WO 2014/204729 A1 | 12/2014 |
| WO | WO 2014/205192 A2 | 12/2014 |
| WO | WO 2014/207043 A1 | 12/2014 |
| WO | WO 2014197748 A2 | 12/2014 |
| WO | WO 2015/002780 A1 | 1/2015 |
| WO | WO 2015/004241 A2 | 1/2015 |
| WO | WO 2015/006290 A1 | 1/2015 |
| WO | WO 2015/006294 A2 | 1/2015 |
| WO | WO 2015/006437 A1 | 1/2015 |
| WO | WO 2015/006498 A2 | 1/2015 |
| WO | WO 2015/007194 A1 | 1/2015 |
| WO | WO 2015/010114 A1 | 1/2015 |
| WO | WO 2015/011483 A1 | 1/2015 |
| WO | WO 2015/013583 A2 | 1/2015 |
| WO | WO 2015006747 A2 | 1/2015 |
| WO | WO 2015/017866 A1 | 2/2015 |
| WO | WO 2015/018503 A1 | 2/2015 |
| WO | WO 2015/021353 A1 | 2/2015 |
| WO | WO 2015/021426 A1 | 2/2015 |
| WO | WO 2015/021990 A1 | 2/2015 |
| WO | WO 2015/024017 A2 | 2/2015 |
| WO | WO 2015/024986 A1 | 2/2015 |
| WO | WO 2015/026883 A1 | 2/2015 |
| WO | WO 2015/026885 A1 | 2/2015 |
| WO | WO 2015/026886 A1 | 2/2015 |
| WO | WO 2015/026887 A1 | 2/2015 |
| WO | WO 2015/027134 A1 | 2/2015 |
| WO | WO 2015/028969 A2 | 3/2015 |
| WO | WO 2015/030881 A1 | 3/2015 |
| WO | WO 2015/031619 A1 | 3/2015 |
| WO | WO 2015/031775 A1 | 3/2015 |
| WO | WO 2015/032494 A2 | 3/2015 |
| WO | WO 2015/033293 A1 | 3/2015 |
| WO | WO 2015/034872 A2 | 3/2015 |
| WO | WO 2015/034885 A1 | 3/2015 |
| WO | WO 2015/035136 A2 | 3/2015 |
| WO | WO 2015/035139 A2 | 3/2015 |
| WO | WO 2015/035162 A2 | 3/2015 |
| WO | WO 2015/040075 A1 | 3/2015 |
| WO | WO 2015/040402 A1 | 3/2015 |
| WO | WO 2015/042393 A2 | 3/2015 |
| WO | WO 2015/042585 A1 | 3/2015 |
| WO | WO 2015/048577 A2 | 4/2015 |
| WO | WO 2015/048690 A1 | 4/2015 |
| WO | WO 2015/048707 A2 | 4/2015 |
| WO | WO 2015/048801 A2 | 4/2015 |
| WO | WO 2015/049897 A1 | 4/2015 |
| WO | WO 2015/051191 A1 | 4/2015 |
| WO | WO 2015/052133 A1 | 4/2015 |
| WO | WO 2015/052231 A2 | 4/2015 |
| WO | WO 2015/052335 A1 | 4/2015 |
| WO | WO 2015/053995 A1 | 4/2015 |
| WO | WO 2015/054253 A1 | 4/2015 |
| WO | WO 2015/054315 A1 | 4/2015 |
| WO | WO 2015/057671 A1 | 4/2015 |
| WO | WO 2015/057834 A1 | 4/2015 |
| WO | WO 2015/057852 A1 | 4/2015 |
| WO | WO 2015/057976 A1 | 4/2015 |
| WO | WO 2015/057980 A1 | 4/2015 |
| WO | WO 2015/059265 A1 | 4/2015 |
| WO | WO 2015/065964 A1 | 5/2015 |
| WO | WO 2015/066119 A1 | 5/2015 |
| WO | WO 2015/066634 A2 | 5/2015 |
| WO | WO 2015/066636 A2 | 5/2015 |
| WO | WO 2015/066637 A1 | 5/2015 |
| WO | WO 2015/066638 A2 | 5/2015 |
| WO | WO 2015/066643 A1 | 5/2015 |
| WO | WO 2015/069682 A2 | 5/2015 |
| WO | WO 2015/070083 A1 | 5/2015 |
| WO | WO 2015/070193 A1 | 5/2015 |
| WO | WO 2015/070212 A1 | 5/2015 |
| WO | WO 2015/071474 A2 | 5/2015 |
| WO | WO 2015/073683 A2 | 5/2015 |
| WO | WO 2015/073867 A1 | 5/2015 |
| WO | WO 2015/073990 A1 | 5/2015 |
| WO | WO 2015/075056 A1 | 5/2015 |
| WO | WO 2015/075175 A1 | 5/2015 |
| WO | WO 2015/075195 A1 | 5/2015 |
| WO | WO 2015/075557 A2 | 5/2015 |
| WO | WO 2015/077058 A2 | 5/2015 |
| WO | WO 2015/077290 A2 | 5/2015 |
| WO | WO 2015/077318 A1 | 5/2015 |
| WO | WP 2015/075154 A2 | 5/2015 |
| WO | WO 2015/079056 A1 | 6/2015 |
| WO | WO 2015/079057 A2 | 6/2015 |
| WO | WO 2015/086795 A1 | 6/2015 |
| WO | WO 2015/086798 A2 | 6/2015 |
| WO | WO 2015/088643 A1 | 6/2015 |
| WO | WO 2015/089046 A1 | 6/2015 |
| WO | WO 2015/089077 A2 | 6/2015 |
| WO | WO 2015/089277 A1 | 6/2015 |
| WO | WO 2015/089351 A1 | 6/2015 |
| WO | WO 2015/089354 A1 | 6/2015 |
| WO | WO 2015/089364 A1 | 6/2015 |
| WO | WO 2015/089406 A1 | 6/2015 |
| WO | WO 2015/089419 A2 | 6/2015 |
| WO | WO 2015/089427 A1 | 6/2015 |
| WO | WO 2015/089462 A1 | 6/2015 |
| WO | WO 2015/089465 A1 | 6/2015 |
| WO | WO 2015/089473 A1 | 6/2015 |
| WO | WO 2015/089486 A2 | 6/2015 |
| WO | WO 2015/095804 A1 | 6/2015 |
| WO | WO 2015/099850 A1 | 7/2015 |
| WO | WO 2015/100929 A1 | 7/2015 |
| WO | WO 2015/103057 A1 | 7/2015 |
| WO | WO 2015/103153 A1 | 7/2015 |
| WO | WO 2015/105928 A1 | 7/2015 |
| WO | WO 2015/108993 A1 | 7/2015 |
| WO | WO 2015/109752 A1 | 7/2015 |
| WO | WO 2015/110474 A1 | 7/2015 |
| WO | WO 2015/112790 A2 | 7/2015 |
| WO | WO 2015/112896 A2 | 7/2015 |
| WO | WO 2015/113063 A1 | 7/2015 |
| WO | WO 2015/114365 A1 | 8/2015 |
| WO | WO 2015/115903 A1 | 8/2015 |
| WO | WO 2015/116686 A1 | 8/2015 |
| WO | WO 2015/116969 A2 | 8/2015 |
| WO | WO 2015/117021 A1 | 8/2015 |
| WO | WO 2015/117041 A1 | 8/2015 |
| WO | WO 2015/117081 A2 | 8/2015 |
| WO | WO 2015/118156 A1 | 8/2015 |
| WO | WO 2015/119941 A2 | 8/2015 |
| WO | WO 2015/121454 A1 | 8/2015 |
| WO | WO 2015/122967 A1 | 8/2015 |
| WO | WO 2015/123339 A1 | 8/2015 |
| WO | WO 2015/124715 A1 | 8/2015 |
| WO | WO 2015/124718 A1 | 8/2015 |
| WO | WO 2015/126927 A2 | 8/2015 |
| WO | WO 2015/127428 A1 | 8/2015 |
| WO | WO 2015/127439 A1 | 8/2015 |
| WO | WO 2015/129686 A1 | 9/2015 |
| WO | WO 2015/131101 A1 | 9/2015 |
| WO | WO 2015/133554 A1 | 9/2015 |
| WO | WO 2015/134121 A2 | 9/2015 |
| WO | WO 2015/134812 A1 | 9/2015 |
| WO | WO 2015/136001 A1 | 9/2015 |
| WO | WO 2015/138510 A1 | 9/2015 |
| WO | WO 2015/138739 A2 | 9/2015 |
| WO | WO 2015/138855 A1 | 9/2015 |
| WO | WO 2015/138870 A2 | 9/2015 |
| WO | WO 2015/139008 A1 | 9/2015 |
| WO | WO 2015/139139 A1 | 9/2015 |
| WO | WO 2015/143046 A2 | 9/2015 |
| WO | WO 2015/143177 A1 | 9/2015 |
| WO | WO 2015/145417 A1 | 10/2015 |
| WO | WO 2015/148431 A1 | 10/2015 |
| WO | WO 2015/148670 A1 | 10/2015 |

(56) References Cited

FOREIGN PATENT DOCUMENTS

| | | |
|---|---|---|
| WO | WO 2015/148680 A1 | 10/2015 |
| WO | WO 2015/148761 A1 | 10/2015 |
| WO | WO 2015/148860 A1 | 10/2015 |
| WO | WO 2015/148863 A2 | 10/2015 |
| WO | WO 2015/153760 A2 | 10/2015 |
| WO | WO 2015/153780 A1 | 10/2015 |
| WO | WO 2015/153789 A1 | 10/2015 |
| WO | WO 2015/153791 A1 | 10/2015 |
| WO | WO 2015/153889 A2 | 10/2015 |
| WO | WO 2015/153940 A1 | 10/2015 |
| WO | WO 2015/155341 A1 | 10/2015 |
| WO | WO 2015/155686 A2 | 10/2015 |
| WO | WO 2015/157070 A2 | 10/2015 |
| WO | WO 2015/157534 A1 | 10/2015 |
| WO | WO 2015/159068 A1 | 10/2015 |
| WO | WO 2015/159086 A1 | 10/2015 |
| WO | WO 2015/159087 A1 | 10/2015 |
| WO | WO 2015/160683 A1 | 10/2015 |
| WO | WO 2015/161276 A2 | 10/2015 |
| WO | WO 2015/163733 A1 | 10/2015 |
| WO | WO 2015/164740 A1 | 10/2015 |
| WO | WO 2015/164748 A1 | 10/2015 |
| WO | WO 2015/165274 A1 | 11/2015 |
| WO | WO 2015/165275 A1 | 11/2015 |
| WO | WO 2015/165276 A1 | 11/2015 |
| WO | WO 2015/166272 A2 | 11/2015 |
| WO | WO 2015/167766 A1 | 11/2015 |
| WO | WO 2015/167956 A1 | 11/2015 |
| WO | WO 2015/168125 A1 | 11/2015 |
| WO | WO 2015/168158 A1 | 11/2015 |
| WO | WO 2015/168404 A1 | 11/2015 |
| WO | WO 2015/168547 A2 | 11/2015 |
| WO | WO 2015/168800 A1 | 11/2015 |
| WO | WO 2015/171603 A1 | 11/2015 |
| WO | WO 2015/171894 A1 | 11/2015 |
| WO | WO 2015/171932 A1 | 11/2015 |
| WO | WO 2015/172128 A1 | 11/2015 |
| WO | WO 2015/173436 A1 | 11/2015 |
| WO | WO 2015/175642 A2 | 11/2015 |
| WO | WO 2015/179540 A1 | 11/2015 |
| WO | WO 2015/183025 A1 | 12/2015 |
| WO | WO 2015/183026 A1 | 12/2015 |
| WO | WO 2015/183885 A1 | 12/2015 |
| WO | WO 2015/184259 A1 | 12/2015 |
| WO | WO 2015/184262 A1 | 12/2015 |
| WO | WO 2015/184268 A1 | 12/2015 |
| WO | WO 2015/188056 A1 | 12/2015 |
| WO | WO 2015/188065 A1 | 12/2015 |
| WO | WO 2015/188094 A1 | 12/2015 |
| WO | WO 2015/188109 A1 | 12/2015 |
| WO | WO 2015/188132 A1 | 12/2015 |
| WO | WO 2015/188135 A1 | 12/2015 |
| WO | WO 2015/188191 A1 | 12/2015 |
| WO | WO 2015/189693 A1 | 12/2015 |
| WO | WO 2015/191693 A2 | 12/2015 |
| WO | WO 2015/191899 A1 | 12/2015 |
| WO | WO 2015/191911 A2 | 12/2015 |
| WO | WO 2015/193858 A1 | 12/2015 |
| WO | WO 2015/193897 A1 | 12/2015 |
| WO | WO 2015/195547 A1 | 12/2015 |
| WO | WO 2015/195621 A1 | 12/2015 |
| WO | WO 2015/195798 A1 | 12/2015 |
| WO | WO 2015/198020 A1 | 12/2015 |
| WO | WO 2015/200334 A1 | 12/2015 |
| WO | WO 2015/200378 A1 | 12/2015 |
| WO | WO 2015/200555 A2 | 12/2015 |
| WO | WO 2015/200805 A2 | 12/2015 |
| WO | WO 2016/001978 A1 | 1/2016 |
| WO | WO 2016/004010 A1 | 1/2016 |
| WO | WO 2016/004318 A1 | 1/2016 |
| WO | WO 2016/007347 A1 | 1/2016 |
| WO | WO 2016/007604 A1 | 1/2016 |
| WO | WO 2016/007948 A1 | 1/2016 |
| WO | WO 2016/011080 A2 | 1/2016 |
| WO | WO 2016/011210 A2 | 1/2016 |
| WO | WO 2016/011428 A1 | 1/2016 |
| WO | WO 2016/012544 A2 | 1/2016 |
| WO | WO 2016/012552 A1 | 1/2016 |
| WO | WO 2016/014409 A1 | 1/2016 |
| WO | WO 2016/014565 A2 | 1/2016 |
| WO | WO 2016/014794 A1 | 1/2016 |
| WO | WO 2016/014837 A1 | 1/2016 |
| WO | WO 2016/016119 A1 | 2/2016 |
| WO | WO 2016/016358 A1 | 2/2016 |
| WO | WO 2016/019144 A2 | 2/2016 |
| WO | WO 2016/020399 A1 | 2/2016 |
| WO | WO 2016/021972 A1 | 2/2016 |
| WO | WO 2016/021973 A1 | 2/2016 |
| WO | WO 2016/022363 A2 | 2/2016 |
| WO | WO 2016/022866 A1 | 2/2016 |
| WO | WO 2016/022931 A1 | 2/2016 |
| WO | WO 2016/025131 A1 | 2/2016 |
| WO | WO 2016/025469 A1 | 2/2016 |
| WO | WO 2016/025759 A1 | 2/2016 |
| WO | WO 2016/026444 A1 | 2/2016 |
| WO | WO 2016/028682 A1 | 2/2016 |
| WO | WO 2016/028843 A2 | 2/2016 |
| WO | WO 2016/028887 A1 | 2/2016 |
| WO | WO 2016/033088 A1 | 3/2016 |
| WO | WO 2016/033230 A1 | 3/2016 |
| WO | WO 2016/033246 A1 | 3/2016 |
| WO | WO 2016/033298 A1 | 3/2016 |
| WO | WO 2016/035044 A1 | 3/2016 |
| WO | WO 2016/036754 A1 | 3/2016 |
| WO | WO 2016/037157 A2 | 3/2016 |
| WO | WO 2016/040030 A1 | 3/2016 |
| WO | WO 2016/040594 A1 | 3/2016 |
| WO | WO 2016/044182 A1 | 3/2016 |
| WO | WO 2016/044416 A1 | 3/2016 |
| WO | WO 2016/046635 A1 | 3/2016 |
| WO | WO 2016/049024 A2 | 3/2016 |
| WO | WO 2016/049163 A2 | 3/2016 |
| WO | WO 2016/049230 A1 | 3/2016 |
| WO | WO 2016/049251 A1 | 3/2016 |
| WO | WO 2016/049258 A2 | 3/2016 |
| WO | WO 2016/053397 A2 | 4/2016 |
| WO | WO 2016/054326 A1 | 4/2016 |
| WO | WO 2016/057061 A2 | 4/2016 |
| WO | WO 2016/057821 A2 | 4/2016 |
| WO | WO 2016/057835 A2 | 4/2016 |
| WO | WO 2016/057850 A1 | 4/2016 |
| WO | WO 2016/057951 A2 | 4/2016 |
| WO | WO 2016/057961 A1 | 4/2016 |
| WO | WO 2016/061073 A1 | 4/2016 |
| WO | WO 2016/061374 A1 | 4/2016 |
| WO | WO 2016/061481 A1 | 4/2016 |
| WO | WO 2016/061523 A1 | 4/2016 |
| WO | WO 2016/064894 A2 | 4/2016 |
| WO | WO 2016/065364 A1 | 4/2016 |
| WO | WO 2016/069282 A1 | 5/2016 |
| WO | WO 2016/069283 A1 | 5/2016 |
| WO | WO 2016/069591 A2 | 5/2016 |
| WO | WO 2016/069774 A1 | 5/2016 |
| WO | WO 2016/069910 A1 | 5/2016 |
| WO | WO 2016/069912 A1 | 5/2016 |
| WO | WO 2016/070037 A2 | 5/2016 |
| WO | WO 2016/070070 A1 | 5/2016 |
| WO | WO 2016/070129 A1 | 5/2016 |
| WO | WO 2016/072399 A1 | 5/2016 |
| WO | WO 2016/072936 A1 | 5/2016 |
| WO | WO 2016/073433 A1 | 5/2016 |
| WO | WO 2016/073559 A1 | 5/2016 |
| WO | WO 2016/073990 A2 | 5/2016 |
| WO | WO 2016/075662 A2 | 5/2016 |
| WO | WO 2016/076672 A1 | 5/2016 |
| WO | WO 2016/077273 A1 | 5/2016 |
| WO | WO 2016/077350 A1 | 5/2016 |
| WO | WO 2016/080097 A1 | 5/2016 |
| WO | WO 2016/080795 A1 | 5/2016 |
| WO | WO 2016/081923 A2 | 5/2016 |
| WO | WO 2016/081924 A1 | 5/2016 |
| WO | WO 2016/082135 A1 | 6/2016 |
| WO | WO 2016/083811 A1 | 6/2016 |
| WO | WO 2016/084084 A1 | 6/2016 |

(56) References Cited

FOREIGN PATENT DOCUMENTS

| | | |
|---|---|---|
| WO | WO 2016/084088 A1 | 6/2016 |
| WO | WO 2016/086177 A2 | 6/2016 |
| WO | WO 2016/089433 A1 | 6/2016 |
| WO | WO 2016/089866 A1 | 6/2016 |
| WO | WO 2016/089883 A1 | 6/2016 |
| WO | WO 2016/090385 A1 | 6/2016 |
| WO | WO 2016/094679 A1 | 6/2016 |
| WO | WO 2016/094845 A2 | 6/2016 |
| WO | WO 2016/094867 A1 | 6/2016 |
| WO | WO 2016/094872 A1 | 6/2016 |
| WO | WO 2016/094874 A1 | 6/2016 |
| WO | WO 2016/094880 A1 | 6/2016 |
| WO | WO 2016/094888 A1 | 6/2016 |
| WO | WO 2016/097212 A1 | 6/2016 |
| WO | WO 2016/097231 A2 | 6/2016 |
| WO | WO 2016/097751 A1 | 6/2016 |
| WO | WO 2016/099887 A1 | 6/2016 |
| WO | WO 2016/100272 A1 | 6/2016 |
| WO | WO 2016/100389 A1 | 6/2016 |
| WO | WO 2016/100568 A1 | 6/2016 |
| WO | WO 2016/100571 A1 | 6/2016 |
| WO | WO 2016/100951 A2 | 6/2016 |
| WO | WO 2016/100955 A2 | 6/2016 |
| WO | WO 2016/100974 A1 | 6/2016 |
| WO | WO 2016/103233 A2 | 6/2016 |
| WO | WO 2016/104716 A1 | 6/2016 |
| WO | WO 2016/106236 A1 | 6/2016 |
| WO | WO 2016/106239 A1 | 6/2016 |
| WO | WO 2016/106244 A1 | 6/2016 |
| WO | WO 2016/106338 A2 | 6/2016 |
| WO | WO 2016/108926 A1 | 7/2016 |
| WO | WO 2016/109255 A1 | 7/2016 |
| WO | WO 2016/109840 A2 | 7/2016 |
| WO | WO 2016/110214 A1 | 7/2016 |
| WO | WO 2016/110453 A1 | 7/2016 |
| WO | WO 2016/110511 A1 | 7/2016 |
| WO | WO 2016/110512 A1 | 7/2016 |
| WO | WO 2016/111546 A2 | 7/2016 |
| WO | WO 2016/112242 A1 | 7/2016 |
| WO | WO 2016/112351 A1 | 7/2016 |
| WO | WO 2016/112963 A1 | 7/2016 |
| WO | WO 2016/113357 A1 | 7/2016 |
| WO | WO 2016/114972 A1 | 7/2016 |
| WO | WO 2016/115179 A1 | 7/2016 |
| WO | WO 2016/115326 A1 | 7/2016 |
| WO | WO 2016/115355 A1 | 7/2016 |
| WO | WO 2016/116032 A1 | 7/2016 |
| WO | WO 2016/120480 A1 | 8/2016 |
| WO | WO 2016/123071 A1 | 8/2016 |
| WO | WO 2016/123230 A1 | 8/2016 |
| WO | WO 2016/123243 A1 | 8/2016 |
| WO | WO 2016/123578 A1 | 8/2016 |
| WO | WO 2016/126747 A1 | 8/2016 |
| WO | WO 2016/130600 A2 | 8/2016 |
| WO | WO 2016/130697 A1 | 8/2016 |
| WO | WO 2016/131009 A1 | 8/2016 |
| WO | WO 2016/132122 A1 | 8/2016 |
| WO | WO 2016/133165 A1 | 8/2016 |
| WO | WO 2016/077052 A9 | 9/2016 |
| WO | WO 2016/135507 A1 | 9/2016 |
| WO | WO 2016/135557 A2 | 9/2016 |
| WO | WO 2016/135558 A2 | 9/2016 |
| WO | WO 2016/135559 A2 | 9/2016 |
| WO | WO 2016/137774 A1 | 9/2016 |
| WO | WO 2016/137949 A1 | 9/2016 |
| WO | WO 2016/141224 A1 | 9/2016 |
| WO | WO 2016/141893 A1 | 9/2016 |
| WO | WO 2016/142719 A1 | 9/2016 |
| WO | WO 2016/145150 A2 | 9/2016 |
| WO | WO 2016/148994 A1 | 9/2016 |
| WO | WO 2016/149484 A2 | 9/2016 |
| WO | WO 2016/149547 A1 | 9/2016 |
| WO | WO 2016/150336 A1 | 9/2016 |
| WO | WO 2016/150855 A1 | 9/2016 |
| WO | WO 2016/154016 A2 | 9/2016 |
| WO | WO 2016/154579 A2 | 9/2016 |
| WO | WO 2016/154596 A1 | 9/2016 |
| WO | WO 2016/155482 A1 | 10/2016 |
| WO | WO 2016/161004 A1 | 10/2016 |
| WO | WO 2016/161207 A1 | 10/2016 |
| WO | WO 2016/161260 A1 | 10/2016 |
| WO | WO 2016/161380 A1 | 10/2016 |
| WO | WO 2016/161446 A1 | 10/2016 |
| WO | WO 2016/164356 A1 | 10/2016 |
| WO | WO 2016/164797 A1 | 10/2016 |
| WO | WO 2016/166340 A1 | 10/2016 |
| WO | WO 2016/167300 A1 | 10/2016 |
| WO | WO 2016/168631 A1 | 10/2016 |
| WO | WO 2016/170484 A1 | 10/2016 |
| WO | WO 2016/172359 A2 | 10/2016 |
| WO | WO 2016/172727 A1 | 10/2016 |
| WO | WO 2016/174056 A1 | 11/2016 |
| WO | WO 2016/174151 A1 | 11/2016 |
| WO | WO 2016/174250 A1 | 11/2016 |
| WO | WO 2016/176191 A1 | 11/2016 |
| WO | WO 2016/176404 A1 | 11/2016 |
| WO | WO 2016/176690 A2 | 11/2016 |
| WO | WO 2016/177682 A1 | 11/2016 |
| WO | WO 2016/178207 A1 | 11/2016 |
| WO | WO 2016/179038 A1 | 11/2016 |
| WO | WO 2016/179112 A1 | 11/2016 |
| WO | WO 2016/181357 A1 | 11/2016 |
| WO | WO 2016/182893 A1 | 11/2016 |
| WO | WO 2016/182917 A1 | 11/2016 |
| WO | WO 2016/182959 A1 | 11/2016 |
| WO | WO 2016/183236 A1 | 11/2016 |
| WO | WO 2016/183298 A2 | 11/2016 |
| WO | WO 2016/183345 A1 | 11/2016 |
| WO | WO 2016/183402 A2 | 11/2016 |
| WO | WO 2016/183438 A1 | 11/2016 |
| WO | WO 2016/183448 A1 | 11/2016 |
| WO | WO 2016/184955 A2 | 11/2016 |
| WO | WO 2016/184989 A1 | 11/2016 |
| WO | WO 2016/185411 A1 | 11/2016 |
| WO | WO 2016/186745 A1 | 11/2016 |
| WO | WO 2016/186772 A2 | 11/2016 |
| WO | WO 2016/186946 A1 | 11/2016 |
| WO | WO 2016/186953 A1 | 11/2016 |
| WO | WO 2016/187717 A1 | 12/2016 |
| WO | WO 2016/187904 A1 | 12/2016 |
| WO | WO 2016/191684 A1 | 12/2016 |
| WO | WO 2016/191869 A1 | 12/2016 |
| WO | WO 2016/196273 A1 | 12/2016 |
| WO | WO 2016/196282 A1 | 12/2016 |
| WO | WO 2016/196308 A1 | 12/2016 |
| WO | WO 2016/196361 A1 | 12/2016 |
| WO | WO 2016/196499 A1 | 12/2016 |
| WO | WO 2016/196539 A2 | 12/2016 |
| WO | WO 2016/196655 A1 | 12/2016 |
| WO | WO 2016/196805 A1 | 12/2016 |
| WO | WO 2016/196887 A1 | 12/2016 |
| WO | WO 2016/197132 A1 | 12/2016 |
| WO | WO 2016/197133 A1 | 12/2016 |
| WO | WO 2016/197354 A1 | 12/2016 |
| WO | WO 2016/197355 A1 | 12/2016 |
| WO | WO 2016/197356 A1 | 12/2016 |
| WO | WO 2016/197357 A1 | 12/2016 |
| WO | WO 2016/197358 A1 | 12/2016 |
| WO | WO 2016/197359 A1 | 12/2016 |
| WO | WO 2016/197360 A1 | 12/2016 |
| WO | WO 2016/197361 A1 | 12/2016 |
| WO | WO 2016/197362 A1 | 12/2016 |
| WO | WO 2016/198361 A1 | 12/2016 |
| WO | WO 2016/198500 A1 | 12/2016 |
| WO | WO 2016/200263 A1 | 12/2016 |
| WO | WO 2016/201047 A1 | 12/2016 |
| WO | WO 2016/201138 A1 | 12/2016 |
| WO | WO 2016/201152 A1 | 12/2016 |
| WO | WO 2016/201153 A1 | 12/2016 |
| WO | WO 2016/201155 A1 | 12/2016 |
| WO | WO 2016/205276 A1 | 12/2016 |
| WO | WO 2016/205613 A1 | 12/2016 |
| WO | WO 2016/205623 A1 | 12/2016 |
| WO | WO 2016/205680 A1 | 12/2016 |

(56) References Cited

FOREIGN PATENT DOCUMENTS

| | | |
|---|---|---|
| WO | WO 2016/205688 A2 | 12/2016 |
| WO | WO 2016/205703 A1 | 12/2016 |
| WO | WO 2016/205711 A1 | 12/2016 |
| WO | WO 2016/205728 A1 | 12/2016 |
| WO | WO 2016/205745 A2 | 12/2016 |
| WO | WO 2016/205749 A1 | 12/2016 |
| WO | WO 2016/205759 A1 | 12/2016 |
| WO | WO 2016/205764 A1 | 12/2016 |
| WO | WO 2017/001572 A1 | 1/2017 |
| WO | WO 2017/001988 A1 | 1/2017 |
| WO | WO 2017/004261 A1 | 1/2017 |
| WO | WO 2017/004279 A2 | 1/2017 |
| WO | WO 2017/004616 A1 | 1/2017 |
| WO | WO 2017/005807 A1 | 1/2017 |
| WO | WO 2017/009399 A1 | 1/2017 |
| WO | WO 2017/010556 A1 | 1/2017 |
| WO | WO 2017/011519 A1 | 1/2017 |
| WO | WO 2017/011721 A1 | 1/2017 |
| WO | WO 2017/011804 A1 | 1/2017 |
| WO | WO 2017/015015 A1 | 1/2017 |
| WO | WO 2017/015101 A1 | 1/2017 |
| WO | WO 2017/015545 A1 | 1/2017 |
| WO | WO 2017/015559 A2 | 1/2017 |
| WO | WO 2017/015567 A1 | 1/2017 |
| WO | WO 2017/015637 A1 | 1/2017 |
| WO | WO 2017/017016 A1 | 2/2017 |
| WO | WO 2017/019867 A1 | 2/2017 |
| WO | WO 2017/019895 A1 | 2/2017 |
| WO | WO 2017/023803 A1 | 2/2017 |
| WO | WO 2017/023974 A1 | 2/2017 |
| WO | WO 2017/024047 A1 | 2/2017 |
| WO | WO 2017/024319 A1 | 2/2017 |
| WO | WO 2017/024343 A1 | 2/2017 |
| WO | WO 2017/024602 A1 | 2/2017 |
| WO | WO 2017/025323 A1 | 2/2017 |
| WO | WO 2017/027423 A1 | 2/2017 |
| WO | WO 2017/028768 A1 | 2/2017 |
| WO | WO 2017/029664 A1 | 2/2017 |
| WO | WO 2017/031360 A1 | 2/2017 |
| WO | WO 2017/031483 A1 | 2/2017 |
| WO | WO 2017/035416 A1 | 3/2017 |
| WO | WO 2017/035416 A2 | 3/2017 |
| WO | WO 2017/040348 A1 | 3/2017 |
| WO | WO 2017/040511 A1 | 3/2017 |
| WO | WO 2017/040709 A1 | 3/2017 |
| WO | WO 2017/040786 A1 | 3/2017 |
| WO | WO 2017/040793 A1 | 3/2017 |
| WO | WO 2017/040813 A2 | 3/2017 |
| WO | WO 2017/043573 A1 | 3/2017 |
| WO | WO 2017/043656 A1 | 3/2017 |
| WO | WO 2017/044419 A1 | 3/2017 |
| WO | WO 2017/044776 A1 | 3/2017 |
| WO | WO 2017/044857 A2 | 3/2017 |
| WO | WO 2017/048390 A1 | 3/2017 |
| WO | WO 2017/049129 A2 | 3/2017 |
| WO | WO 2017/050963 A1 | 3/2017 |
| WO | WO 2017/053312 A1 | 3/2017 |
| WO | WO 2017/053431 A2 | 3/2017 |
| WO | WO 2017/053713 A1 | 3/2017 |
| WO | WO 2017/053729 A1 | 3/2017 |
| WO | WO 2017/053753 A1 | 3/2017 |
| WO | WO 2017/053762 A1 | 3/2017 |
| WO | WO 2017/053879 A1 | 3/2017 |
| WO | WO 2017/054721 A1 | 4/2017 |
| WO | WO 2017/058658 A2 | 4/2017 |
| WO | WO 2017/059241 A1 | 4/2017 |
| WO | WO 2017/062605 A1 | 4/2017 |
| WO | WO 2017/062723 A1 | 4/2017 |
| WO | WO 2017/062754 A1 | 4/2017 |
| WO | WO 2017/062855 A1 | 4/2017 |
| WO | WO 2017/062886 A1 | 4/2017 |
| WO | WO 2017/062983 A1 | 4/2017 |
| WO | WO 2017/064439 A1 | 4/2017 |
| WO | WO 2017/064546 A1 | 4/2017 |
| WO | WO 2017/064566 A2 | 4/2017 |
| WO | WO 2017/066175 A1 | 4/2017 |
| WO | WO 2017/066497 A2 | 4/2017 |
| WO | WO 2017/066588 A2 | 4/2017 |
| WO | WO 2017/066707 A1 | 4/2017 |
| WO | WO 2017/066781 A1 | 4/2017 |
| WO | WO 2017/068077 A1 | 4/2017 |
| WO | WO 2017/068377 A1 | 4/2017 |
| WO | WO 2017/069829 A2 | 4/2017 |
| WO | WO 2017/070029 A1 | 4/2017 |
| WO | WO 2017/070032 A1 | 4/2017 |
| WO | WO 2017/070169 A1 | 4/2017 |
| WO | WO 2017/070284 A1 | 4/2017 |
| WO | WO 2017/070598 A1 | 4/2017 |
| WO | WO 2017/070605 A1 | 4/2017 |
| WO | WO 2017/070632 A2 | 4/2017 |
| WO | WO 2017/070633 A2 | 4/2017 |
| WO | WO 2017/072590 A1 | 5/2017 |
| WO | WO 2017/074526 A1 | 5/2017 |
| WO | WO 2017/074962 A1 | 5/2017 |
| WO | WO 2017/075261 A1 | 5/2017 |
| WO | WO 2017/075335 A1 | 5/2017 |
| WO | WO 2017/075475 A1 | 5/2017 |
| WO | WO 2017/077135 A1 | 5/2017 |
| WO | WO 2017/077329 A2 | 5/2017 |
| WO | WO 2017/078751 A1 | 5/2017 |
| WO | WO 2017/079400 A1 | 5/2017 |
| WO | WO 2017/079428 A1 | 5/2017 |
| WO | WO 2017/079673 A1 | 5/2017 |
| WO | WO 2017/079724 A1 | 5/2017 |
| WO | WO 2017/081097 A1 | 5/2017 |
| WO | WO 2017/081288 A1 | 5/2017 |
| WO | WO 2017/083368 A1 | 5/2017 |
| WO | WO 2017/083722 A1 | 5/2017 |
| WO | WO 2017/083766 A1 | 5/2017 |
| WO | WO 2017/087395 A1 | 5/2017 |
| WO | WO 2017/090724 A1 | 6/2017 |
| WO | WO 2017/091510 A1 | 6/2017 |
| WO | WO 2017/091630 A1 | 6/2017 |
| WO | WO 2017/092201 A1 | 6/2017 |
| WO | WO 2017/093370 A1 | 6/2017 |
| WO | WO 2017/093969 A1 | 6/2017 |
| WO | WO 2017/095111 A1 | 6/2017 |
| WO | WO 2017/096041 A1 | 6/2017 |
| WO | WO 2017/096237 A1 | 6/2017 |
| WO | WO 2017/100158 A1 | 6/2017 |
| WO | WO 2017/100431 A2 | 6/2017 |
| WO | WO 2017/104404 A1 | 6/2017 |
| WO | WO 2017/105251 A1 | 6/2017 |
| WO | WO 2017/105350 A1 | 6/2017 |
| WO | WO 2017/105991 A1 | 6/2017 |
| WO | WO 2017/106414 A1 | 6/2017 |
| WO | WO 2017/106528 A2 | 6/2017 |
| WO | WO 2017/106537 A2 | 6/2017 |
| WO | WO 2017/106569 A1 | 6/2017 |
| WO | WO 2017/106616 A1 | 6/2017 |
| WO | WO 2017/106657 A1 | 6/2017 |
| WO | WO 2017/106767 A1 | 6/2017 |
| WO | WO 2017/109134 A1 | 6/2017 |
| WO | WO 2017/109757 A1 | 6/2017 |
| WO | WO 2017/112620 A1 | 6/2017 |
| WO | WO 2017/115268 A1 | 7/2017 |
| WO | WO 2017/117395 A1 | 7/2017 |
| WO | WO 2017/118598 A1 | 7/2017 |
| WO | WO 2017/118720 A1 | 7/2017 |
| WO | WO 2017/123609 A1 | 7/2017 |
| WO | WO 2017/123910 A1 | 7/2017 |
| WO | WO 2017/124086 A1 | 7/2017 |
| WO | WO 2017/124100 A1 | 7/2017 |
| WO | WO 2017/124652 A1 | 7/2017 |
| WO | WO 2017/126987 A1 | 7/2017 |
| WO | WO 2017/127807 A1 | 7/2017 |
| WO | WO 2017/131237 A1 | 8/2017 |
| WO | WO 2017/132112 A1 | 8/2017 |
| WO | WO 2017/132580 A2 | 8/2017 |
| WO | WO 2017/136520 A1 | 8/2017 |
| WO | WO 2017/136629 A1 | 8/2017 |
| WO | WO 2017/136794 A1 | 8/2017 |
| WO | WO 2017/139264 A1 | 8/2017 |
| WO | WO 2017/139505 A2 | 8/2017 |

(56) References Cited

FOREIGN PATENT DOCUMENTS

| | | |
|---|---|---|
| WO | WO 2017/141173 A2 | 8/2017 |
| WO | WO 2017/142835 A1 | 8/2017 |
| WO | WO 2017/142999 A2 | 8/2017 |
| WO | WO 2017/143042 A2 | 8/2017 |
| WO | WO 2017/147056 A1 | 8/2017 |
| WO | WO 2017/147278 A1 | 8/2017 |
| WO | WO 2017/147432 A1 | 8/2017 |
| WO | WO 2017/147446 A1 | 8/2017 |
| WO | WO 2017/147555 A1 | 8/2017 |
| WO | WO 2017/151444 A1 | 9/2017 |
| WO | WO 2017/151719 A1 | 9/2017 |
| WO | WO 2017/152015 A1 | 9/2017 |
| WO | WO 2017/155717 A1 | 9/2017 |
| WO | WO 2017/157422 A1 | 9/2017 |
| WO | WO 2017/158153 A1 | 9/2017 |
| WO | WO 2017/160689 A1 | 9/2017 |
| WO | WO 2017/160752 A1 | 9/2017 |
| WO | WO 2017/160890 A1 | 9/2017 |
| WO | WO 2017/161068 A1 | 9/2017 |
| WO | WO 2017/165826 A1 | 9/2017 |
| WO | WO 2017/165862 A1 | 9/2017 |
| WO | WO 2017/167712 A1 | 10/2017 |
| WO | WO 2017/172644 A2 | 10/2017 |
| WO | WO 2017/172645 A2 | 10/2017 |
| WO | WO 2017/172860 A1 | 10/2017 |
| WO | WO 2017/173004 A1 | 10/2017 |
| WO | WO 2017/173054 A1 | 10/2017 |
| WO | WO 2017/173092 A1 | 10/2017 |
| WO | WO 2017/174329 A1 | 10/2017 |
| WO | WO 2017/176529 A1 | 10/2017 |
| WO | WO 2017/176806 A1 | 10/2017 |
| WO | WO 2017/178590 A1 | 10/2017 |
| WO | WO 2017/180694 A1 | 10/2017 |
| WO | WO 2017/180711 A1 | 10/2017 |
| WO | WO 2017/180915 A2 | 10/2017 |
| WO | WO 2017/180926 A1 | 10/2017 |
| WO | WO 2017/181107 A2 | 10/2017 |
| WO | WO 2017/181735 A2 | 10/2017 |
| WO | WO 2017/182468 A1 | 10/2017 |
| WO | WO 2017/184334 A1 | 10/2017 |
| WO | WO 2017/184768 A1 | 10/2017 |
| WO | WO 2017/184786 A1 | 10/2017 |
| WO | WO 2017/186550 A1 | 11/2017 |
| WO | WO 2017/189308 A1 | 11/2017 |
| WO | WO 2017/189336 A1 | 11/2017 |
| WO | WO 2017/190041 A1 | 11/2017 |
| WO | WO 2017/190257 A1 | 11/2017 |
| WO | WO 2017/190664 A1 | 11/2017 |
| WO | WO 2017/191210 A1 | 11/2017 |
| WO | WO 2017/191274 A2 | 11/2017 |
| WO | WO 2017/192172 A1 | 11/2017 |
| WO | WO 2017/192512 A2 | 11/2017 |
| WO | WO 2017/192544 A1 | 11/2017 |
| WO | WO 2017/192573 A1 | 11/2017 |
| WO | WO 2017/193029 A2 | 11/2017 |
| WO | WO 2017/193053 A1 | 11/2017 |
| WO | WO 2017/196768 A1 | 11/2017 |
| WO | WO 2017/197038 A1 | 11/2017 |
| WO | WO 2017/197238 A1 | 11/2017 |
| WO | WO 2017/197301 A1 | 11/2017 |
| WO | WO 2017/201476 A1 | 11/2017 |
| WO | WO 2017/205290 A1 | 11/2017 |
| WO | WO 2017/205423 A1 | 11/2017 |
| WO | WO 2017/207589 A1 | 12/2017 |
| WO | WO 2017/208247 A1 | 12/2017 |
| WO | WO 2017/209809 A1 | 12/2017 |
| WO | WO 2017/213896 A1 | 12/2017 |
| WO | WO 2017/213898 A2 | 12/2017 |
| WO | WO 2017/214460 A1 | 12/2017 |
| WO | WO 2017/216392 A1 | 12/2017 |
| WO | WO 2017/216771 A2 | 12/2017 |
| WO | WO 2017/218185 A1 | 12/2017 |
| WO | WO 2017/219027 A1 | 12/2017 |
| WO | WO 2017/219033 A1 | 12/2017 |
| WO | WO 2017/220751 A1 | 12/2017 |
| WO | WO 2017/222370 A1 | 12/2017 |
| WO | WO 2017/222773 A1 | 12/2017 |
| WO | WO 2017/222834 A1 | 12/2017 |
| WO | WO 2017/223107 A1 | 12/2017 |
| WO | WO 2017/223330 A1 | 12/2017 |
| WO | WO 2018/000657 A1 | 1/2018 |
| WO | WO 2018/002719 A1 | 1/2018 |
| WO | WO 2018/005117 A1 | 1/2018 |
| WO | WO 2018/005289 A2 | 1/2018 |
| WO | WO 2018/005691 A1 | 1/2018 |
| WO | WO 2018/005782 A1 | 1/2018 |
| WO | WO 2018/005873 A1 | 1/2018 |
| WO | WO 2018/06693 A1 | 1/2018 |
| WO | WO 2018/009520 A1 | 1/2018 |
| WO | WO 2018/009562 A1 | 1/2018 |
| WO | WO 2018/009822 A1 | 1/2018 |
| WO | WO 2018/009903 A2 | 1/2018 |
| WO | WO 2018/013821 A1 | 1/2018 |
| WO | WO 2018/013932 A1 | 1/2018 |
| WO | WO 2018/013990 A1 | 1/2018 |
| WO | WO 2018/014384 A1 | 1/2018 |
| WO | WO 2018/015444 A1 | 1/2018 |
| WO | WO 2018/015936 A2 | 1/2018 |
| WO | WO 2018/017754 A1 | 1/2018 |
| WO | WO 2018/018979 A1 | 2/2018 |
| WO | WO 2018/020248 A1 | 2/2018 |
| WO | WO 2018/021878 A1 | 2/2018 |
| WO | WO 2018/022480 A1 | 2/2018 |
| WO | WO 2018/022634 A1 | 2/2018 |
| WO | WO 2018/025206 A1 | 2/2018 |
| WO | WO 2018/026723 A1 | 2/2018 |
| WO | WO 2018/026976 A1 | 2/2018 |
| WO | WO 2018/027078 A1 | 2/2018 |
| WO | WO 2018/030608 A1 | 2/2018 |
| WO | WO 2018/031683 A1 | 2/2018 |
| WO | WO 2018/035250 A1 | 2/2018 |
| WO | WO 2018/035300 A1 | 2/2018 |
| WO | WO 2018/035423 A1 | 2/2018 |
| WO | WO 2018/035503 A1 | 2/2018 |
| WO | WO 2018/039145 A1 | 3/2018 |
| WO | WO 2018/039438 A1 | 3/2018 |
| WO | WO 2018/039440 A1 | 3/2018 |
| WO | WO 2018/039448 A1 | 3/2018 |
| WO | WO 2018/045630 A1 | 3/2018 |
| WO | WO 2018/048827 A1 | 3/2018 |
| WO | WO 2018/049073 A1 | 3/2018 |
| WO | WO 2018/049168 A1 | 3/2018 |
| WO | WO 2018/051347 A1 | 3/2018 |
| WO | WO 2018/058064 A1 | 3/2018 |
| WO | WO 2018/062866 A2 | 4/2018 |
| WO | WO 2018/064352 A1 | 4/2018 |
| WO | WO 2018/064371 A1 | 4/2018 |
| WO | WO 2018/064516 A1 | 4/2018 |
| WO | WO 2018/067546 A1 | 4/2018 |
| WO | WO 2018/067846 A1 | 4/2018 |
| WO | WO 2018/068053 A2 | 4/2018 |
| WO | WO 2018/069474 A1 | 4/2018 |
| WO | WO 2018/071623 A2 | 4/2018 |
| WO | WO 2018/071663 A1 | 4/2018 |
| WO | WO 2018/071868 A1 | 4/2018 |
| WO | WO 2018/071892 A1 | 4/2018 |
| WO | WO 2018/074979 | 4/2018 |
| WO | WO 2018/079134 A1 | 5/2018 |
| WO | WO 2018/080573 A1 | 5/2018 |
| WO | WO 2018/081504 A1 | 5/2018 |
| WO | WO 2018/081535 A2 | 5/2018 |
| WO | WO 2018/081728 A1 | 5/2018 |
| WO | WO 2018/083128 A2 | 5/2018 |
| WO | WO 2018/083606 A1 | 5/2018 |
| WO | WO 2018/085288 A1 | 5/2018 |
| WO | WO 2018/085414 A1 | 5/2018 |
| WO | WO 2018/086623 A1 | 5/2018 |
| WO | WO 2018/089664 A1 | 5/2018 |
| WO | WO 2018/093990 A1 | 5/2018 |
| WO | WO 2018/098383 A1 | 5/2018 |
| WO | WO 2018/098480 A1 | 5/2018 |
| WO | WO 2018/098587 A1 | 6/2018 |
| WO | WO 2018/099256 A1 | 6/2018 |
| WO | WO 2018/103686 A1 | 6/2018 |

(56) References Cited

FOREIGN PATENT DOCUMENTS

| | | |
|---|---|---|
| WO | WO 2018/106268 A1 | 6/2018 |
| WO | WO 2018/107028 A1 | 6/2018 |
| WO | WO 2018/107103 A1 | 6/2018 |
| WO | WO 2018/107129 A1 | 6/2018 |
| WO | WO 2018/108272 A1 | 6/2018 |
| WO | WO 2018/109101 A1 | 6/2018 |
| WO | WO 2018/109447 A1 | 6/2018 |
| WO | WO 2018/111946 A1 | 6/2018 |
| WO | WO 2018/111947 A1 | 6/2018 |
| WO | WO 2018/112336 A1 | 6/2018 |
| WO | WO 2018/112446 A2 | 6/2018 |
| WO | WO 2018/119354 A1 | 6/2018 |
| WO | WO 2018/119359 A1 | 6/2018 |
| WO | WO 2018/120283 A1 | 7/2018 |
| WO | WO 2018/130830 A1 | 7/2018 |
| WO | WO 2018/135838 A2 | 7/2018 |
| WO | WO 2018/136396 A2 | 7/2018 |
| WO | WO 2018/136939 A1 | 7/2018 |
| WO | WO 2018/138385 A1 | 8/2018 |
| WO | WO 2018/142364 A1 | 8/2018 |
| WO | WO 2018/148246 A1 | 8/2018 |
| WO | WO 2018/148256 A1 | 8/2018 |
| WO | WO 2018/148647 A2 | 8/2018 |
| WO | WO 2018/149418 A1 | 8/2018 |
| WO | WO 2018/149888 A1 | 8/2018 |
| WO | WO 2018/149915 A1 | 8/2018 |
| WO | WO 2018/152197 A1 | 8/2018 |
| WO | WO 2018/152418 A1 | 8/2018 |
| WO | WO 2018/154380 A1 | 8/2018 |
| WO | WO 2018/154387 A1 | 8/2018 |
| WO | WO 2018/154412 A1 | 8/2018 |
| WO | WO 2018/154413 A1 | 8/2018 |
| WO | WO 2018/154418 A1 | 8/2018 |
| WO | WO 2018/154439 A1 | 8/2018 |
| WO | WO 2018/154459 A1 | 8/2018 |
| WO | WO 2018/154462 A2 | 8/2018 |
| WO | WO 2018/156372 A1 | 8/2018 |
| WO | WO 2018/156824 A1 | 8/2018 |
| WO | WO 2018/161009 A1 | 9/2018 |
| WO | WO 2018/165504 A1 | 9/2018 |
| WO | WO 2018/165629 A1 | 9/2018 |
| WO | WO 2018/170015 A1 | 9/2018 |
| WO | WO 2018/170340 A1 | 9/2018 |
| WO | WO 2018/175502 A2 | 9/2018 |
| WO | WO 2018/176009 A1 | 9/2018 |
| WO | WO 2018/177351 A1 | 10/2018 |
| WO | WO 2018/179578 A1 | 10/2018 |
| WO | WO 2018/183403 A1 | 10/2018 |
| WO | WO 2018/189184 A1 | 10/2018 |
| WO | WO 2018/191388 A1 | 10/2018 |
| WO | WO 2018/195402 A1 | 10/2018 |
| WO | WO 2018/195545 A2 | 10/2018 |
| WO | WO 2018/195555 A1 | 10/2018 |
| WO | WO 2018/197020 A1 | 11/2018 |
| WO | WO 2018/197495 A1 | 11/2018 |
| WO | WO 2018/202800 A1 | 11/2018 |
| WO | WO 2018/204493 A1 | 11/2018 |
| WO | WO 2018/208755 A1 | 11/2018 |
| WO | WO 2018/208998 A1 | 11/2018 |
| WO | WO 2018/209158 A2 | 11/2018 |
| WO | WO 2018/209320 A1 | 11/2018 |
| WO | WO 2018/213351 A1 | 11/2018 |
| WO | WO 2018/213708 A1 | 11/2018 |
| WO | WO 2018/213726 A1 | 11/2018 |
| WO | WO 2018/213771 A1 | 11/2018 |
| WO | WO 2018/213791 A1 | 11/2018 |
| WO | WO 2018/217852 A1 | 11/2018 |
| WO | WO 2018/217981 A1 | 11/2018 |
| WO | WO 2018/218166 A1 | 11/2018 |
| WO | WO 2018/218188 A2 | 11/2018 |
| WO | WO 2018/218206 A1 | 11/2018 |
| WO | WO 2019/005884 A1 | 1/2019 |
| WO | WO 2019/005886 A1 | 1/2019 |
| WO | WO 2019/010384 A1 | 1/2019 |
| WO | WO 2019/023680 A1 | 1/2019 |
| WO | WO 2019/040935 A1 | 2/2019 |
| WO | WO 2019/051097 A1 | 3/2019 |
| WO | WO 2019/067815 A2 | 4/2019 |
| WO | WO 2019/079347 | 4/2019 |
| WO | WO 2019/084062 A1 | 5/2019 |
| WO | WO 2019/090367 A1 | 5/2019 |
| WO | WO 2019/118949 A1 | 6/2019 |
| WO | WO 2019/123430 A1 | 6/2019 |
| WO | WO 2019/139645 A2 | 7/2019 |
| WO | WO 2019/139951 A1 | 7/2019 |
| WO | WO 2019/147014 A1 | 8/2019 |
| WO | WO 2019/161251 A1 | 8/2019 |
| WO | WO 2019/168953 A1 | 9/2019 |
| WO | WO 2019/217942 A1 | 11/2019 |
| WO | WO 2019/226953 A1 | 11/2019 |
| WO | WO 2019/236566 A1 | 12/2019 |
| WO | WO 2019/241649 A1 | 12/2019 |
| WO | WO 2020/014261 A1 | 1/2020 |
| WO | WO 2020/028555 A2 | 2/2020 |
| WO | WO 2020/028823 A1 | 2/2020 |
| WO | WO 2020/041751 A1 | 2/2020 |
| WO | WO 2020/047124 A1 | 3/2020 |
| WO | WO 2020/051360 A1 | 3/2020 |
| WO | WO 2020/086908 A1 | 4/2020 |
| WO | WO 2020/092453 A1 | 5/2020 |
| WO | WO 2020/102659 A1 | 5/2020 |
| WO | WO 2020/154500 A1 | 7/2020 |
| WO | WO 2020/157008 A1 | 8/2020 |
| WO | WO 2020/160071 A1 | 8/2020 |
| WO | WO 2020/180975 A1 | 9/2020 |
| WO | WO 2020/181178 A1 | 9/2020 |
| WO | WO 2020/181180 A1 | 9/2020 |
| WO | WO 2020/181193 A1 | 9/2020 |
| WO | WO 2020/181195 A1 | 9/2020 |
| WO | WO 2020/181202 A1 | 9/2020 |
| WO | WO 2020/191153 A1 | 9/2020 |
| WO | WO 2020/191171 A1 | 9/2020 |
| WO | WO 2020/191233 A1 | 9/2020 |
| WO | WO 2020/191234 A1 | 9/2020 |
| WO | WO 2020/191239 A1 | 9/2020 |
| WO | WO 2020/191241 A1 | 9/2020 |
| WO | WO 2020/191242 A1 | 9/2020 |
| WO | WO 2020/191243 A1 | 9/2020 |
| WO | WO 2020/191245 A1 | 9/2020 |
| WO | WO 2020/191246 A1 | 9/2020 |
| WO | WO 2020/191248 A1 | 9/2020 |
| WO | WO 2020/191249 A1 | 9/2020 |
| WO | WO 2020/210751 A1 | 10/2020 |
| WO | WO 2020/214842 A1 | 10/2020 |
| WO | WO 2020/236982 A1 | 11/2020 |
| WO | WO 2021/022043 A2 | 2/2021 |
| WO | WO 2021/025750 A1 | 2/2021 |
| WO | WO 2021/030666 A1 | 2/2021 |
| WO | WO 2021/042062 A2 | 3/2021 |
| WO | WO 2021/072328 A1 | 4/2021 |
| WO | WO 2021/081264 A1 | 4/2021 |
| WO | WO 2021/087182 A1 | 5/2021 |
| WO | WO 2021/108717 A2 | 6/2021 |
| WO | WO 2021/138469 A1 | 7/2021 |
| WO | WO 2021/155065 A1 | 8/2021 |
| WO | WO 2021/158921 A2 | 8/2021 |
| WO | WO 2021/158995 A1 | 8/2021 |
| WO | WO 2021/158999 A1 | 8/2021 |
| WO | WO 2021/178709 A1 | 9/2021 |
| WO | WO 2021/178717 A2 | 9/2021 |
| WO | WO 2021/178720 A2 | 9/2021 |
| WO | WO 2021/178898 A1 | 9/2021 |
| WO | WO 2021/222318 A1 | 11/2021 |
| WO | WO 2021/226558 A1 | 11/2021 |

OTHER PUBLICATIONS

7561: pp. 481-485 and Supplementary Materials (aka pp. 1-27), published online Jun. 22, 2015). (Year: 2015).*
Kleinstiver et al (Nature Biotechnology Dec. 2015; vol. 33, No. 12: pp. 1293-1298, published online Nov. 2, 2015). (Year: 2015).*
Score result for Shimomura et al in "Complete genome sequencing and analysis of a Lancefield group G RT *Streptococcus dysgalactiae*

(56) References Cited

OTHER PUBLICATIONS subsp. *equisimilis* strain causing streptococcal RT toxic shock syndrome (STSS)."; RL BMC Genomics 12:17-17(2011). (Year: 2011).*
Score result for Luetticken et al "Complete genome sequence of a *Streptococcus dysgalactiae* subsp. RT *equisimilis* strain possessing Lancefield's group A antigen."; RL Submitted (May 2012) to the EMBL/GenBank/DDBJ databases. (Year: 2012).*
Score result for Okumura et al "Evolutionary paths of streptococcal and staphylococcal superantigens."; RL BMC Genomics 13:404-404(2012). (Year: 2012).*
Kleinstiver et al: "Engineered CRISPR-Cas9 nucleases with altered PAM specificities", Nature, vol. 523, No. 7561, Jun. 22, 2015 (Jun. 22, 2015), pp. 481-485. (Year: 2015).*
[No Author Listed], EMBL Accession No. Q99ZW2. Nov. 2012. 2 pages.
[No Author Listed], Invitrogen Lipofectamine™ 2000 product sheets, 2002. 2 pages.
[No Author Listed], Invitrogen Lipofectamine™ 2000 product sheets, 2005. 3 pages.
[No Author Listed], Invitrogen Lipofectamine™ LTX product sheets, 2011. 4 pages.
[No Author Listed], Thermo Fisher Scientific—How Cationic Lipid Mediated Transfection Works, retrieved from the internet Aug. 27, 2015. 2 pages.
Abudayyeh et al., C2c2 is a single-component programmable RNA-guided RNA-targeting CRISPR effector. Science Aug. 2016;353(6299):aaf5573. DOI: 10.1126/science.aaf5573.
Addgene Plasmid # 44246. pdCas9-humanized, 2017, Stanley Qi.
Addgene Plasmid # 73021. PCMV-BE3, 2017, David Liu.
Addgene Plasmid # 79620. pcDNA3.1_pCMV-nCas-PmCDA1-ugi pH1-gRNA(HPRT), 2017, Akihiko Kondo.
Alexandrov et al., Signatures of mutational processes in human cancer. Nature. Aug. 22, 2013;500(7463):415-21. doi: 10.1038/nature12477. Epub Aug. 14, 2013.
Anders et al., Structural basis of PAM-dependent target DNA recognition by the Cas9 endonuclease. Nature. Sep. 25, 2014;513(7519):569-73. doi: 10.1038/nature13579. Epub Jul. 27, 2014.
Arnold et al., Mutants of Tn3 resolvase which do not require accessory binding sites for recombination activity. EMBO J. Mar. 1, 1999;18(5):1407-14.
Barnes et al., Repair and genetic consequences of endogenous DNA base damage in mammalian cells. Annu Rev Genet. 2004;38:445-76.
Barrangou et al., CRISPR provides acquired resistance against viruses in prokaryotes. Science. Mar. 23, 2007;315(5819):1709-12.
Barrangou et al., RNA-mediated programmable DNA cleavage. Nat Biotechnol. Sep. 2012;30(9):836-8. doi: 10.1038/nbt.2357.
Basha et al., Influence of cationic lipid composition on gene silencing properties of lipid nanoparticle formulations of siRNA in antigen-presenting cells. Mol Ther. Dec. 2011;19(12):2186-200. doi: 10.1038/mt.2011.190. Epub Oct. 4, 2011.
Beale et al., Comparison of the differential context-dependence of DNA deamination by APOBEC enzymes: correlation with mutation spectra in vivo. J Mol Biol. Mar. 26, 2004;337(3):585-96.
Bedell et al., In vivo genome editing using a high-efficiency TALEN system. Nature. Nov. 1, 2012;491(7422):114-8. Doi: 10.1038/nature11537. Epub Sep. 23, 2012.
Begley, Scientists unveil the 'most clever CRISPR gadget' so far. STAT, Apr. 20, 2016. https://www.statnews.com/2016/04/20/clever-crispr-advance-unveiled/.
Beumer et al., Efficient gene targeting in *Drosophila* with zinc-finger nucleases. Genetics. Apr. 2006;172(4):2391-403. Epub Feb. 1, 2006.
Billon et al., CRISPR-Mediated Base Editing Enables Efficient Disruption of Eukaryotic Genes through Induction of STOP Codons. Mol Cell. Sep. 21, 2017;67(6):1068-1079.e4. doi: 10.1016/j.molcel.2017.08.008. Epub Sep. 7, 2017.

Birling et al., Site-specific recombinases for manipulation of the mouse genome. Methods Mol Biol. 2009;561:245-63. doi: 10.1007/978-1-60327-019-9_16.
Bitinaite et al., FokI dimerization is required for DNA cleavage. Proc Natl Acad Sci U S A. Sep. 1, 1998;95(18):10570-5.
Boch, TALEs of genome targeting. Nat Biotechnol. Feb. 2011;29(2):135-6. Doi: 10.1038/nbt.1767.
Boeckle et al., Melittin analogs with high lytic activity at endosomal pH enhance transfection with purified targeted PEI polyplexes. J Control Release. May 15, 2006;112(2):240-8. Epub Mar. 20, 2006.
Bolotin et al., Clustered regularly interspaced short palindrome repeats (CRISPRs) have spacers of extrachromosomal origin. Microbiology. Aug. 2005;151(Pt 8):2551-61.
Borman, Improved route to single-base genome editing. Chemical & Engineering News, Apr. 25, 2016;94(17)p. 5. http://cen.acs.org/articles/94/i17/Improved-route-single-base-genome.html.
Branden and Tooze, Introduction to Protein Structure. 1999; 2nd edition. Garland Science Publisher: 3-12.
Briner et al., Guide RNA functional modules direct Cas9 activity and orthogonality. Mol Cell. Oct. 23, 2014;56(2):333-339. doi: 10.1016/j.molcel.2014.09.019.
Britt et al., Re-engineering plant gene targeting. Trends Plant Sci. Feb. 2003;8(2):90-5.
Brouns et al., Small CRISPR RNAs guide antiviral defense in prokaryotes. Science. Aug. 15, 2008;321(5891):960-4. doi: 10.1126/science.1159689.
Brown et al., Serine recombinases as tools for genome engineering. Methods. Apr. 2011;53(4):372-9. doi: 10.1016/j.ymeth.2010.12.031. Epub Dec. 30, 2010.
Brusse et al., Spinocerebellar ataxia associated with a mutation in the fibroblast growth factor 14 gene (SCA27): A new phenotype. Mov Disord. Mar. 2006;21(3):396-401.
Buchholz et al., Alteration of Cre recombinase site specificity by substrate-linked protein evolution. Nat Biotechnol. Nov. 2001;19(11):1047-52.
Buchwald et al., Long-term, continuous intravenous heparin administration by an implantable infusion pump in ambulatory patients with recurrent venous thrombosis. Surgery. Oct. 1980;88(4):507-16.
Bulow et al., Multienzyme systems obtained by gene fusion. Trends Biotechnol. Jul. 1991;9(7):226-31.
Burstein et al., New CRISPR-Cas systems from uncultivated microbes. Nature Feb. 2017;542(7640):237-240.
Cade et al., Highly efficient generation of heritable zebrafish gene mutations using homo- and heterodimeric TALENs. Nucleic Acids Res. Sep. 2012;40(16):8001-10. Doi: 10.1093/nar/gks518. Epub Jun. 7, 2012.
Caldecott et al., Single-strand break repair and genetic disease. Nat Rev Genet. Aug. 2008;9(8):619-31. doi: 10.1038/nrg2380.
Cameron, Recent advances in transgenic technology. Mol Biotechnol. Jun. 1997;7(3):253-65.
Cargill et al.,Characterization of single-nucleotide polymorphisms in coding regions of human genes. Nat Genet. Jul. 1999;22(3):231-8.
Caron et al., Intracellular delivery of a Tat-eGFP fusion protein into muscle cells. Mol Ther. Mar. 2001;3(3):310-8.
Carroll et al., Gene targeting in *Drosophila* and *Caenorhabditis elegans* with zinc-finger nucleases. Methods Mol Biol. 2008;435:63-77. doi: 10.1007/978-1-59745-232-8_5.
Carroll et al., Progress and prospects: zinc-finger nucleases as gene therapy agents. Gene Ther. Nov. 2008;15(22):1463-8. doi: 10.1038/gt.2008.145. Epub Sep. 11, 2008.
Carroll, A CRISPR approach to gene targeting. Mol Ther. Sep. 2012;20(9):1658-60. doi: 10.1038/mt.2012.171.
Cermak et al., Efficient design and assembly of custom TALEN and other TAL effector-based constructs for DNA targeting. Nucleic Acids Res. Jul. 2011;39(12):e82. Doi: 10.1093/nar/gkr218. Epub Apr. 14, 2011.
Chadwick et al., In Vivo Base Editing of PCSK9 (Proprotein Convertase Subtilisin/Kexin Type 9) as a Therapeutic Alternative to Genome Editing. Arterioscler Thromb Vasc Biol. Sep. 2017;37(9):1741-1747. doi: 10.1161/ATVBAHA.117.309881. Epub Jul. 27, 2017.

(56) References Cited

OTHER PUBLICATIONS

Chaikind et al., A programmable Cas9-serine recombinase fusion protein that operates on DNA sequences in mammalian cells. Nucleic Acids Res. Nov. 16, 2016;44(20):9758-9770. Epub Aug. 11, 2016.
Charpentier et al., Biotechnology: Rewriting a genome. Nature. Mar. 7, 2013;495(7439):50-1. doi: 10.1038/495050a.
Chavez et al., Highly efficient Cas9-mediated transcriptional programming. Nat Methods. Apr. 2015;12(4):326-8. doi: 10.1038/nmeth.3312. Epub Mar. 2, 2015.
Chavez et al., Precise Cas9 targeting enables genomic mutation prevention. Proc Natl Acad Sci U S A. Apr. 3, 2018;115(14):3669-3673. doi: 10.1073/pnas.1718148115. Epub Mar. 19, 2018.
Chelico et al., Biochemical basis of immunological and retroviral responses to DNA-targeted cytosine deamination by activation-induced cytidine deaminase and APOBEC3G. J Biol Chem. Oct. 9, 2009;284(41):27761-5. doi: 10.1074/jbc.R109.052449. Epub Aug. 13, 2009.
Chelico et al., Stochastic properties of processive cytidine DNA deaminases AID and APOBEC3G. Philos Trans R Soc Lond B Biol Sci. Mar. 12, 2009;364(1517):583-93. doi: 10.1098/rstb.2008.0195.
Chen et al., Structure of the DNA deaminase domain of the HIV-1 restriction factor APOBEC3G. Nature. Mar. 6, 2008;452(7183):116-9. doi: 10.1038/nature06638. Epub Feb. 20, 2008.
Chesnoy et al., Structure and function of lipid-DNA complexes for gene delivery. Annu Rev Biophys Biomol Struct. 2000;29:27-47.
Chew et al., A multifunctional AAV-CRISPR-Cas9 and its host response. Nat Methods. Oct. 2016;13(10):868-74. doi: 10.1038/nmeth.3993. Epub Sep. 5, 2016.
Chichili et al., Linkers in the structural biology of protein-protein interactions. Protein Science. 2013;22:153-67.
Chipev et al., A leucine-proline mutation in the H1 subdomain of keratin 1 causes epidermolytic hyperkeratosis. Cell. Sep. 4, 1992;70(5):821-8.
Cho et al., Analysis of off-target effects of CRISPR/Cas-derived RNA-guided endonucleases and nickases. Genome Res. Jan. 2014;24(1):132-41. doi: 10.1101/gr.162339.113. Epub Nov. 19, 2013.
Cho et al., Targeted genome engineering in human cells with the Cas9 RNA-guided endonuclease. Nat Biotechnol. Mar. 2013;31(3):230-2. doi: 10.1038/nbt.2507. Epub Jan. 29, 2013.
Christian et al., Targeting G with TAL effectors: a comparison of activities of TALENs constructed with NN and NK repeat variable di-residues. PLoS One. 2012;7(9):e45383. doi: 10.1371/journal.pone.0045383. Epub Sep. 24, 2012.
Christian et al., Targeting DNA double-strand breaks with TAL effector nucleases. Genetics. Oct. 2010;186(2):757-61. Doi: 10.1534/genetics.110.120717. Epub Jul. 26, 2010.
Chu et al., Increasing the efficiency of homology-directed repair for CRISPR-Cas9-induced precise gene editing in mammalian cells. Nat Biotech. Feb. 13, 2015;33:543-8.
Chung-Il et al., Artificial control of gene expression in mammalian cells by modulating RNA interference through aptamer-small molecule interaction. RNA. May 2006;12(5):710-6. Epub Apr. 10, 2006.
Chylinski et al., The tracrRNA and Cas9 families of type II CRISPR-Cas immunity systems. RNA Biol. May 2013;10(5):726-37. doi: 10.4161/rna.24321. Epub Apr. 5, 2013.
Cole-Strauss et al., Correction of the mutation responsible for sickle cell anemia by an RNA-DNA oligonucleotide. Science. Sep. 6, 1996;273(5280):1386-9.
Cong et al., Multiplex genome engineering using CRISPR/Cas systems. Science. Feb. 15, 2013;339(6121):819-23. doi: 10.1126/science.1231143. Epub Jan. 3, 2013.
Conticello, The AID/APOBEC family of nucleic acid mutators. Genome Biol. 2008;9(6):229. doi: 10.1186/gb-2008-9-6-229. Epub Jun. 17, 2008.
Covino et al., The CCL2/CCR2 Axis in the Pathogenesis of HIV-1 Infection: A New Cellular Target for Therapy? Current Drug Targets Dec. 2016;17(1):76-110. DOI : 10.2174/13894501170151217110917.

Cox et al., Conditional gene expression in the mouse inner ear using Cre-loxP. J Assoc Res Otolaryngol. Jun. 2012;13(3):295-322. doi: 10.1007/s10162-012-0324-5. Epub Apr. 24, 2012.
Cox et al., Therapeutic genome editing: prospects and challenges. Nat Med. Feb. 2015;21(2):121-31. doi: 10.1038/nm.3793.
Cradick et al., CRISPR/Cas9 systems targeting β-globin and CCR5 genes have substantial off-target activity. Nucleic Acids Res. Nov. 1, 2013;41(20):9584-92. doi: 10.1093/nar/gkt714. Epub Aug. 11, 2013.
Cradick et al., ZFN-site searches genomes for zinc finger nuclease target sites and off-target sites. BMC Bioinformatics. May 13, 2011;12:152. doi: 10.1186/1471-2105-12-152.
Cradick et al., Zinc-finger nucleases as a novel therapeutic strategy for targeting hepatitis B virus DNAs. Mol Ther. May 2010;18(5):947-54. Doi: 10.1038/mt.2010.20. Epub Feb. 16, 2010.
Cui et al., Targeted integration in rat and mouse embryos with zinc-finger nucleases. Nat Biotechnol. Jan. 2011;29(1):64-7. Doi: 10.1038/nbt.1731. Epub Dec. 12, 2010.
Cunningham et al., Ensembl 2015. Nucleic Acids Res. Jan. 2015;43(Database issue):D662-9. doi: 10.1093/nar/gku1010. Epub Oct. 28, 2014.
Dahlem et al., Simple methods for generating and detecting locus-specific mutations induced with TALENs in the zebrafish genome. PLoS Genet. 2012;8(8):e1002861. doi: 10.1371/journal.pgen.1002861. Epub Aug. 16, 2012.
Davis et al., DNA double strand break repair via non-homologous end-joining. Transl Cancer Res. Jun. 2013;2(3):130-143.
Davis et al., Small molecule-triggered Cas9 protein with improved genome-editing specificity. Nat Chem Biol. May 2015;11(5):316-8. doi: 10.1038/nchembio.1793. Epub Apr. 6, 2015.
De Souza, Primer: genome editing with engineered nucleases. Nat Methods. Jan. 2012;9(1):27.
Deltcheva et al., CRISPR RNA maturation by trans-encoded small RNA and host factor RNase III. Nature. Mar. 31, 2011;471(7340):602-7. doi: 10.1038/nature09886.
Dicarlo et al., Genome engineering in *Saccharomyces cerevisiae* using CRISPR-Cas systems. Nucleic Acids Research Apr. 2013;41(7):4336-43.
Ding et al., A Talen genome-editing system for generating human stem cell-based disease models. Cell Stem Cell. Feb. 7, 2013;12(2):238-51. Doi: 10.1016/j.stem.2012.11.011. Epub Dec. 13, 2012.
Ding et al., Permanent alteration of PCSK9 with in vivo CRISPR-Cas9 genome editing. Circ Res. Aug. 15, 2014;115(5):488-92. doi: 10.1161/CIRCRESAHA.115.304351. Epub Jun. 10, 2014.
Doench et al., Optimized sgRNA design to maximize activity and minimize off-target effects of CRISPR-Cas9. Nat Biotechnol. Feb. 2016;34(2):184-191. doi: 10.1038/nbt.3437.
Dormiani et al., Long-term and efficient expression of human β-globin gene in a hematopoietic cell line using a new site-specific integrating non-viral system. Gene Ther. Aug. 2015;22(8):663-74. doi: 10.1038/gt.2015.30. Epub Apr. 1, 2015.
Doudna et al., Genome editing. The new frontier of genome engineering with CRISPR-Cas9. Science. Nov. 28, 2014;346(6213):1258096. doi: 10.1126/science.1258096.
Doyon et al., Heritable targeted gene disruption in zebrafish using designed zinc-finger nucleases. Nat Biotechnol. Jun. 2008;26(6):702-8. Doi: 10.1038/nbt1409. Epub May 25, 2008.
Dunaime, Breakthrough method means CRISPR just got a lot more relevant to human health. The Verge. Apr. 20, 2016. http://www.theverge.com/2016/4/20/11450262/crispr-base-editing-single-nucleotides-dna-gene-liu-harvard.
During et al., Controlled release of dopamine from a polymeric brain implant: in vivo characterization. Ann Neurol. Apr. 1989;25(4):351-6.
East-Seletsky et al., Two distinct RNase activities of CRISPR-C2c2 enable guide-RNA processing and RNA detection. Nature Oct. 2016;538(7624):270-3.
Eltoukhy et al., Nucleic acid-mediated intracellular protein delivery by lipid-like nanoparticles. Biomaterials. Aug. 2014;35(24):6454-61. doi: 10.1016/j.biomaterials.2014.04.014. Epub May 13, 2014.
Esvelt et al., Genome-scale engineering for systems and synthetic biology. Mol Syst Biol. 2013;9:641. doi: 10.1038/msb.2012.66.

(56) References Cited

OTHER PUBLICATIONS

Esvelt et al., Orthogonal Cas9 proteins for RNA-guided gene regulation and editing. Nat Methods. Nov. 2013;10(11):1116-21. doi: 10.1038/nmeth.2681. Epub Sep. 29, 2013.
Extended European Search Report for EP 15830407.1, mailed Mar. 2, 2018.
Fine et al., Trans-spliced Cas9 allows cleavage of HBB and CCR5 genes in human cells using compact expression cassettes. Scientific Reports 2015;5(1):Article No. 10777. doi: 10.1038/srep10777. With Supplementary Information.
Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013.
Freshney, Culture of Animal Cells. A Manual of Basic Technique. Alan R. Liss, Inc. New York. 1983;4.
Fu et al., Improving CRISPR-Cas nuclease specificity using truncated guide RNAs. Nat Biotechnol. Mar. 2014;32(3):279-84. doi: 10.1038/nbt.2808. Epub Jan. 26, 2014.
Fu et al., High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.
Fuchs et al., Polyarginine as a multifunctional fusion tag. Protein Sci. Jun. 2005;14(6):1538-44.
Fujisawa et al., Disease-associated mutations in CIAS1 induce cathepsin B-dependent rapid cell death of human THP-1 monocytic cells. Blood. Apr. 1, 2007;109(7):2903-11.
Fukui et al., DNA Mismatch Repair in Eukaryotes and Bacteria. J Nucleic Acids. Jul. 27, 2010;2010. pii: 260512. doi: 10.4061/2010/260512.
Fung et al., Repair at single targeted DNA double-strand breaks in pluripotent and differentiated human cells. PLoS One. 2011;6(5):e20514. doi: 10.1371/journal.pone.0020514. Epub May 25, 2011.
Gaj et al., A comprehensive approach to zinc-finger recombinase customization enables genomic targeting in human cells. Nucleic Acids Res. Feb. 6, 2013;41(6):3937-46.
Gaj et al., Enhancing the specificity of recombinase-mediated genome engineering through dimer interface redesign. J Am Chem Soc. Apr. 2, 2014;136(13):5047-56. doi: 10.1021/ja4130059. Epub Mar. 20, 2014.
Gaj et al., Expanding the scope of site-specific recombinases for genetic and metabolic engineering. Biotechnol Bioeng. Jan. 2014;111(1):1-15. doi: 10.1002/bit.25096. Epub Sep. 13, 2013.
Gaj et al., ZFN, TALEN, and CRISPR/Cas-based methods for genome engineering. Trends Biotechnol. Jul. 2013;31(7):397-405. doi: 10.1016/j.tibtech.2013.04.004. Epub May 9, 2013.
Gallo et al., A novel pathogenic PSEN1 mutation in a family with Alzheimer's disease: phenotypical and neuropathological features. J Alzheimers Dis. 2011;25(3):425-31. doi: 10.3233/JAD-2011-110185.
Gao et al., DNA-guided genome editing using the Natronobacterium gregoryi Argonaute. Nat Biotechnol. Jul. 2016;34(7):768-73. doi: 10.1038/nbt.3547. Epub May 2, 2016.
Gardlik et al., Vectors and delivery systems in gene therapy. Med Sci Monit. Apr. 2005;11(4):RA110-21. Epub Mar. 24, 2005.
Garneau et al., The CRISPR/Cas bacterial immune system cleaves bacteriophage and plasmid DNA. Nature. Nov. 4, 2010;468(7320):67-71. doi: 10.1038/nature09523.
Gasiunas et al., Cas9-crRNA ribonucleoprotein complex mediates specific DNA cleavage for adaptive immunity in bacteria. Proc Natl Acad Sci U S A. Sep. 25, 2012;109(39):E2579-86. Epub Sep. 4, 2012. Supplementary materials included.
Gasiunas et al., RNA-dependent DNA endonuclease Cas9 of the CRISPR system: Holy Grail of genome editing? Trends Microbiol. Nov. 2013;21(11):562-7. doi: 10.1016/j.tim.2013.09.001. Epub Oct. 1, 2013.
GenBank Submission; NIH/NCBI, Accession No. J04623. Kita et al., Apr. 26, 1993. 2 pages.
GenBank Submission; NIH/NCBI, Accession No. NC_002737.1. Ferretti et al., Jun. 27, 2013. 1 page.

GenBank Submission; NIH/NCBI, Accession No. NC_015683.1. Trost et al., Jul. 6, 2013. 1 page.
GenBank Submission; NIH/NCBI, Accession No. NC_016782.1. Trost et al., Jun. 11, 2013. 1 page.
GenBank Submission; NIH/NCBI, Accession No. NC_016786.1. Trost et al., Aug. 28, 2013. 1 page.
GenBank Submission; NIH/NCBI, Accession No. NC_017053.1. Fittipaldi et al., Jul. 6, 2013. 1 page.
GenBank Submission; NIH/NCBI, Accession No. NC_017317.1. Trost et al., Jun. 11, 2013. 1 page.
GenBank Submission; NIH/NCBI, Accession No. NC_017861.1. Heidelberg et al., Jun. 11, 2013. 1 page.
GenBank Submission; NIH/NCBI, Accession No. NC_018010.1. Lucas et al., Jun. 11, 2013. 2 pages.
GenBank Submission; NIH/NCBI, Accession No. NC_018721.1. Feng et al., Jun. 11, 2013. 1 pages.
GenBank Submission; NIH/NCBI, Accession No. NC_021284.1. Ku et al., Jul. 12, 2013. 1 page.
GenBank Submission; NIH/NCBI, Accession No. NC_021314.1. Zhang et al., Jul. 15, 2013. 1 page.
GenBank Submission; NIH/NCBI, Accession No. NC_021846.1. Lo et al., Jul. 22, 2013. 1 page.
GenBank Submission; NIH/NCBI, Accession No. NP_472073.1. Glaser et al., Jun. 27, 2013. 2 pages.
GenBank Submission; NIH/NCBI, Accession No. P42212. Prasher et al., Mar. 19, 2014. 7 pages.
GenBank Submission; NIH/NCBI, Accession No. YP_002342100.1. Bernardini et al., Jun. 10, 2013. 2 pages.
GenBank Submission; NIH/NCBI, Accession No. YP_002344900.1. Gundogdu et al., Mar. 19, 2014. 2 pages.
GenBank Submission; NIH/NCBI, Accession No. YP_820832.1. Makarova et al., Aug. 27, 2013. 2 pages.
Gerber et al., RNA editing by base deamination: more enzymes, more targets, new mysteries. Trends Biochem Sci. Jun. 2001;26(6):376-84.
Gersbach et al., Directed evolution of recombinase specificity by split gene reassembly. Nucleic Acids Res. Jul. 2010;38(12):4198-206. doi: 10.1093/nar/gkq125. Epub Mar. 1, 2010.
Gersbach et al., Targeted plasmid integration into the human genome by an engineered zinc-finger recombinase. Nucleic Acids Res. Sep. 1, 2011;39(17):7868-78. doi: 10.1093/nar/gkr421. Epub Jun. 7, 2011.
Gilbert et al., CRISPR-mediated modular RNA-guided regulation of transcription in eukaryotes. Cell. 2013 154(2):442-51.
Gilleron et al., Image-based analysis of lipid nanoparticle-mediated siRNA delivery, intracellular trafficking and endosomal escape. Nat Biotechnol. Jul. 2013;31(7):638-46. doi: 10.1038/nbt.2612. Epub Jun. 23, 2013.
Gonzalez et al., An iCRISPR platform for rapid, multiplexable, and inducible genome editing in human pluripotent stem cells. Cell Stem Cell. Aug. 7, 2014;15(2):215-26. doi: 10.1016/j.stem.2014.05.018. Epub Jun. 12, 2014.
Guilinger et al., Broad specificity profiling of TALENs results in engineered nucleases with improved DNA-cleavage specificity. Nat Methods. Apr. 2014;11(4):429-35. doi: 10.1038/nmeth.2845. Epub Feb. 16, 2014.
Guilinger et al., Fusion of catalytically inactive Cas9 to FokI nuclease improves the specificity of genome modification. Nat Biotechnol. Jun. 2014;32(6):577-82. doi: 10.1038/nbt.2909. Epub Apr. 25, 2014.
Guo et al., Protein tolerance to random amino acid change. Proc Natl Acad Sci U S A. Jun. 22, 2004;101(25):9205-10. Epub Jun. 14, 2004.
Haeussler et al., Evaluation of off-target and on-target scoring algorithms and integration into the guide RNA selection tool CRISPOR. Genome Biol. Jul. 5, 2016;17(1):148. doi: 10.1186/s13059-016-1012-2.
Hale et al., RNA-guided RNA cleavage by a CRISPR RNA-Cas protein complex. Cell. Nov. 25, 2009;139(5):945-56. doi: 10.1016/j.cell.2009.07.040.
Han, New CRISPR/Cas9-based Tech Edits Single Nucleotides Without Breaking DNA. Genome Web, Apr. 20, 2016. https://www.

(56) References Cited

OTHER PUBLICATIONS genomeweb.com/gene-silencinggene-editing/new-crisprcas9-based-tech-edits-single-nucleotides-without-breaking-dna.
Harris et al., RNA editing enzyme APOBEC1 and some of its homologs can act as DNA mutators. Mol Cell. Nov. 2002;10(5):1247-53.
Hartung et al., Correction of metabolic, craniofacial, and neurologic abnormalities in MPS I mice treated at birth with adeno-associated virus vector transducing the human alpha-L-iduronidase gene. Mol Ther. Jun. 2004;9(6):866-75.
Hasadsri et al., Functional protein delivery into neurons using polymeric nanoparticles. J Biol Chem. Mar. 13, 2009;284(11):6972-81. doi: 10.1074/jbc.M805956200. Epub Jan. 7, 2009.
Heller et al., Replisome assembly and the direct restart of stalled replication forks. Nat Rev Mol Cell Biol. Dec. 2006;7(12):932-43. Epub Nov. 8, 2006.
Hess et al., Directed evolution using dCas9-targeted somatic hypermutation in mammalian cells. Nat Methods. Dec. 2016;13(12):1036-1042. doi: 10.1038/nmeth.4038. Epub Oct. 31, 2016.
Hill et al., Functional analysis of conserved histidines in ADP-glucose pyrophosphorylase from *Escherichia coli*.Biochem Biophys Res Commun. Mar. 17, 1998;244(2):573-7.
Hilton et al., Enabling functional genomics with genome engineering. Genome Res. Oct. 2015;25(10):1442-55. doi: 10.1101/gr.190124.115.
Hockemeyer et al., Efficient targeting of expressed and silent genes in human ESCs and iPSCs using zinc-finger nucleases. Nat Biotechnol. Sep. 2009;27(9):851-7. doi: 10.1038/nbt. 1562. Epub Aug. 13, 2009.
Hockemeyer et al., Genetic engineering of human pluripotent cells using TALE nucleases. Nat Biotechnol. Jul. 7, 2011;29(8):731-4. doi: 10.1038/nbt.1927.
Holden et al., Crystal structure of the anti-viral APOBEC3G catalytic domain and functional implications. Nature. Nov. 6, 2008;456(7218):121-4. doi: 10.1038/nature07357. Epub Oct. 12, 2008.
Hondares et al., Peroxisome Proliferator-activated Receptor α (PPARα) Induces PPAR65 Coactivator 1α (PGC-1α) Gene Expression and Contributes to Thermogenic Activation of Brown Fat. J Biol. Chem Oct. 2011; 286(50):43112-22. doi: 10.1074/jbc.M111.252775.
Horvath et al., CRISPR/Cas, the immune system of bacteria and archaea. Science. Jan. 8, 2010;327(5962):167-70. doi: 10.1126/science.1179555.
Hou et al., Efficient genome engineering in human pluripotent stem cells using Cas9 from Neisseria meningitidis. Proc Natl Acad Sci U S A. Sep. 24, 2013;110(39):15644-9. doi: 10.1073/pnas.1313587110. Epub Aug. 12, 2013.
Houdebine, The methods to generate transgenic animals and to control transgene expression. J Biotechnol. Sep. 25, 2002;98(2-3):145-60.
Howard et al., Intracerebral drug delivery in rats with lesion-induced memory deficits. J Neurosurg. Jul. 1989;71(1):105-12.
Hower et al., Shape-based peak identification for ChIP-Seq. BMC Bioinformatics. Jan. 12, 2011;12:15. doi: 10.1186/1471-2105-12-15.
Hsu et al., DNA targeting specificity of RNA-guided Cas9 nucleases. Nat Biotechnol. Sep. 2013;31(9):827-32. doi: 10.1038/nbt.2647. Epub Jul. 21, 2013.
Hu et al., Chemical Biology Approaches to Genome Editing: Understanding, Controlling, and Delivering Programmable Nucleases. Cell Chem Biol. Jan. 21, 2016;23(1):57-73. doi: 10.1016/j.chembiol.2015.12.009.
Huang et al., Heritable gene targeting in zebrafish using customized TALENs. Nat Biotechnol. Aug. 5, 2011;29(8):699-700. doi: 10.1038/nbt.1939.
Humbert et al., Targeted gene therapies: tools, applications, optimization. Crit Rev Biochem Mol Biol. May-Jun. 2012;47(3):264-81. doi: 10.3109/10409238.2012.658112.
Hurt et al., Highly specific zinc finger proteins obtained by directed domain shuffling and cell-based selection. Proc Natl Acad Sci U S A. Oct. 14, 2003;100(21): 12271-6. Epub Oct. 3, 2003.
Hwang et al., Efficient genome editing in zebrafish using a CRISPR-Cas system. Nat Biotechnol. Mar. 2013;31(3):227-9. doi: 10.1038/nbt.2501. Epub Jan. 29, 2013.
Hwang et al., Efficient In Vivo Genome Editing Using RNA-Guided Nucleases. Nat Biotechnol. Mar. 2013; 31(3): 227-229. doi: 10.1038/nbt.2501. Epub Jan. 29, 2013.
Ikediobi et al., Mutation analysis of 24 known cancer genes in the NCI-60 cell line set. Mol Cancer Ther. Nov. 2006;5(11):2606-12. Epub Nov. 6, 2006.
International Preliminary Report on Patentability for PCT/US2016/058344, mailed May 3, 2018.
International Preliminary Report on Patentability for PCT/US2012/047778, mailed Feb. 6, 2014.
International Preliminary Report on patentability for PCT/US2014/050283, mailed Feb. 18, 2016.
International Preliminary Report on Patentability for PCT/US2014/052231, mailed Mar. 3, 2016.
International Preliminary Report on Patentability for PCT/US2014/054247, mailed Mar. 17, 2016.
International Preliminary Report on Patentability for PCT/US2014/054291, mailed Mar. 17, 2016.
International Preliminary Report on Patentability for PCT/US2014/070038, mailed Jun. 23, 2016.
International Preliminary Report on Patentability for PCT/US2015/042770, mailed Dec. 19, 2016.
International Preliminary Report on Patentability for PCT/US2015/058479, mailed May 11, 2017.
International Preliminary Report on Patentability or PCT/US2014/054252, mailed Mar. 17, 2016.
International Search Report and Written Opinion for PCT/US2012/047778, mailed May 30, 2013.
International Search Report and Written Opinion for PCT/US2014/050283, mailed Nov. 6, 2014.
International Search Report and Written Opinion for PCT/US2014/052231, mailed Dec. 4, 2014.
International Search Report and Written Opinion for PCT/US2014/054247, mailed Mar. 27, 2015.
International Search Report and Written Opinion for PCT/US2014/054252, mailed Mar. 5, 2015.
International Search Report and Written Opinion for PCT/US2014/054291, mailed Mar. 27, 2015.
International Search Report and Written Opinion for PCT/US2014/070038, mailed Apr. 14, 2015.
International Search Report and Written Opinion for PCT/US2015/042770, mailed Feb. 23, 2016.
International Search Report and Written Opinion for PCT/US2015/058479, mailed Feb. 11, 2016.
International Search Report and Written Opinion for PCT/US2016/044546, mailed Dec. 28, 2016.
International Search Report and Written Opinion for PCT/US2016/058344, mailed Apr. 20, 2017.
International Search Report and Written Opinion for PCT/US2017/045381, mailed Oct. 26, 2017.
International Search Report and Written Opinion for PCT/US2017/046144, mailed Oct. 10, 2017.
International Search Report and Written Opinion for PCT/US2017/056671, mailed Feb. 20, 2018.
International Search Report and Written Opinion for PCT/US2017/068105, mailed Apr. 4, 2018.
International Search Report and Written Opinion for PCT/US2017/068114, mailed Mar. 20, 2018.
International Search Report and Written Opinion for PCT/US2017/48390, mailed Jan. 9, 2018.
International Search Report for PCT/US2013/032589, mailed Jul. 26, 2013.
Invitation to Pay Additional Fees for PCT/US2014/054291, mailed Dec. 18, 2014.
Invitation to Pay Additional Fees for PCT/US2016/058344, mailed Mar. 1, 2017.

(56) References Cited

OTHER PUBLICATIONS

Invitation to Pay Additional Fees for PCT/US2017/056671, mailed Dec. 21, 2017.
Invitation to Pay Additional Fees for PCT/US2017/48390, mailed Nov. 7, 2017.
Irrthum et al., Congenital hereditary lymphedema caused by a mutation that inactivates VEGFR3 tyrosine kinase. Am J Hum Genet. Aug. 2000;67(2):295-301. Epub Jun. 9, 2000.
Ishino et al., Nucleotide sequence of the iap gene, responsible for alkaline phosphatase isozyme conversion in *Escherichia coli*, and identification of the gene product. J Bacteriol. Dec. 1987;169(12):5429-33.
Jamieson et al., Drug discovery with engineered zinc-finger proteins. Nat Rev Drug Discov. May 2003;2(5):361-8.
Jansen et al., Backbone and nucleobase contacts to glucosamine-6-phosphate in the glmS ribozyme. Nat Struct Mol Biol. Jun. 2006;13(6):517-23. Epub May 14, 2006.
Jansen et al., Identification of genes that are associated with DNA repeats in prokaryotes. Mol Microbiol. Mar. 2002;43(6):1565-75.
Jenkins et al., Comparison of a preQ1 riboswitch aptamer in metabolite-bound and free states with implications for gene regulation. J Biol Chem. Jul. 15, 2011;286(28):24626-37. doi: 10.1074/jbc.M111.230375. Epub May 18, 2011.
Jiang et al., RNA-guided editing of bacterial genomes using CRISPR-Cas systems. Nat Biotechnol. Mar. 2013;31(3):233-9. doi: 10.1038/nbt.2508. Epub Jan. 29, 2013.
Jiang et al., Structures of a CRISPR-Cas9 R-loop complex primed for DNA cleavage. Science. Feb. 19, 2016;351(6275):867-71. doi: 10.1126/science.aad8282. Epub Jan. 14, 2016.
Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.
Jinek et al., RNA-programmed genome editing in human cells. Elife. Jan. 29, 2013;2:e00471. doi: 10.7554/eLife.00471.
Jinek et al., Structures of Cas9 endonucleases reveal RNA-mediated conformational activation. Science. Mar. 14, 2014;343(6176):1247997. doi: 10.1126/science.1247997. Epub Feb. 6, 2014.
Jore et al., Structural basis for CRISPR RNA-guided DNA recognition by Cascade. Nat Struct Mol Biol. May 2011;18(5):529-36. doi: 10.1038/nsmb.2019. Epub Apr. 3, 2011.
Joung et al., TALENs: a widely applicable technology for targeted genome editing. Nat Rev Mol Cell Biol. Jan. 2013;14(1):49-55. doi: 10.1038/nrm3486. Epub Nov. 21, 2012.
Kaiser et al., Gene therapy. Putting the fingers on gene repair. Science. Dec. 23, 2005;310(5756):1894-6.
Kandavelou et al., Targeted manipulation of mammalian genomes using designed zinc finger nucleases. Biochem Biophys Res Commun. Oct. 9, 2009;388(1):56-61. doi: 10.1016/j.bbrc.2009.07.112. Epub Jul. 25, 2009.
Kappel et al., Regulating gene expression in transgenic animals. Curr Opin Biotechnol. Oct. 1992;3(5):548-53.
Karpenshif et al., From yeast to mammals: recent advances in genetic control of homologous recombination. DNA Repair (Amst). Oct. 1, 2012;11(10):781-8. doi: 10.1016/j.dnarep.2012.07.001. Epub Aug. 11, 2012. Review.
Karpinsky et al., Directed evolution of a recombinase that excises the provirus of most HIV-1 primary isolates with high specificity. Nat Biotechnol. Apr. 2016;34(4):401-9. doi: 10.1038/nbt.3467. Epub Feb. 22, 2016.
Kaya et al., A bacterial Argonaute with noncanonical guide RNA specificity. Proc. Natl. Acad. Sci. USA Apr. 2016;113(15):4057-62.
Kellendonk et al., Regulation of Cre recombinase activity by the synthetic steroid RU 486. Nucleic Acids Res. Apr. 15, 1996;24(8):1404-11.
Kim et al., A library of TAL effector nucleases spanning the human genome. Nat Biotechnol. Mar. 2013;31(3):251-8. Doi: 10.1038/nbt.2517. Epub Feb. 17, 2013.
Kim et al., Genome-wide target specificities of CRISPR RNA-guided programmable deaminases. Nat Biotechnol. May 2017;35(5):475-480. doi: 10.1038/nbt.3852. Epub Apr. 10, 2017.
Kim et al., Highly efficient RNA-guided base editing in mouse embryos. Nat Biotechnol. May 2017;35(5):435-437. doi: 10.1038/nbt.3816. Epub Feb. 27, 2017.
Kim et al., Highly efficient RNA-guided genome editing in human cells via delivery of purified Cas9 ribonucleoproteins. Genome Res. Jun. 2014;24(6):1012-9. doi: 10.1101/gr.171322.113. Epub Apr. 2, 2014.
Kim et al., Increasing the genome-targeting scope and precision of base editing with engineered Cas9-cytidine deaminase fusions. Nat Biotechnol. Apr. 2017;35(4):371-376. doi: 10.1038/nbt.3803. Epub Feb. 13, 2017.
Kim et al., TALENs and ZFNs are associated with different mutationsignatures. Nat Methods. Mar. 2013;10(3):185. doi: 10.1038/nmeth.2364. Epub Feb. 10, 2013.
Kim et al., Targeted genome editing in human cells with zinc finger nucleases constructed via modular assembly. Genome Res. Jul. 2009;19(7):1279-88. doi: 10.1101/gr.089417.108. Epub May 21, 2009.
Kim et al., The role of apolipoprotein E in Alzheimer's disease. Neuron. Aug. 13, 2009;63(3):287-303. doi: 10.1016/j.neuron.2009.06.026.
Kim et al., Transcriptional repression by zinc finger peptides. Exploring the potential for applications in gene therapy. J Biol Chem. Nov. 21, 1997;272(47):29795-800.
Kitamura et al., Uracil DNA glycosylase counteracts APOBEC3G-induced hypermutation of hepatitis B viral genomes: excision repair of covalently closed circular DNA. PLoS Pathog. 2013;9(5):e1003361. doi: 10.1371/journal.ppat.1003361. Epub May 16, 2013.
Klauser et al., An engineered small RNA-mediated genetic switch based on a ribozyme expression platform. Nucleic Acids Res. May 1, 2013;41(10):5542-52. doi: 10.1093/nar/gkt253. Epub Apr. 12, 2013.
Kleinstiver et al., Broadening the targeting range of *Staphylococcus aureus* CRISPR-Cas9 by modifying PAM recognition. Nat Biotechnol. Dec. 2015;33(12):1293-1298. doi: 10.1038/nbt.3404. Epub Nov. 2, 2015.
Kleinstiver et al., Engineered CRISPR-Cas9 nucleases with altered PAM specificities. Nature. Jul. 23, 2015;523(7561):481-5. doi: 10.1038/nature14592. Epub Jun. 22, 2015.
Kleinstiver et al., High-fidelity CRISPR-Cas9 nucleases with no detectable genome-wide off-target effects. Nature. Jan. 28, 2016;529(7587):490-5. doi: 10.1038/nature16526. Epub Jan. 6, 2016.
Kleinstiver et al., Monomeric site-specific nucleases for genome editing. Proc Natl Acad Sci U S A. May 22, 2012;109(21):8061-6. doi: 10.1073/pnas.1117984109. Epub May 7, 2012.
Klippel et al., Isolation and characterization of unusual gin mutants. EMBO J. Dec. 1, 1988;7(12):3983-9.
Klippel et al., The DNA invertase Gin of phage Mu: formation of a covalent complex with DNA via a phosphoserine at amino acid position 9. EMBO J. Apr. 1988;7(4):1229-37.
Kohli et al., Local sequence targeting in the AID/APOBEC family differentially impacts retroviral restriction and antibody diversification. J Biol Chem. Dec. 24, 2010;285(52):40956-64. doi: 10.1074/jbc.M110.177402. Epub Oct. 6, 2010.
Komor et al., CRISPR-Based Technologies for the Manipulation of Eukaryotic Genomes. Cell. Jan. 12, 2017;168(1-2):20-36. doi: 10.1016/j.cell.2016.10.044.
Komor et al., Improved base excision repair inhibition and bacteriophage Mu Gam protein yields C:G-to-T:A base editors with higher efficiency and product purity. Sci Adv. Aug. 30, 2017;3(8):eaao4774. doi: 10.1126/sciadv.aao4774. eCollection Aug. 2017.
Komor et al., Programmable editing of a target base in genomic DNA without double-stranded DNA cleavage. Nature. Apr. 20, 2016;533(7603):420-4. doi: 10.1038/nature17946.
Kouzminova et al., Patterns of chromosomal fragmentation due to uracil-DNA incorporation reveal a novel mechanism of replication-dependent double-stranded breaks. Mol Microbiol. Apr. 2008;68(1):202-15. doi: 10.1111/j.1365-2958.2008.06149.x.
Kumar et al., Structural and functional consequences of the mutation of a conserved arginine residue in alphaA and alphaB crystallins. J Biol Chem. Aug. 20, 1999;274(34):24137-41.

(56) References Cited

OTHER PUBLICATIONS

Kundu et al., Leucine to proline substitution by SNP at position 197 in Caspase-9 gene expression leads to neuroblastoma: a bioinformatics analysis. 3 Biotech. 2013; 3:225-34.
Kunz et al., DNA Repair in mammalian cells: Mismatched repair: variations on a theme. Cell Mol Life Sci. Mar. 2009;66(6):1021-38. doi: 10.1007/s00018-009-8739-9.
Kuscu et al., CRISPR-STOP: gene silencing through base-editing-induced nonsense mutations. Nat Methods. Jul. 2017;14(7):710-712. doi: 10.1038/nmeth.4327. Epub Jun. 5, 2017.
Kuscu et al., Genome-wide analysis reveals characteristics of off-target sites bound by the Cas9 endonuclease. Nat Biotechnol. Jul. 2014;32(7):677-83. doi: 10.1038/nbt.2916. Epub May 18, 2014.
Landrum et al., ClinVar: public archive of interpretations of clinically relevant variants. Nucleic Acids Res. Jan. 4, 2016;44(D1):D862-8. doi: 10.1093/nar/gkv1222. Epub Nov. 17, 2015.
Langer et al., Chemical and Physical Structure of Polymers as Carriers for Controlled Release of Bioactive Agents: A Review. Journal of Macromolecular Science, 2006;23(1):61-126. DOI: 10.1080/07366578308079439.
Langer et al., New methods of drug delivery. Science. Sep. 28, 1990;249(4976):1527-33.
Larson et al., CRISPR interference (CRISPRi) for sequence-specific control of gene expression. Nat Protoc. Nov. 2013;8(11):2180-96. doi: 10.1038/nprot.2013.132. Epub Oct. 17, 2013.
Lau et al., Molecular basis for discriminating between normal and damaged bases by the human alkyladenine glycosylase, AAG. Proc Natl Acad Sci U S A. Dec. 5, 2000;97(25):13573-8.
Lavergne et al., Defects in type IIA von Willebrand disease: a cysteine 509 to arginine substitution in the mature von Willebrand factor disrupts a disulphide loop involved in the interaction with platelet glycoprotein Ib-IX. Br J Haematol. Sep. 1992;82(1):66-72.
Lawrence et al., Supercharging proteins can impart unusual resilience. J Am Chem Soc. Aug. 22, 2007;129(33): 10110-2. Epub Aug. 1, 2007.
Lazar et al., Transforming growth factor alpha: mutation of aspartic acid 47 and leucine 48 results in different biological activities. Mol Cell Biol. Mar. 1988;8(3):1247-52.
Ledford, Gene-editing hack yields pinpoint precision. Nature, Apr. 20, 2016. http://www.nature.com/news/gene-editing-hack-yields-pinpoint-precision-1.19773.
Lee et al., A chimeric thyroid hormone receptor constitutively bound to DNA requires retinoid X receptor for hormone-dependent transcriptional activation in yeast. Mol Endocrinol. Sep. 1994;8(9):1245-52.
Lee et al., Failure to detect DNA-guided genome editing using Natronobacterium gregoryi Argonaute. Nat Biotechnol. Nov. 28, 2016;35(1):17-18. doi: 10.1038/nbt.3753.
Lee et al., PIK3CA gene is frequently mutated in breast carcinomas and hepatocellular carcinomas. Oncogene. Feb. 17, 2005;24(8):1477-80.
Lee et al., Recognition of liposomes by cells: in vitro binding and endocytosis mediated by specific lipid headgroups and surface charge density. Biochim Biophys Acta. Jan. 31, 1992;1103(2):185-97.
Lei et al., Efficient targeted gene disruption in Xenopus embryos using engineered transcription activator-like effector nucleases (TALENs). Proc Natl Acad Sci U S A. Oct. 23, 2012;109(43):17484-9. Doi: 10.1073/pnas.1215421109. Epub Oct. 8, 2012.
Lenk et al., Pathogenic mechanism of the FIG4 mutation responsible for Charcot-Marie-Tooth disease CMT4J. PLoS Genet. Jun. 2011;7(6):e1002104. doi: 10.1371/journal.pgen.1002104. Epub Jun. 2, 2011.
Levy et al., Inhibition of calcification of bioprosthetic heart valves by local controlled-release diphosphonate. Science. Apr. 12, 1985;228(4696):190-2.
Lewis et al., A serum-resistant cytofectin for cellular delivery of antisense oligodeoxynucleotides and plasmid DNA. Proc Natl Acad Sci U S A. Apr. 16, 1996;93(8):3176-81.

Lewis et al., Codon 129 polymorphism of the human prion protein influences the kinetics of amyloid formation. J Gen Virol. Aug. 2006;87(Pt 8):2443-9.
Li et al., Base editing with a Cpf1-cytidine deaminase fusion. Nat Biotechnol. Apr. 2018;36(4):324-327. doi: 10.1038/nbt.4102. Epub Mar. 19, 2018.
Li et al., Current approaches for engineering proteins with diverse biological properties. Adv Exp Med Biol. 2007;620:18-33.
Li et al., Generation of Targeted Point Mutations in Rice by a Modified CRISPR/Cas9 System. Mol Plant. Mar. 6, 2017;10(3):526-529. doi: 10.1016/j.molp.2016.12.001. Epub Dec. 8, 2016.
Li et al., Highly efficient and precise base editing in discarded human tripronuclear embryos. Protein Cell. Aug. 19, 2017. doi: 10.1007/s13238-017-0458-7. [Epub ahead of print].
Li et al., Modularly assembled designer TAL effector nucleases for targeted gene knockout and gene replacement in eukaryotes. Nucleic Acids Res. Aug. 2011;39(14):6315-25. doi: 10.1093/nar/gkr188. Epub Mar. 31, 2011.
Li et al., Multiplex and homologous recombination-mediated genome editing in *Arabidopsis* and Nicotiana benthamiana using guide RNA and Cas9. Nat Biotechnol. Aug. 2013;31(8):688-91. doi: 10.1038/nbt.2654.
Li et al., TAL nucleases (TALNs): hybrid proteins composed of TAL effectors and FokI DNA-cleavage domain. Nucleic Acids Res. Jan. 2011;39(1):359-72. doi: 10.1093/nar/gkq704. Epub Aug. 10, 2010.
Liang et al., Rapid and highly efficient mammalian cell engineering via Cas9 protein transfection. Send to; J Biotechnol. Aug. 20, 2015;208:44-53. doi: 10.1016/j.jbiotec.2015.04.024.
Lieber et al., Mechanism and regulation of human non-homologous DNA end-joining. Nat Rev Mol Cell Biol. Sep. 2003;4(9):712-20.
Lin et al., Enhanced homology-directed human genome engineering by controlled timing of CRISPR/Cas9 delivery. Elife. Dec. 15, 2014;3:e04766. doi: 10.7554/eLife.04766.
Liu et al., C2c1-sgRNA Complex Structure Reveals RNA-Guided DNA Cleavage Mechanism. Molecular Cell Jan. 2017;65(2):310-22.
Liu et al., Apolipoprotein E and Alzheimer disease: risk, mechanisms and therapy. Nat Rev Neurol. Feb. 2013;9(2):106-18. doi: 10.1038/nrneurol.2012.263. Epub Jan. 8, 2013.
Liu et al., Balancing AID and DNA repair during somatic hypermutation. Trends Immunol. Apr. 2009;30(4):173-81. doi: 10.1016/j.it.2009.01.007.
Liu et al., Cell-penetrating peptide-mediated delivery of TALEN proteins via bioconjugation for genome engineering. PLoS One. Jan. 20, 2014;9(1):e85755. doi: 10.1371/journal.pone.0085755. eCollection 2014.
Liu et al., Design of polydactyl zinc-finger proteins for unique addressing within complex genomes. Proc Natl Acad Sci U S A. May 27, 1997;94(11):5525-30.
Liu et al., Distance determination by GIY-YIG intron endonucleases: discrimination between repression and cleavage functions. Nucleic Acids Res. Mar. 31, 2006;34(6): 1755-64. Print 2006.
Liu et al., Fast Colorimetric Sensing of Adenosine and Cocaine Based on a General Sensor Design Involving Aptamers and Nanoparticles. Angew Chem. 2006;118(1):96-100.
Lombardo et al., Gene editing in human stem cells using zinc finger nucleases and integrase-defective lentiviral vector delivery. Nat Biotechnol. Nov. 2007;25(11):1298-306. Epub Oct. 28, 2007.
Losey et al., Crystal structure of *Staphylococcus sureus* tRNA adenosine deaminase tadA in complex with RNA. Nature Struct. Mol. Biol. Feb. 2006;13(2):153-9.
Lu et al., Precise Editing of a Target Base in the Rice Genome Using a Modified CRISPR/Cas9 System. Mol Plant. Mar. 6, 2017;10(3):523-525. doi: 10.1016/j.molp.2016.11.013. Epub Dec. 6, 2016.
Lundberg et al., Delivery of short interfering RNA using endosomolytic cell-penetrating peptides. FASEB J. Sep. 2007;21(11):2664-71. Epub Apr. 26, 2007.
Lundquist et al., Site-directed mutagenesis and characterization of uracil-DNA glycosylase inhibitor protein. Role of specific carboxylic amino acids in complex formation with *Escherichia coli* uracil-DNA glycosylase. J Biol Chem. Aug. 22, 1997;272(34):21408-19.

(56) References Cited

OTHER PUBLICATIONS

Lyons et al., Efficient Recognition of an Unpaired Lesion by a DNA Repair Glycosylase. J. Am. Chem. Soc., 2009;131(49):17742-3. DOI: 10.1021/ja908378y.

Ma et al., Targeted AID-mediated mutagenesis (TAM) enables efficient genomic diversification in mammalian cells. Nature Methods. Oct. 2016;13:1029-35. doi: 10.1038/nmeth.4027.

Maeder et al., CRISPR RNA-guided activation of endogenous human genes. Nat Methods. Oct. 2013;10(10):977-9. doi: 10.1038/nmeth.2598. Epub Jul. 25, 2013.

Maeder et al., Rapid "open-source" engineering of customized zinc-finger nucleases for highly efficient gene modification. Mol Cell. Jul. 25, 2008;31(2):294-301. doi:10.1016/j.molcel.2008.06.016.

Maeder et al., Robust, synergistic regulation of human gene expression using TALE activators. Nat Methods. Mar. 2013;10(3):243-5. doi: 10.1038/nmeth.2366. Epub Feb. 10, 2013.

Mahfouz et al., De novo-engineered transcription activator-like effector (TALE) hybrid nuclease with novel DNA binding specificity creates double-strand breaks. Proc Natl Acad Sci U S A. Feb. 8, 2011;108(6):2623-8. doi: 10.1073/pnas.1019533108. Epub Jan. 24, 2011.

Makarova et al., Prokaryotic homologs of Argonaute proteins are predicted to function as key components of a novel system of defense against mobile genetic elements. Biology Direct 2009;4:29.

Makarova et al., An updated evolutionary classification of CRISPR-Cas systems. Nat Rev Microbiol. Nov. 2015;13(11):722-36. doi: 10.1038/nrmicro3569. Epub Sep. 28, 2015.

Makarova et al., Evolution and classification of the CRISPR-Cas systems. Nat Rev Microbiol. Jun. 2011;9(6):467-77. doi: 10.1038/nrmicro2577. Epub May 9, 2011.

Mali et al., Cas9 as a versatile tool for engineering biology. Nat Methods. Oct. 2013;10(10):957-63. doi: 10.1038/nmeth.2649.

Mali et al., CAS9 transcriptional activators for target specificity screening and paired nickases for cooperative genome engineering. Nat Biotechnol. Sep. 2013;31(9):833-8. doi: 10.1038/nbt.2675. Epub Aug. 1, 2013.

Mali et al., RNA-guided human genome engineering via Cas9. Science. Feb. 15, 2013;339(6121):823-6. doi: 10.1126/science.1232033. Epub Jan. 3, 2013.

Mani et al., Design, engineering, and characterization of zinc finger nucleases. Biochem Biophys Res Commun. Sep. 23, 2005;335(2):447-57.

Marioni et al., DNA methylation age of blood predicts all-cause mortality in later life. Genome Biol. Jan. 30, 2015;16:25. doi: 10.1186/s13059-015-0584-6.

Marraffini et al., CRISPR interference limits horizontal gene transfer in staphylococci by targeting DNA. Science. Dec. 19, 2008;322(5909):1843-5. doi: 10.1126/science.1165771.

Maruyama et al., Increasing the efficiency of precise genome editing with CRISPR-Cas9 by inhibition of nonhomologous end joining. Nat Biotechnol. May 2015;33(5):538-42. doi: 10.1038/nbt.3190. Epub Mar. 23, 2015.

Mei et al., Recent Progress in CRISPR/Cas9 Technology. J Genet Genomics. Feb. 20, 2016;43(2):63-75. doi: 10.1016/j.jgg.2016.01.001. Epub Jan. 18, 2016.

Meng et al., Targeted gene inactivation in zebrafish using engineered zinc-finger nucleases. Nat Biotechnol. Jun. 2008;26(6):695-701. doi: 10.1038/nbt1398. Epub May 25, 2008.

Mercer et al., Chimeric TALE recombinases with programmable DNA sequence specificity. Nucleic Acids Res. Nov. 2012;40(21):11163-72. doi: 10.1093/nar/gks875. Epub Sep. 26, 2012.

Meyer et al., Breathing life into polycations: functionalization with pH-responsive endosomolytic peptides and polyethylene glycol enables siRNA delivery. J Am Chem Soc. Mar. 19, 2008;130(11):3272-3. doi: 10.1021/ja710344v. Epub Feb. 21, 2008.

Midoux et al., Chemical vectors for gene delivery: a current review on polymers, peptides and lipids containing histidine or imidazole as nucleic acids carriers. Br J Pharmacol. May 2009;157(2):166-78. doi: 10.1111/j.1476-5381.2009.00288.x.

Miller et al., A TALE nuclease architecture for efficient genome editing. Nat Biotechnol. Feb. 2011;29(2):143-8. doi:10.1038/nbt.1755. Epub Dec. 22, 2010.

Miller et al., An improved zinc-finger nuclease architecture for highly specific genome editing. Nat Biotechnol. Jul. 2007;25(7):778-85. Epub Jul. 1, 2007.

Minoche et al., Evaluation of genomic high-throughput sequencing data generated on Illumina HiSeq and genome analyzer systems. Genome Biol. Nov. 8, 2011;12(11):R112. doi: 10.1186/GB-2011-12-11-r112.

Minoretti et al., A W148R mutation in the human FOXD4 gene segregating with dilated cardiomyopathy, obsessive-compulsive disorder, and suicidality. Int J Mol Med. Mar. 2007;19(3):369-72.

Mojica et al., Intervening sequences of regularly spaced prokaryotic repeats derive from foreign genetic elements. J Mol Evol. Feb. 2005;60(2):174-82.

Mol et al., Crystal structure of human uracil-DNA glycosylase in complex with a protein inhibitor: protein mimicry of DNA. Cell. Sep. 8, 1995;82(5):701-8.

Moore et al., Improved somatic mutagenesis in zebrafish using transcription activator-like effector nucleases (TALENs). PloS One. 2012;7(5):e37877. Doi: 10.1371/journal.pone.0037877. Epub May 24, 2012.

Morbitzer et al., Assembly of custom TALE-type DNA binding domains by modular cloning. Nucleic Acids Res. Jul. 2011;39(13):5790-9. doi: 10.1093/nar/gkr151. Epub Mar. 18, 2011.

Morris et al., A peptide carrier for the delivery of biologically active proteins into mammalian cells. Nat Biotechnol. Dec. 2001;19(12):1173-6.

Moscou et al., A simple cipher governs DNA recognition by TAL effectors. Science. Dec. 11, 2009;326(5959):1501. doi: 10.1126/science.1178817.

Mullins et al., Transgenesis in nonmurine species. Hypertension. Oct. 1993;22(4):630-3.

Mussolino et al., A novel TALE nuclease scaffold enables high genome editing activity in combination with low toxicity. Nucleic Acids Res. Nov. 2011;39(21):9283-93. Doi: 10.1093/nar/gkr597. Epub Aug. 3, 2011.

Mussolino et al., TALE nucleases: tailored genome engineering made easy. Curr Opin Biotechnol. Oct. 2012;23(5):644-50. doi: 10.1016/j.copbio.2012.01.013. Epub Feb. 17, 2012.

Nahvi et al., Coenzyme B12 riboswitches are widespread genetic control elements in prokaryotes. Nucleic Acids Res. Jan. 2, 2004;32(1):143-50.

Narayanan et al., Clamping down on weak terminal base pairs: oligonucleotides with molecular caps as fidelity-enhancing elements at the 5'- and 3'-terminal residues. Nucleic Acids Res. May 20, 2004;32(9):2901-11. Print 2004.

Navaratnam et al., An overview of cytidine deaminases. Int J Hematol. Apr. 2006;83(3):195-200.

NCBI Reference Sequence: NM_002427.3. Wu et al., May 3, 2014. 5 pages.

Nishida et al., Targeted nucleotide editing using hybrid prokaryotic and vertebrate adaptive immune systems. Science. Sep. 16, 2016;353(6305):1248. pii: aaf8729. doi: 10.1126/science.aaf8729. Epub Aug. 4, 2016.

Nishimasu et al., Crystal structure of Cas9 in complex with guide RNA and target DNA. Cell. Feb. 27, 2014;156(5):935-49. doi: 10.1016/j.cell.2014.02.001. Epub Feb. 13, 2014.

Nomura et al., Synthetic mammalian riboswitches based on guanine aptazyme. Chem Commun (Camb). Jul. 21, 2012;48(57):7215-7. doi: 10.1039/c2cc33140c. Epub Jun. 13, 2012.

Noris et al., A phenylalanine-55 to serine amino-acid substitution in the human glycoprotein IX leucine-rich repeat is associated with Bernard-Soulier syndrome. Br J Haematol. May 1997;97(2):312-20.

O'Connell et al., Programmable RNA recognition and cleavage by CRISPR/Cas9. Nature. Dec. 11, 2014;516(7530):263-6. doi: 10.1038/nature13769. Epub Sep. 28, 2014.

Offord, Advances in Genome Editing. The Scientist, Apr. 20, 2016. http://www.the-scientist.com/?articles.view/articleNo/45903/title/Advances-in-Genome-Editing/.

(56) References Cited

OTHER PUBLICATIONS

Osborn et al., TALEN-based gene correction for epidermolysis bullosa. Mol Ther. Jun. 2013;21(6):1151-9. doi: 10.1038/mt.2013. 56. Epub Apr. 2, 2013.
Pan et al., Biological and biomedical applications of engineered nucleases. Mol Biotechnol. Sep. 2013;55(1):54-62. doi: 10.1007/s12033-012-9613-9.
Parker et al., Admixture mapping identifies a quantitative trait locus associated with FEV1/FVC in the COPDGene Study. Genet Epidemiol. Nov. 2014;38(7):652-9. doi: 10.1002/gepi.21847. Epub Aug. 11, 2014.
Partial Supplementary European Search Report for Application No. EP 12845790.0, mailed Mar. 18, 2015.
Pattanayak et al., Determining the specificities of TALENs, Cas9, and other genome-editing enzymes. Methods Enzymol. 2014;546:47-78. doi: 10.1016/B978-0-12-801185-0.00003-9.
Pattanayak et al., High-throughput profiling of off-target DNA cleavage reveals RNA-programmed Cas9 nuclease specificity. Nat Biotechnol. Sep. 2013;31(9):839-43. doi: 10.1038/nbt.2673. Epub Aug. 11, 2013.
Pattanayak et al., Revealing off-target cleavage specificities of zinc-finger nucleases by in vitro selection. Nat Methods. Aug. 7, 2011;8(9):765-70. doi: 10.1038/nmeth.1670.
Pavletich et al., Zinc finger-DNA recognition: crystal structure of a Zif268-DNA complex at 2.1 A. Science. May 10, 1991;252(5007):809-17.
Pearl, Structure and function in the uracil-DNA glycosylase superfamily. Mutat Res. Aug. 30, 2000;460(3-4):165-81.
Pennisi et al., The CRISPR craze. Science. Aug. 23, 2013;341(6148):833-6. doi: 10.1126/science.341.6148.833.
Pennisi et al., The tale of the TALEs. Science. Dec. 14, 2012;338(6113):1408-11. doi: 10.1126/science.338.6113.1408.
Perez et al., Establishment of HIV-1 resistance in CD4+ T cells by genome editing using zinc-finger nucleases. Nat Biotechnol. Jul. 2008;26(7):808-16. Doi: 10.1038/nbt1410. Epub Jun. 29, 2008.
Perez-Pinera et al., Advances in targeted genome editing. Curr Opin Chem Biol. Aug. 2012; 16(3-4):268-77. doi: 10.1016/j.cbpa.2012. 06.007. Epub Jul. 20, 2012.
Perez-Pinera et al., RNA-guided gene activation by CRISPR-Cas9-based transcription factors. Nat Methods. Oct. 2013;10(10):973-6. doi: 10.1038/nmeth.2600. Epub Jul. 2 2013.
Petek et al., Frequent endonuclease cleavage at off-target locations in vivo. Mol Ther. May 2010;18(5):983-6. Doi: 10.1038/mt.2010. 35. Epub Mar. 9, 2010.
Petolino et al., Editing Plant Genomes: a new era of crop improvement. Plant Biotechnol J. Feb. 2016;14(2):435-6. doi: 10.1111/pbi. 12542.
Phillips, The challenge of gene therapy and DNA delivery. J Pharm Pharmacol. Sep. 2001;53(9):1169-74.
Plasterk et al., DNA inversions in the chromosome of *Escherichia coli* and in bacteriophage Mu: relationship to other site-specific recombination systems. Proc Natl Acad Sci U S A. Sep. 1983;80(17):5355-8.
Pluciennik et al., PCNA function in the activation and strand direction of MutLα endonuclease in mismatch repair. Proc Natl Acad Sci U S A. Sep. 14, 2010;107(37):16066-71. doi: 10.1073/pnas.1010662107. Epub Aug. 16, 2010.
Poller et al., A leucine-to-proline substitution causes a defective alpha 1-antichymotrypsin allele associated with familial obstructive lung disease. Genomics. Sep. 1993;17(3):740-3.
Porteus, Design and testing of zinc finger nucleases for use in mammalian cells. Methods Mol Biol. 2008;435:47-61. doi: 10.1007/978-1-59745-232-8_4.
Pourcel et al., CRISPR elements in Yersinia pestis acquire new repeats by preferential uptake of bacteriophage DNA, and provide additional tools for evolutionary studies. Microbiology. Mar. 2005;151(Pt 3):653-63.
Prashant et al., CAS9 transcriptional activators for target specificity screening and paired nickases for cooperative genome engineering. Nature Biotechnology 2013;31(9):833-8.

Prorocic et al., Zinc-finger recombinase activities in vitro. Nucleic Acids Res. Nov. 2011;39(21):9316-28. doi: 10.1093/nar/gkr652. Epub Aug. 17, 2011.
Proudfoot et al., Zinc finger recombinases with adaptable DNA sequence specificity. PLoS One. Apr. 29, 2011;6(4):e19537. doi: 10.1371/journal.pone.0019537.
Prykhozhij et al., CRISPR multitargeter: a web tool to find common and unique CRISPR single guide RNA targets in a set of similar sequences. PLoS One. Mar. 5, 2015;10(3):e0119372. doi: 10.1371/journal.pone.0119372. eCollection 2015.
Putnam et al., Protein mimicry of DNA from crystal structures of the uracil-DNA glycosylase inhibitor protein and its complex with *Escherichia coli* uracil-DNA glycosylase. J Mol Biol. Mar. 26, 1999;287(2):331-46.
Qi et al., Engineering naturally occurring trans-acting non-coding RNAs to sense molecular signals. Nucleic Acids Res. Jul. 2012;40(12):5775-86. doi: 10.1093/nar/gks168. Epub Mar. 1, 2012.
Qi et al., Repurposing CRISPR as an RNA-guided platform for sequence-specific control of gene expression. Cell. Feb. 28, 2013;152(5):1173-83. doi: 10.1016/j.cell.2013.02.022.
Ramakrishna et al., Gene disruption by cell-penetrating peptide-mediated delivery of Cas9 protein and guide RNA. Genome Res. Jun. 2014;24(6):1020-7. doi: 10.1101/gr.171264.113. Epub Apr. 2, 2014.
Ramirez et al., Engineered zinc finger nickases induce homology-directed repair with reduced mutagenic effects. Nucleic Acids Res. Jul. 2012;40(12):5560-8. doi: 10.1093/nar/gks179. Epub Feb. 28, 2012.
Ramirez et al., Unexpected failure rates for modular assembly of engineered zinc fingers. Nat Methods. May 2008;5(5):374-5. Doi: 10.1038/nmeth0508-374.
Ran et al., Double nicking by RNA-guided CRISPR Cas9 for enhanced genome editing specificity. Cell. Sep. 12, 2013;154(6):1380-9. doi: 10.1016/j.cell.2013.08.021. Epub Aug. 29, 2013.
Ran et al., Genome engineering using the CRISPR-Cas9 system. Nat Protoc. Nov. 2013;8(11):2281-308. doi: 10.1038/nprot.2013. 143. Epub Oct. 24, 2013.
Ran et al., In vivo genome editing using *Staphylococcus aureus* Cas9. Nature. Apr. 9, 2015;520(7546): 186-91. doi: 10.1038/nature14299. Epub Apr. 1, 2015.
Rath et al., Fidelity of end joining in mammalian episomes and the impact of Metnase on joint processing. BMC Mol Biol. Mar. 22, 2014;15:6. doi: 10.1186/1471-2199-15-6.
Ravishankar et al., X-ray analysis of a complex of *Escherichia coli* uracil DNA glycosylase (EcUDG) with a proteinaceous inhibitor. The structure elucidation of a prokaryotic UDG. Nuclei Acids Res. 26 (21): 4880-4887 (1998).
Ray et al., Homologous recombination: ends as the means. Trends Plant Sci. Oct. 2002;7(10):435-40.
Rebuzzini et al., New mammalian cellular systems to study mutations introduced at the break site by non-homologous end-joining. DNA Repair (Amst). May 2, 2005;4(5):546-55.
Rees et al., Improving the DNA specificity and applicability of base editing through protein engineering and protein delivery. Nat Commun. Jun. 6, 2017;8:15790. doi: 10.1038/ncomms15790.
Reyon et al., FLASH assembly of TALENs for high-throughput genome editing. Nat Biotechnol. May 2012;30(5):460-5. doi: 10.1038/nbt.2170.
Richardson et al., Enhancing homology-directed genome editing by catalytically active and inactive CRISPR-Cas9 using asymmetric donor DNA. Nat Biotechnol. Mar. 2016;34(3): 339-44. doi: 10.1038/nbt.3481. Epub Jan. 20, 2016.
Richter et al., Function and regulation of clustered regularly interspaced short palindromic repeats (CRISPR) / CRISPR associated (Cas) systems. Viruses. Oct. 19, 2012;4(10):2291-311. doi: 10.3390/v4102291.
Rong et al., Homologous recombination in human embryonic stem cells using CRISPR/Cas9 nickase and a long DNA donor template. Protein Cell. Apr. 2014;5(4):258-60. doi: 10.1007/s13238-014-0032-5.

(56) References Cited

OTHER PUBLICATIONS

Rowland et al., Regulatory mutations in Sin recombinase support a structure-based model of the synaptosome. Mol Microbiol. Oct. 2009;74(2):282-98. doi: 10.1111/j.1365- 2958.2009.06756.x. Epub Jun. 8, 2009.
Sadelain et al., Safe harbours for the integration of new DNA in the human genome. Nat Rev Cancer. Dec. 1, 2011;12(1):51-8. doi: 10.1038/nrc3179.
Sage et al., Proliferation of functional hair cells in vivo in the absence of the retinoblastoma protein. Science. Feb. 18, 2005;307(5712):1114-8. Epub Jan. 13, 2005.
Samal et al., Cationic polymers and their therapeutic potential. Chem Soc Rev. Nov. 7, 2012;41(21):7147-94. doi: 10.1039/c2cs35094g. Epub Aug. 10, 2012.
Sander et al., CRISPR-Cas systems for editing, regulating and targeting genomes. Nat Biotechnol. Apr. 2014;32(4):347-55. doi: 10.1038/nbt.2842. Epub Mar. 2, 2014.
Sander et al., In silico abstraction of zinc finger nuclease cleavage profiles reveals an expanded landscape of off-target sites. Nucleic Acids Res. Oct. 2013;41(19):e181. doi: 10.1093/nar/gkt716. Epub Aug. 14, 2013.
Sander et al., Targeted gene disruption in somatic zebrafish cells using engineered TALENs. Nat Biotechnol. Aug. 5, 2011;29(8):697-8. doi: 10.1038/nbt.1934.
Sang, Prospects for transgenesis in the chick. Mech Dev. Sep. 2004;121(9):1179-86.
Sanjana et al., A transcription activator-like effector toolbox for genome engineering. Nat Protoc. Jan. 5, 2012;7(1):171-92. doi: 10.1038/nprot.2011.431.
Santiago et al., Targeted gene knockout in mammalian cells by using engineered zinc-finger nucleases. Proc Natl Acad Sci U S A. Apr. 15, 2008;105(15):5809-14. doi: 10.1073/pnas.0800940105. Epub Mar. 21, 2008.
Sapranauskas et al., The *Streptococcus thermophilus* CRISPR/Cas system provides immunity in *Escherichia coli*. Nucleic Acids Res. Nov. 2011;39(21):9275-82. doi: 10.1093/nar/gkr606. Epub Aug. 3, 2011.
Saraconi et al., The RNA editing enzyme APOBEC1 induces somatic mutations and a compatible mutational signature is present in esophageal adenocarcinomas. Genome Biol. Jul. 31, 2014;15(7):417. doi: 10.1186/s13059-014-0417-z.
Sashital et al., Mechanism of foreign DNA selection in a bacterial adaptive immune system. Mol Cell. Jun. 8, 2012;46(5):606-15. doi: 10.1016/j.molcel.2012.03.020. Epub Apr. 19, 2012.
Saudek et al., A preliminary trial of the programmable implantable medication system for insulin delivery. N Engl J Med. Aug. 31, 1989;321(9):574-9.
Schriefer et al., Low pressure DNA shearing: a method for random DNA sequence analysis. Nucleic Acids Res. Dec. 25, 1990;18(24):7455-6.
Schwank et al., Functional repair of CFTR by CRISPR/Cas9 in intestinal stem cell organoids of cystic fibrosis patients. Cell Stem Cell. Dec. 5, 2013;13(6):653-8. doi:10.1016/j.stem.2013.11.002.
Schwartz et al., Post-translational enzyme activation in an animal via optimized conditional protein splicing. Nat Chem Biol. Jan. 2007;3(1):50-4. Epub Nov. 26, 2006.
Schwarze et al., In vivo protein transduction: delivery of a biologically active protein into the mouse. Science. Sep. 3, 1999;285(5433):1569-72.
Sclimenti et al., Directed evolution of a recombinase for improved genomic integration at a native human sequence. Nucleic Acids Res. Dec. 15, 2001;29(24):5044-51.
Sefton et al., Implantable pumps. Crit Rev Biomed Eng. 1987;14(3):201-40.
Segal et al., Toward controlling gene expression at will: selection and design of zinc finger domains recognizing each of the 5'-GNN-3' DNA target sequences. Proc Natl Acad Sci U S A. Mar. 16, 1999;96(6):2758-63.
Sells et al., Delivery of protein into cells using polycationic liposomes. Biotechniques. Jul. 1995;19(1):72-6, 78.
Semenova et al., Interference by clustered regularly interspaced short palindromic repeat (CRISPR) RNA is governed by a seed sequence. Proc Natl Acad Sci U S A. Jun. 21, 2011;108(25):10098-103. doi: 10.1073/pnas.1104144108. Epub Jun. 6, 2011.
Semple et al., Rational design of cationic lipids for siRNA delivery. Nat Biotechnol. Feb. 2010;28(2):172-6. doi: 10.1038/nbt.1602. Epub Jan. 17, 2010.
Seripa et al., The missing ApoE allele. Ann Hum Genet. Jul. 2007;71(Pt 4):496-500. Epub Jan. 22, 2007.
Shah et al., Inteins: nature's gift to protein chemists. Chem Sci. 2014;5(1):446-461.
Shah et al., Kinetic control of one-pot trans-splicing reactions by using a wild-type and designed split intein. Angew Chem Int Ed Engl. Jul. 11, 2011;50(29):6511-5. doi: 10.1002/anie.201102909. Epub Jun. 8, 2011.
Shah et al., Target-specific variants of Flp recombinase mediate genome engineering reactions in mammalian cells. FEBS J. Sep. 2015;282(17):3323-33. doi: 10.1111/febs.13345. Epub Jul. 1, 2015.
Shalem et al., Genome-scale CRISPR-Cas9 knockout screening in human cells. Science. Jan. 3, 2014;343(6166):84-7. doi: 10.1126/science.1247005. Epub Dec. 12, 2013.
Sharbeen et al., Ectopic restriction of DNA repair reveals that UNG2 excises AID-induced uracils predominantly or exclusively during G1 phase. J Exp Med. May 7, 2012;209(5):965-74. doi: 10.1084/jem.20112379. Epub Apr. 23, 2012.
Shcherbakova et al., Near-infrared fluorescent proteins for multicolor in vivo imaging. Nat Methods. Aug. 2013;10(8):751-4. doi: 10.1038/nmeth.2521. Epub Jun. 16, 2013.
Shee et al., Engineered proteins detect spontaneous DNA breakage in human and bacterial cells. Elife. Oct. 29, 2013;2:e01222. doi: 10.7554/eLife.01222.
Sheridan, First CRISPR-Cas patent opens race to stake out intellectual property. Nat Biotechnol. 2014;32(7):599-601.
Sheridan, Gene therapy finds its niche. Nat Biotechnol. Feb. 2011;29(2):121-8. doi: 10.1038/nbt.1769.
Shimantani et al., Targeted base editing in rice and tomato using a CRISPR-Cas9 cytidine deaminase fusion. Nat Biotechnol. May 2017;35(5):441-443. doi: 10.1038/nbt.3833. Epub Mar. 27, 2017.
Shimojima et al., Spinocerebellar ataxias type 27 derived from a disruption of the fibroblast growth factor 14 gene with mimicking phenotype of paroxysmal non-kinesigenic dyskinesia. Brain Dev. Mar. 2012;34(3):230-3. doi: 10.1016/j.braindev.2011.04.014. Epub May 19, 2011.
Shmakov et al., Discovery and Functional Characterization of Diverse Class 2 CRISPR Cas Systems. Molecular Cell Nov. 2015;60(3):385-97.
Siebert et al., An improved PCR method for walking in uncloned genomic DNA. Nucleic Acids Res. Mar. 25, 1995;23(6):1087-8.
Simonelli et al., Base excision repair intermediates are mutagenic in mammalian cells. Nucleic Acids Res. Aug. 2, 2005;33(14):4404-11. Print 2005.
Sirk et al., Expanding the zinc-finger recombinase repertoire: directed evolution and mutational analysis of serine recombinase specificity determinants. Nucleic Acids Res. Apr. 2014;42(7):4755-66. doi: 10.1093/nar/gkt1389. Epub Jan. 21, 2014.
Sjoblom et al., The consensus coding sequences of human breast and colorectal cancers. Science. Oct. 13, 2006;314(5797):268-74. Epub Sep. 7, 2006.
Slaymaker et al., Rationally engineered Cas9 nucleases with improved specificity. Science. Jan. 1, 2016;351(6268):84-8. doi: 10.1126/science.aad5227. Epub Dec. 1, 2015.
Smith et al., Expression of a dominant negative retinoic acid receptor γ in Xenopus embryos leads to partial resistance to retinoic acid. Roux Arch Dev Biol. Mar. 1994;203(5):254-265. doi: 10.1007/BF00360521.
Stenglein et al., APOBEC3 proteins mediate the clearance of foreign DNA from human cells. Nat Struct Mol Biol. Feb. 2010;17(2):222-9. doi: 10.1038/nsmb.1744. Epub Jan. 10, 2010.
Stephens et al., The landscape of cancer genes and mutational processes in breast cancer. Nature Jun. 2012;486:400-404. doi:10.1038/nature11017.

(56) References Cited

OTHER PUBLICATIONS

Sternberg et al., DNA interrogation by the CRISPR RNA-guided endonuclease Cas9. Nature.Mar. 6, 2014;507(7490):62-7. doi: 10.1038/nature13011. Epub Jan. 29, 2014.
Stevens et al., Design of a Split Intein with Exceptional Protein-Splicing Activity. J Am Chem Soc. Feb. 24, 2016;138(7):2162-5. doi: 10.1021/jacs.5b13528. Epub Feb. 8, 2016.
Sun et al., Optimized TAL effector nucleases (TALENs) for use in treatment of sickle cell disease. Mol Biosyst. Apr. 2012;8(4):1255-63. doi: 10.1039/c2mb05461b. Epub Feb. 3, 2012.
Supplementary European Search Report for Application No. EP 12845790.0, mailed Oct. 12, 2015.
Swarts et al., Argonaute of the archaeon *Pyrococcus furiosus* is a DNA-guided nuclease that targets cognate DNA. Nucleic Acids Res. May 26, 2015;43(10):5120-9. doi: 10.1093/nar/gkv415. Epub Apr. 29, 2015.
Swarts et al., DNA-guided DNA interference by a prokaryotic Argonaute. Nature. Mar. 13, 2014;507(7491):258-61. doi: 10.1038/nature12971. Epub Feb. 16, 2014.
Swarts et al., The evolutionary journey of Argonaute proteins. Nat Struct Mol Biol. Sep. 2014;21(9):743-53. doi: 10.1038/nsmb.2879.
Szczepek et al., Structure-based redesign of the dimerization interface reduces the toxicity of zinc-finger nucleases. Nat Biotechnol. Jul. 2007;25(7):786-93. Epub Jul. 1, 2007.
Tagalakis et al., Lack of RNA-DNA oligonucleotide (chimeraplast) mutagenic activity in mouse embryos. Mol Reprod Dev. Jun. 2005;71(2):140-4.
Tang et al., Aptazyme-embedded guide RNAs enable ligand-responsive genome editing and transcriptional activation. Nat Commun. Jun. 28, 2017;8:15939. doi: 10.1038/ncomms15939.
Tebas et al., Gene editing of CCR5 in autologous CD4 T cells of persons infected with HIV. N Engl J Med. Mar. 6, 2014;370(10):901-10. doi: 10.1056/NEJMoa1300662.
Tessarollo et al., Targeted mutation in the neurotrophin-3 gene results in loss of muscle sensory neurons. Proc Natl Acad Sci U S A. Dec. 6, 1994;91(25):11844-8.
Tesson et al., Knockout rats generated by embryo microinjection of TALENs. Nat Biotechnol. Aug. 5, 2011;29(8):695-6. doi: 10.1038/nbt.1940.
Thompson et al., Cellular uptake mechanisms and endosomal trafficking of supercharged proteins. Chem Biol. Jul. 27, 2012;19(7):831-43. doi: 10.1016/j.chembiol.2012.06.014.
Thompson et al., Engineering and identifying supercharged proteins for macromolecule delivery into mammalian cells. Methods Enzymol. 2012;503:293-319. doi: 10.1016/B978-0-12-396962-0.00012-4.
Thorpe et al., Functional correction of episomal mutations with short DNA fragments and RNA-DNA oligonucleotides. J Gene Med. Mar.-Apr. 2002;4(2):195-204.
Thyagarajan et al., Mammalian genomes contain active recombinase recognition sites. Gene. Feb. 22, 2000;244(1-2):47-54.
Thyagarajan et al., Site-specific genomic integration in mammalian cells mediated by phage phiC31 integrase. Mol Cell Biol. Jun. 2001;21(12):3926-34.
Tirumalai et al., Recognition of core-type DNA sites by lambda integrase. J Mol Biol. Jun. 12, 1998;279(3):513-27.
Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 2015. With Supplementary Data.
Tsai et al., Dimeric CRISPR RNA-guided FokI nucleases for highly specific genome editing. Nat Biotechnol. Jun. 2014;32(6):569-76. doi: 10.1038/nbt.2908. Epub Apr. 25, 2014.
Tsai et al., GUIDE-seq enables genome-wide profiling of off-target cleavage by CRISPR-Cas nucleases. Nat Biotechnol. Feb. 2015;33(2):187-97. doi: 10.1038/nbt.3117. Epub Dec. 16, 2014.
Turan et al., Recombinase-mediated cassette exchange (RMCE)—a rapidly-expanding toolbox for targeted genomic modifications. Gene. Feb. 15, 2013;515(1):1-27. doi: 10.1016/j.gene.2012.11.016. Epub Nov. 29, 2012.

Turan et al., Recombinase-mediated cassette exchange (RMCE): traditional concepts and current challenges. J Mol Biol. Mar. 25, 2011;407(2):193-221. doi: 10.1016/j.jmb.2011.01.004. Epub Jan. 15, 2011.
Turan et al., Site-specific recombinases: from tag-and-target-to tag-and-exchange-based genomic modifications. FASEB J. Dec. 2011;25(12):4088-107. doi: 10.1096/fj.11-186940. Epub Sep. 2, 2011. Review.
UniProt Submission; UniProt, Accession No. P01011. Last modified Jun. 11, 2014, version 2. 15 pages.
UniProt Submission; UniProt, Accession No. P01011. Last modified Sep. 18, 2013, version 2. 15 pages.
UniProt Submission; UniProt, Accession No. P04264. Last modified Jun. 11, 2014, version 6. 15 pages.
UniProt Submission; UniProt, Accession No. P04275. Last modified Jul. 9, 2014, version 107. 29 pages.
Urnov et al., Genome editing with engineered zinc finger nucleases. Nat Rev Genet. Sep. 2010;11(9):636-46. doi: 10.1038/nrg2842.
Urnov et al., Highly efficient endogenous human gene correction using designed zinc-finger nucleases. Nature. Jun. 2, 2005;435(7042):646-51. Epub Apr. 3, 2005.
Vagner et al., Efficiency of homologous DNA recombination varies along the Bacillus subtilis chromosome. J Bacteriol. Sep. 1988;170(9):3978-82.
Van Duyne et al., Teaching Cre to follow directions. Proc Natl Acad Sci U S A. Jan. 6, 2009;106(1):4-5. doi: 10.1073/pnas.0811624106. Epub Dec. 31, 2008.
Van Swieten et al., A mutation in the fibroblast growth factor 14 gene is associated with autosomal dominant cerebellar ataxia [corrected]. Am J Hum Genet. Jan. 2003;72(1):191-9. Epub Dec. 13, 2002.
Vanamee et al., FokI requires two specific DNA sites for cleavage. J Mol Biol. May 25, 2001;309(1):69-78.
Vitreschak et al., Regulation of the vitamin B12 metabolism and transport in bacteria by a conserved RNA structural element. RNA. Sep. 2003;9(9):1084-97.
Wacey et al., Disentangling the perturbational effects of amino acid substitutions in the DNA-binding domain of p53. Hum Genet. Jan. 1999;104(1):15-22.
Wadia et al., Modulation of cellular function by TAT mediated transduction of full length proteins. Curr Protein Pept Sci. Apr. 2003;4(2):97-104.
Wadia et al., Transducible TAT-HA fusogenic peptide enhances escape of TAT-fusion proteins after lipid raft macropinocytosis. Nat Med. Mar. 2004;10(3):310-5. Epub Feb. 8, 2004.
Wah et al., Structure of FokI has implications for DNA cleavage. Proc Natl Acad Sci U S A. Sep. 1, 1998;95(18):10564-9.
Wang et al., CRISPR-Cas9 Targeting of PCSK9 in Human Hepatocytes In Vivo-Brief Report. Arterioscler Thromb Vasc Biol. May 2016;36(5):783-6. doi: 10.1161/ATVBAHA.116.307227. Epub Mar. 3, 2016.
Wang et al., Efficient delivery of genome-editing proteins using bioreducible lipid nanoparticles. Proc Natl Acad Sci U S A. Feb. 29, 2016. pii: 201520244. [Epub ahead of print].
Wang et al., Genetic screens in human cells using the CRISPR-Cas9 system. Science. Jan. 3, 2014;343(6166):80-4. doi: 10.1126/science.1246981. Epub Dec. 12, 2013.
Wang et al., Nucleation, propagation and cleavage of target RNAs in Ago silencing complexes. Nature. Oct. 8, 2009;461(7265):754-61. doi: 10.1038/nature08434.
Wang et al., One-step generation of mice carrying mutations in multiple genes by CRISPR/Cas-mediated genome engineering. Cell. May 9, 2013;153(4):910-8. doi: 10.1016/j.cell.2013.04.025. Epub May 2, 2013.
Wang et al., Recombinase technology: applications and possibilities. Plant Cell Rep. Mar. 2011;30(3):267-85. doi: 10.1007/s00299-010-0938-1. Epub Oct. 24, 2010.
Wang et al., Riboswitches that sense S-adenosylhomocysteine and activate genes involved in coenzyme recycling. Mol Cell. Mar. 28, 2008;29(6):691-702. doi: 10.1016/j.molcel.2008.01.012.

(56) References Cited

OTHER PUBLICATIONS

Wang et al., Targeted gene addition to a predetermined site in the human genome using a ZFN-based nicking enzyme. Genome Res. Jul. 2012;22(7):1316-26. doi: 10.1101/gr.122879.111. Epub Mar. 20, 2012.
Wang et al., Uracil-DNA glycosylase inhibitor gene of bacteriophage PBS2 encodes a binding protein specific for uracil-DNA glycosylase. J Biol Chem. Jan. 15, 1989;264(2):1163-71.
Warren et al., A chimeric Cre recombinase with regulated directionality. Proc Natl Acad Sci USA. Nov. 25, 2008;105(47):18278-83. doi: 10.1073/pnas.0809949105. Epub Nov. 14, 2008.
Warren et al., Mutations in the amino-terminal domain of lambda-integrase have differential effects on integrative and excisive recombination. Mol Microbiol. Feb. 2005;55(4):1104-12.
Weber et al., Assembly of designer TAL effectors by Golden Gate cloning. PLoS One. 2011;6(5):e19722. doi:10.1371/journal.pone.0019722. Epub May 19, 2011.
Weinberger et al., Disease-causing mutations C277R and C277Y modify gating of human CIC-1 chloride channels in myotonia congenita. J Physiol. Aug. 1, 2012;590(Pt 15):3449-64. doi: 0.1113/jphysiol.2012.232785. Epub May 28, 2012.
Wiedenheft et al., RNA-guided genetic silencing systems in bacteria and archaea. Nature. Feb. 15, 2012;482(7385):331-8. doi: 10.1038/nature10886. Review.
Wijnker et al., Managing meiotic recombination in plant breeding. Trends Plant Sci. Dec. 2008;13(12):640-6. doi: 10.1016/j.tplants.2008.09.004. Epub Oct. 22, 2008.
Wolf et al., tadA, an essential tRNA-specific adenosine deaminase from *Escherichia coli*. J. Jul. 15, 2002;21(14):3841-51.
Wolfe et al., Analysis of zinc fingers optimized via phage display: evaluating the utility of a recognition code. J Mol Biol. Feb. 5, 1999;285(5):1917-34.
Wood et al., Targeted genome editing across species using ZFNs and TALENs. Science. Jul. 15, 2011;333(6040):307. doi: 10.1126/science.1207773. Epub Jun. 23, 2011.
Wu et al., Correction of a genetic disease in mouse via use of CRISPR-Cas9. Cell Stem Cell. Dec. 5, 2013;13(6):659-62. doi: 10.1016/j.stem.2013.10.016.
Wu et al., Genome-wide binding of the CRISPR endonuclease Cas9 in mammalian cells. Nat Biotechnol. Jul. 2014;32(7):670-6. doi: 10.1038/nbt.2889. Epub Apr. 20, 2014.
Xu et al., Sequence determinants of improved CRISPR sgRNA design. Genome Res. Aug. 2015;25(8):1147-57. doi: 10.1101/gr.191452.115. Epub Jun. 10, 2015.
Yamano et al., Crystal Structure of Cpf1 in Complex with Guide RNA and Target DNA. Cell May 2016;165(4)949-62.
Yang et al., Engineering and optimising deaminase fusions for genome editing. Nat Commun. Nov. 2, 2016;7:13330. doi: 10.1038/ncomms13330.
Yang et al., Genome editing with targeted deaminases. BioRxiv. Preprint. First posted online Jul. 28, 2016.
Yang et al., PAM-dependent Target DNA Recognition and Cleavage by C2C1 CRISPR-Cas endonuclease. Cell Dec. 2016;167(7):1814-28.
Yanover et al., Extensive protein and DNA backbone sampling improves structure-based specificity prediction for C2H2 zinc fingers. Nucleic Acids Res. Jun. 2011;39(11):4564-76. doi: 10.1093/nar/gkr048. Epub Feb. 22, 2011.
Yazaki et al., Hereditary systemic amyloidosis associated with a new apolipoprotein AII stop codon mutation Stop78Arg. Kidney Int. Jul. 2003;64(1):11-6.
Yin et al., Genome editing with Cas9 in adult mice corrects a disease mutation and phenotype. Nat Biotechnol. Jun. 2014;32(6):551-3. doi: 10.1038/nbt.2884. Epub Mar. 30, 2014.
Yuan et al., Tetrameric structure of a serine integrase catalytic domain. Structure. Aug. 6, 2008;16(8):1275-86. doi: 10.1016/j.str.2008.04.018.
Yuen et al., Control of transcription factor activity and osteoblast differentiation in mammalian cells using an evolved small-molecule-dependent intein. J Am Chem Soc. Jul. 12, 2006;128(27):8939-46.
Zelphati et al., Intracellular delivery of proteins with a new lipid-mediated delivery system. J Biol Chem. Sep. 14, 2001;276(37):35103-10. Epub Jul. 10, 2001.
Zetsche et al., A split-Cas9 architecture for inducible genome editing and transcription modulation. Nat Biotechnol. Feb. 2015;33(2):139-42. doi: 10.1038/nbt.3149.
Zetsche et al., Cpf1 is a single RNA-guided endonuclease of a class 2 CRISPR-Cas system. Cell. Oct. 22, 2015;163(3):759-71. doi: 10.1016/j.cell.2015.09.038. Epub Sep. 25, 2015.
Zhang et al., Comparison of non-canonical PAMs for CRISPR/Cas9-mediated DNA cleavage in human cells. Sci Rep. Jun. 2014;4:5405.
Zhang et al., Conditional gene manipulation: Cre-ating a new biological era. J Zhejiang Univ Sci B. Jul. 2012;13(7):511-24. doi: 10.1631/jzus.B1200042. Review.
Zhang et al., CRISPR/Cas9 for genome editing: progress, implications and challenges. Hum Mol Genet. Sep. 15, 2014;23(R1):R40-6. doi: 10.1093/hmg/ddu125. Epub Mar. 20, 2014.
Zhang et al., Efficient construction of sequence-specific TAL effectors for modulating mammalian transcription. Nat Biotechnol. Feb. 2011;29(2):149-53. doi: 10.1038/nbt. 1775. Epub Jan. 19, 2011.
Zhang et al., Programmable base editing of zebrafish genome using a modified CRISPR-Cas9 system. Nat Commun. Jul. 25, 2017;8(1):118. doi: 10.1038/s41467-017-00175-6.
Zhang et al., Stabilized plasmid-lipid particles for regional gene therapy: formulation and transfection properties. Gene Ther. Aug. 1999;6(8):1438-47.
Zheng et al., DNA editing in DNA/RNA hybrids by adenosine deaminases that act on RNA. Nucleic Acids Res. Apr. 7, 2017;45(6):3369-3377. doi: 10.1093/nar/gkx050.
Zong et al., Precise base editing in rice, wheat and maize with a Cas9-cytidine deaminase fusion. Nat Biotechnol. May 2017;35(5):438-440. doi: 10.1038/nbt.3811. Epub Feb. 27, 2017.
Zorko et al., Cell-penetrating peptides: mechanism and kinetics of cargo delivery. Adv Drug Deliv Rev. Feb. 28, 2005;57(4):529-45. Epub Jan. 22, 2005.
Zou et al., Gene targeting of a disease-related gene in human induced pluripotent stem and embryonic stem cells. Cell Stem Cell. Jul. 2, 2009;5(1):97-110. doi: 10.1016/j.stem.2009.05.023. Epub Jun. 18, 2009.
Zuris et al., Cationic lipid-mediated delivery of proteins enables efficient protein-based genome editing in vitro and in vivo. Nat Biotechnol. 2015;33:73-80.
U.S. Appl. No. 61/838,178, filed Jun. 21, 2013, Joung et al.
U.S. Appl. No. 62/357,332, filed Jun. 30, 2016, Liu et al.
U.S. Appl. No. 62/288,661, filed Jan. 29, 2016, Muir et al.
[No Author Listed] Score result for SEQ 355 to WO2017032580. Muir et al. 2016.
Aihara et al., A conformational switch controls the DNA cleavage activity of lambda integrase. Mol Cell. Jul. 2003;12(1):187-98.
Ames et al., A eubacterial riboswitch class that senses the coenzyme tetrahydrofolate. Chem Biol. Jul. 30, 2010;17(7):681-5. doi: 10.1016/j.chembiol.2010.05.020.
Batey et al., Structure of a natural guanine-responsive riboswitch complexed with the metabolite hypoxanthine. Nature. Nov. 18, 2004;432(7015):411-5.
Bershtein et al., Advances in laboratory evolution of enzymes. Curr Opin; Chem Biol. Apr. 2008;12(2):151-8. doi: 10.1016/j.cbpa.2008.01.027. Epub Mar. 7, 2008. Review.
Bogdanove et al., TAL effectors: customizable proteins for DNA targeting. Science. Sep. 30, 2011;333(6051):1843-6. doi: 10.1126/science.1204094.
Bohlke et al., Sense codon emancipation for proteome-wide incorporation of noncanonical amino acids: rare isoleucine codon AUA as a target for genetic code expansion. FEMS Microbiol Lett. Feb. 2014;351(2):133-44. doi: 10.1111/1574-6968.12371. Epub Jan. 27, 2014.
Budisa et al., Residue-specific bioincorporation of non-natural, biologically active amino acids into proteins as possible drug carriers: structure and stability of the per-thiaproline mutant of annexin V. Proc Natl Acad Sci U S A. Jan. 20, 1998;95(2):455-9.

(56) References Cited

OTHER PUBLICATIONS

Buskirk et al., Directed evolution of ligand dependence: small-molecule-activated protein splicing. Proc Natl Acad Sci U S A. Jul. 20, 2004;101(29):10505-10. Epub Jul. 9, 2004.
Böck et al., Selenocysteine: the 21st amino acid. Mol Microbiol. Mar. 1991;5(3):515-20.
Carroll, Genome engineering with zinc-finger nucleases. Genetics. Aug. 2011;188(4):773-82. doi: 10.1534/genetics.111.131433. Review.
Chavez et al., Precise Cas9 targeting enables genomic mutation prevention. . bioRxiv. Jun. 14, 2016. doi:https://doi.org/10.1101/058974. [Preprint].
Chen et al., Fusion protein linkers: property, design and functionality. Adv Drug Deliv Rev. Oct. 2013;65(10):1357-69. doi:10.1016/j.addr.2012.09.039. Epub Sep. 29, 2012.
Cobb et al., Directed evolution as a powerful synthetic biology tool. Methods. Mar. 15, 2013;60(1):81-90. doi: 10.1016/j.ymeth.2012.03.009. Epub Mar. 23, 2012.
D'Adda di Fagagna et al., The Gam protein of bacteriophage Mu is an orthologue of eukaryotic Ku. EMBO Rep. Jan. 2003;4(1):47-52.
Dixon et al., Reengineering orthogonally selective riboswitches. Proc Natl Acad Sci U S A. Feb. 16, 2010;107(7):2830-5. doi: 10.1073/pnas.0911209107. Epub Jan. 26, 2010.
Dumas et al., Designing logical codon reassignment - Expanding the chemistry in biology. Chem Sci. Jan. 1, 2015;6(1):50-69. doi: 10.1039/c4sc01534g. Epub Jul. 14, 2014. Review.
Edwards et al., An *Escherichia coli* tyrosine transfer RNA is a leucine-specific transfer RNA in the yeast *Saccharomyces cerevisiae*. Proc Natl Acad Sci U S A. Feb. 15, 1991;88(4):1153-6.
Edwards et al., Crystal structures of the thi-box riboswitch bound to thiamine pyrophosphate analogs reveal adaptive RNA-small molecule recognition. Structure. Sep. 2006;14(9):1459-68.
Endo et al., Toward establishing an efficient and versatile gene targeting system in higher plants. Biocatalysis and Agricultural Biotechnology 2014;3,(1):2-6.
Esvelt et al., A system for the continuous directed evolution of biomolecules. Nature. Apr. 28, 2011;472(7344):499-503. doi: 10.1038/nature09929. Epub Apr. 10, 2011.
Fagerlund et al., The Cpf1 CRISPR-Cas protein expands genome-editing tools. Genome Biology Nov. 17, 2015;16:251. https://doi.org/10.1186/s13059-015-0824-9.
Fang et al., Synthetic Studies Towards Halichondrins: Synthesis of the Left Halves of Norhalichondrins and Homohalichondrins. Tetrahedron Letters 1992;33(12):1557-1560.
Farhood et al., Codelivery to mammalian cells of a transcriptional factor with cis-acting element using cationic liposomes. Anal Biochem. Feb. 10, 1995;225(1):89-93.
Ferry et al., Rational design of inducible CRISPR guide RNAs for de novo assembly of transcriptional programs. Nat Commun. Mar. 3, 2017;8:14633. doi: 10.1038/ncomms14633.
Fischer et al., Cryptic epitopes induce high-titer humoral immune response in patients with cancer. J Immunol. Sep. 1, 2010;185(5):3095-102. doi: 10.4049/jimmunol.0902166. Epub Jul. 26, 2010.
Hamano-Takaku et al., A mutant *Escherichia coli* tyrosyl-tRNA synthetase utilizes the unnatural amino acid azatyrosine more efficiently than tyrosine. J Biol Chem. Dec. 22, 2000;275(51):40324-8.
Hayes et al., Stop codons preceded by rare arginine codons are efficient determinants of SsrA tagging in *Escherichia coli*. Proc Natl Acad Sci U S A. Mar. 19, 2002;99(6):3440-5. Epub Mar. 12, 2002.
Hickford et al., Antitumour polyether macrolides: four new halichondrins from the New Zealand deep-water marine sponge *Lissodendoryx* sp. Bioorg Med Chem. Mar. 15, 2009;17(6):2199-203. doi: 10.1016/j.bmc.2008.10.093. Epub Nov. 19, 2008.
Hida et al., Directed evolution for drug and nucleic acid; delivery. Adv Drug Deliv Rev. Dec. 22, 2007;59(15):1562-78. Epub Aug. 28, 2007.; Review.
Hirano et al., Structural Basis for the Altered PAM Specificities of Engineered CRISPR-Cas9. Mol Cell. Mar. 17, 2016;61(6):886-94. doi: 10.1016/j.molcel.2016.02.018.
Husimi, Selection and evolution of bacteriophages in cellstat. Adv Biophys. ; 1989;25:1-43. Review.
Kakiyama et al., A peptide release system using a photo-cleavable linker in a cell array format for cell-toxicity analysis. Polymer J. Feb. 27, 2013;45:535-9.
Kang et al., Structural Insights into riboswitch control of the biosynthesis of queuosine, a modified nucleotide found in the anticodon of tRNA. Mol Cell. Mar. 27, 2009;33(6):784-90. doi: 10.1016/j.molcel.2009.02.019. Epub Mar. 12, 2009.
Kiga et al., An engineered *Escherichia coli* tyrosyl-tRNA synthetase for site-specific incorporation of an unnatural amino acid into proteins in eukaryotic translation and its application in a wheat germ cell-free system. Proc Natl Acad Sci U S A. Jul. 23, 2002;99(15):9715-20. Epub Jul. 3, 2002.
Klein et al., Cocrystal structure of a class I preQ1 riboswitch reveals a pseudoknot recognizing an essential hypermodified nucleobase. Nat Struct Mol Biol. Mar. 2009;16(3):343-4. doi: 10.1038/nsmb.1563.Epub Feb. 22, 2009.
Kowal et al., Exploiting unassigned codons in Micrococcus luteus for tRNA-based amino acid mutagenesis. Nucleic Acids Res. Nov. 15, 1997;25(22):4685-9.
Kury et al., De Novo Disruption of the Proteasome Regulatory Subunit PSMD12 Causes a Syndromic Neurodevelopmental Disorder. Am J Hum Genet. Feb. 2, 2017;100(2):352-363. doi: 10.1016/j.ajhg.2017.01.003. Epub Jan. 26, 2017.
Kwon et al., Chemical basis of glycine riboswitch cooperativity. RNA. Jan. 2008;14(1):25-34. Epub Nov. 27, 2007.
Köhrer et al., A possible approach to site-specific insertion of two different unnatural amino acids into proteins in mammalian cells via nonsense suppression. Chem Biol. Nov. 2003;10(11):1095-102.
Köhrer et al., Complete set of orthogonal 21st aminoacyl-tRNA synthetase-amber, ochre and opal suppressor tRNA pairs: concomitant suppression of three different termination codons in an mRNA in mammalian cells. Nucleic Acids Res. Dec. 1, 2004;32(21):6200-11. Print 2004.
Lee et al., An allosteric self-splicing ribozyme triggered by a bacterial second messenger. Science. Aug. 13, 2010;329(5993):845-8. doi: 10.1126/science.1190713.
Lee et al., Ribozyme Mediated gRNA Generation for In Vitro and In Vivo CRISPR/Cas9 Mutagenesis. PLoS One. Nov. 10, 2016;11(11):e0166020. doi: 10.1371/journal.pone.0166020. eCollection 2016.
Lewis et al., Building the Class 2 CRISPR-Cas Arsenal. Mol Cell 2017;65(3);377-379.
Link et al., Engineering ligand-responsive gene-control elements: lessons learned from natural riboswitches. Gene Ther. Oct. 2009;16(10):1189-201. doi: 10.1038/gt.2009.81. Epub Jul. 9, 2009. Review.
Liu et al., Engineering a tRNA and aminoacyl-tRNA synthetase for the site-specific incorporation of unnatural amino acids into proteins in vivo. Proc Natl Acad Sci U S A. Sep. 16, 1997;94(19):10092-7.
Liu et al., Fast Colorimetric Sensing of Adenosine and Cocaine Based on a General Sensor Design Involving Aptamers and Nanoparticles. Angew Chem. Dec. 16, 2006;45(1):90-4. DOI: 10.1002/anie.200502589.
Meyer et al., Confirmation of a second natural preQ1 aptamer class in Streptococcaceae bacteria. RNA. Apr. 2008;14(4):685-95. doi: 10.1261/rna.937308. Epub Feb. 27, 2008.
Monahan et al., Site-specific incorporation of unnatural amino acids into receptors expressed in Mammalian cells. Chem Biol. Jun. 2003;10(6):573-80.
Montange et al., Structure of the S-adenosylmethionine riboswitch regulatory mRNA element. Nature. Jun. 29, 2006;441(7097):1172-5.
Mootz et al., Conditional protein splicing: a new tool to control protein structure and function in vitro and in vivo. J Am Chem Soc. Sep. 3, 2003;125(35):10561-9.
Mootz et al., Protein splicing triggered by a small molecule. J Am Chem Soc. Aug. 7, 2002;124(31):9044-5.
Neel et al., Riboswitches: Classification, function and in silico approach, International Journal of Pharma Sciences and Research. 2010;1(9):409-420.

(56) References Cited

OTHER PUBLICATIONS

Nelson et al., Filamentous phage DNA cloning vectors: a noninfective mutant with a nonpolar deletion in gene III. Virology. 1981; 108(2): 338-50.
Ni et al., Nucleic acid aptamers: clinical applications and promising new horizons. Curr Med Chem. 2011;18(27):4206-14. Review.
Oakes et al., Protein engineering of Cas9 for enhanced function. Methods Enzymol. 2014;546:491-511.
Peck et al., Directed evolution of a small-molecule-triggered intein with improved splicing properties in mammalian cells. Chem Biol. May 27, 2011;18(5):619-30. doi: 10.1016/j.chembiol.2011.02.014.
Pelletier, CRISPR-Cas systems for the study of the immune function. Nov. 15, 2016. https://doi.org/10.1002/9780470015902.a0026896.
Plosky et al., CRISPR-Mediated Base Editing without DNA Double-Strand Breaks. Mol Cell. May 19, 2016;62(4):477-8. doi: 10.1016/j.molcel.2016.05.006.
Rakonjac et al., Roles of PIII in filamentous phage assembly. J Mol Biol. 1998; 282(1)25-41.
Riechmann et al.,. The C-terminal domain of TolA is the coreceptor for filamentous phage infection of *E. coli*. Cell. 1997; 90(2):351-60. PMID:9244308.
Rudolph et al., Synthetic riboswitches for the conditional control of gene expression in Streptomyces coelicolor. Microbiology. Jul. 2013;159(Pt 7):1416-22. doi: 10.1099/mic.0.067322-0. Epub May 15, 2013.
Saleh-Gohari et al., Conservative homologous recombination preferentially repairs DNA double-strand breaks in the S phase of the cell cycle in human cells. Nucleic Acids Res. Jul. 13, 2004;32(12):3683-8. Print 2004.
Serganov et al., Coenzyme recognition and gene regulation by a flavin mononucleotide riboswitch. Nature. Mar. 12, 2009;458(7235):233-7. doi: 10.1038/nature07642. Epub Jan. 25, 2009.
Serganov et al., Structural basis for discriminative regulation of gene expression by adenine- and guanine-sensing mRNAs. Chem Biol. Dec. 2004;11(12):1729-41.
Serganov et al., Structural basis for gene regulation by a thiamine pyrophosphate-sensing riboswitch. Nature. Jun. 29, 2006;441(7097):1167-71. Epub May 21, 2006.
Sharma et al., Efficient introduction of aryl bromide functionality into proteins in vivo. FEBS Lett. Feb. 4, 2000;467(1):37-40.
Skretas et al., Regulation of protein activity with small-molecule-controlled inteins. Protein Sci. Feb. 2005;14(2):523-32. Epub Jan. 4, 2005.
Smith, Filamentous fusion phage: novel expression vectors that display cloned antigens on the virion surface. Science. Jun. 14, 1985;228(4705): 1315-7.
Sudarsan et al., An mRNA structure in bacteria that controls gene expression by binding lysine. Genes Dev. Nov. 1, 2003;17(21):2688-97.
Suess et al., A theophylline responsive riboswitch based on helix slipping controls gene expression in vivo. Nucleic Acids Res. Mar. 5, 2004;32(4):1610-4.
Tourdot et al., A general strategy to enhance immunogenicity of low-affinity HLA-A2. 1-associated peptides: implication in the identification of cryptic tumor epitopes. Eur J Immunol. Dec. 2000;30(12):3411-21.
Trausch et al., The structure of a tetrahydrofolate-sensing riboswitch reveals two ligand binding sites in a single aptamer. Structure. Oct. 12, 2011;19(10):1413-23. doi: 10.1016/j.str.2011.06.019. Epub Sep. 8, 2011.
Wals et al., Unnatural amino acid incorporation in *E. coli*: current and future applications in the design of therapeutic proteins. Front Chem. Apr. 1, 2014;2:15. doi: 10.3389/fchem.2014.00015. eCollection 2014.
Weinberg et al., The aptamer core of SAM-IV riboswitches mimics the ligand-binding site of SAM-I riboswitches. RNA. May 2008;14(5):822-8. doi: 10.1261/rna.988608. Epub Mar. 27, 2008.
Winkler et al., An mRNA structure that controls gene expression by binding FMN. Proc Natl Acad Sci U S A. Dec. 10, 2002;99(25):15908-13. Epub Nov. 27, 2002.
Winkler et al., Control of gene expression by a natural metabolite-responsive ribozyme. Nature. Mar. 18, 2004;428(6980):281-6.
Winkler et al., Thiamine derivatives bind messenger RNAs directly to regulate bacterial gene expression. Nature. Oct. 31, 2002;419(6910):952-6. Epub Oct. 16, 2002.
Yahata et al., Unified, Efficient, and Scalable Synthesis of Halichondrins: Zirconium/Nickel-Mediated One-Pot Ketone Synthesis as the Final Coupling Reaction. Angew Chem Int Ed Engl. Aug. 28, 2017;56(36):10796-10800. doi: 10.1002/anie.201705523. Epub Jul. 28, 2017.
Yamamoto et al., Virological and immunological bases for HIV-1 vaccine design. Uirusu 2007;57(2):133-139. https://doi.org/10.2222/jsv.57.133.
Yang et al., APOBEC: From mutator to editor. J Genet Genomics. Sep. 20, 2017;44(9):423-437. doi: 10.1016/j.jgg.2017.04.009. Epub Aug. 7, 2017.
Yang et al., New CRISPR-Cas systems discovered. Cell Res. Mar. 2017;27(3):313-314. doi: 10.1038/cr.2017.21. Epub Feb. 21, 2017.
Young et al., Beyond the canonical 20 amino acids: expanding the genetic lexicon. J Biol Chem. Apr. 9, 2010;285(15):11039-44. doi: 10.1074/jbc.R109.091306. Epub Feb. 10, 2010.
Yuan et al., Laboratory-directed protein evolution. Microbiol Mol Biol Rev. 2005; 69(3):373-92. PMID: 16148303.
Zimmermann et al., Molecular interactions and metal binding in the theophylline-binding core of an RNA aptamer. RNA. May 2000;6(5):659-67.
International Preliminary Report on Patentability for PCT/US2018/048969, mailed Mar. 12, 2020.
[No Author Listed], "Lambda DNA" from Catalog & Technical Reference. New England Biolabs Inc. 2002/2003. pp. 133 and 270-273.
Baba et al., Construction of *Escherichia coli* K-12 in-frame, single-gene knockout mutants: the Keio collection. Mol Syst Biol. 2006;2:2006.0008. doi: 10.1038/msb4100050. Epub Feb. 21, 2006.
Bass, B.L., Rna editing by adenosine deaminases that act on RNA. Annu Rev Biochem. 2002;71:817-46. doi: 10.1146/annurev.biochem.71.110601.135501. Epub Nov. 9, 2001.
Blauw et al., SMN1 gene duplications are associated with sporadic ALS. Neurology. Mar. 13, 2012;78(11):776-80. doi: 10.1212/WNL.0b013e318249f697. Epub Feb. 8, 2012.
Bothmer et al., Characterization of the interplay between DNA repair and CRISPR/Cas9-induced DNA lesions at an endogenous locus. Nat Commun. Jan. 9, 2017;8:13905. doi: 10.1038/ncomms13905.
Brutlag et al., Improved sensitivity of biological sequence database searches. Comput Appl Biosci. Jul. 1990;6(3):237-45. doi: 10.1093/bioinformatics/6.3.237.
Canny et al., Inhibition of 53BP1 Favors Homology-Dependent DNA Repair and Increases CRISPR-Cas9 Genome-Editing Efficiency. Nat Biotechnol. Jan. 2018;36(1):95-102. doi: 10.1038/nbt.4021. Epub Nov. 27, 2017.
Cao et al., Rapamycin reverses cellular phenotypes and enhances mutant protein clearance in Hutchinson-Gilford progeria syndrome cells. Sci Transl Med. Jun. 29, 2011;3(89):89ra58. doi: 10.1126/scitranslmed.3002346.
Cartegni et al., Determinants of exon 7 splicing in the spinal muscular atrophy genes, SMN1 and SMN2. Am J Hum Genet. Jan. 2006;78(1):63-77. doi: 10.1086/498853. Epub Nov. 16, 2005.
Chang et al., Degradation of survival motor neuron (SMN) protein is mediated via the ubiquitin/proteasome pathway. Neurochem Int. Dec. 2004;45(7):1107-12. doi: 10.1016/j.neuint.2004.04.005.
Cho et al., A degron created by SMN2 exon 7 skipping is a principal contributor to spinal muscular atrophy severity. Genes Dev. Mar. 1, 2010;24(5):438-42. doi: 10.1101/gad.1884910.
Corcia et al., The importance of the SMN genes in the genetics of sporadic ALS. Amyotroph Lateral Scler. Oct.-Dec. 2009;10(5-6):436-40. doi: 10.3109/17482960902759162.

(56) References Cited

OTHER PUBLICATIONS

Corti et al., Genetic correction of human induced pluripotent stem cells from patients with spinal muscular atrophy. Sci Transl Med. Dec. 19, 2012;4(165): 165ra162. doi: 10.1126/scitranslmed.3004108.

Cucchiarini et al., Enhanced expression of the central survival of motor neuron (SMN) protein during the pathogenesis of osteoarthritis. J Cell Mol Med. Jan. 2014;18(1):115-24. doi: 10.1111/jcmm.12170. Epub Nov. 17, 2013.

D'Ydewalle et al., The Antisense Transcript SMN-AS1 Regulates SMN Expression and Is a Novel Therapeutic Target for Spinal Muscular Atrophy. Neuron. Jan. 4, 2017;93(1):66-79 and Supplemental Information. doi: 10.1016/j.neuron.2016.11.033. Epub Dec. 22, 2016.

Davis et al., Assaying Repair at DNA Nicks. Methods Enzymol. 2018;601:71-89. doi: 10.1016/bs.mie.2017.12.001. Epub Feb. 1, 2018.

Davis et al., Homology-directed repair of DNA nicks via pathways distinct from canonical double-strand break repair. Proc Natl Acad Sci U S A. Mar. 11, 2014;111(10):E924-32. doi: 10.1073/pnas.1400236111. Epub Feb. 20, 2014.

Davis et al., Two Distinct Pathways Support Gene Correction by Single-Stranded Donors at DNA Nicks. Cell Rep. Nov. 8, 2016;17(7):1872-1881. doi: 10.1016/j.celrep.2016.10.049.

De Sandre-Giovannoli et al., Lamin a truncation in Hutchinson-Gilford progeria. Science. Jun. 27, 2003;300(5628):2055. doi: 10.1126/science.1084125. Epub Apr. 17, 2003.

Drenth et al., Mutations in sodium-channel gene SCN9A cause a spectrum of human genetic pain disorders. J Clin Invest. Dec. 2007;117(12):3603-9. doi: 10.1172/JCI33297.

Drost et al., Inactivation of DNA mismatch repair by variants of uncertain significance in the PMS2 gene. Hum Mutat. Nov. 2013;34(11):1477-80. doi: 10.1002/humu.22426. Epub Sep. 11, 2013.

Dugar et al., CRISPR RNA-Dependent Binding and Cleavage of Endogenous RNAs by the Campylobacter jejuni Cas9. Mol Cell. Mar. 1, 2018;69(5):893-905.e7. doi: 10.1016/j.molcel.2018.01.032.

Eisenberg et al., A-to-I RNA editing—immune protector and transcriptome diversifier. Nat Rev Genet. Aug. 2018;19(8):473-490. doi: 10.1038/s41576-018-0006-1.

Ekstrand et al., Frequent alterations of the PI3K/AKT/mTOR pathways in hereditary nonpolyposis colorectal cancer. Fam Cancer. Jun. 2010;9(2):125-9. doi: 10.1007/s10689-009- 9293-1.

Entin-Meer et al., The role of phenylalanine-119 of the reverse transcriptase of mouse mammary tumour virus in DNA synthesis, ribose selection and drug resistance. Biochem J. Oct. 15, 2002;367(Pt 2):381-91. doi: 10.1042/BJ20020712.

Friedman, J. H., Greedy function approximation: A gradient boosting machine. Ann. Statist. Oct. 2001;29(5):1189-232. doi: 10.1214/aos/1013203451.

GenBank Submission; NIH/NCBI, Accession No. NG_008692.2. McClintock et al., Aug. 27, 2018. 33 pages.

GenBank Submission; NIH/NCBI, Accession No. NP_001075493.1. Schiaffella et al., Jun. 24, 2018. 2 pages.

GenBank Submission; NIH/NCBI, Accession No. NP_001157741.1. Zeng et al., Sep. 17, 2018. 3 pages.

GenBank Submission; NIH/NCBI, Accession No. NP_001157742.1. Zeng et al., Oct. 21, 2018. 3 pages.

GenBank Submission; NIH/NCBI, Accession No. NP_033040.2. Liu et al., Jun. 23, 2018. 2 pages.

GenBank Submission; NIH/NCBI, Accession No. XP_003314669.1. No Author Listed, Mar. 20, 2018. 2 pages.

GenBank Submission; NIH/NCBI, Accession No. XP_026671085.1. No Author Listed, Oct. 17, 2018. 1 page.

Gutschner et al., Post-translational Regulation of Cas9 during G1 Enhances Homology-Directed Repair. Cell Rep. Feb. 16, 2016;14(6):1555-1566. doi: 10.1016/j.celrep.2016.01.019. Epub Feb. 4, 2016.

Hart et al., High-Resolution CRISPR Screens Reveal Fitness Genes and Genotype-Specific Cancer Liabilities. Cell. Dec. 3, 2015;163(6):1515-26. doi: 10.1016/j.cell.2015.11.015. Epub Nov. 25, 2015.

Hendel et al., Chemically modified guide RNAs enhance CRISPR-Cas genome editing in human primary cells. Nat Biotechnol. Sep. 2015;33(9):985-989. doi: 10.1038/nbt.3290. Epub Jun. 29, 2015. Author Manuscript. 14 pages.

Huang et al., Gain-of-function mutations in sodium channel Na(v)1.9 in painful neuropathy. Brain. Jun. 2014;137(Pt 6):1627-42. doi: 10.1093/brain/awu079. Epub Apr. 27, 2014.

Iyama et al., DNA repair mechanisms in dividing and non-dividing cells. DNA Repair (Amst). Aug. 2013;12(8):620-36. doi: 10.1016/j.dnarep.2013.04.015. Epub May 16, 2013.

Kan et al., Mechanisms of precise genome editing using oligonucleotide donors. Genome Res. Jul. 2017;27(7):1099-1111. doi: 10.1101/gr.214775.116. Epub Mar. 29, 2017.

Kim et al., RAD51 mutants cause replication defects and chromosomal instability. Mol Cell Biol. Sep. 2012;32(18):3663-80. doi: 10.1128/MCB.00406-12. Epub Jul. 9, 2012.

Knott et al., CRISPR-Cas guides the future of genetic engineering. Science. Aug. 31, 2018;361(6405):866-869. doi: 10.1126/science.aat5011.

Konishi et al., Amino acid substitutions away from the RNase H catalytic site increase the thermal stability of Moloney murine leukemia virus reverse transcriptase through RNase H inactivation. Biochem Biophys Res Commun. Nov. 14, 2014;454(2):269-74. doi: 10.1016/j.bbrc.2014.10.044. Epub Oct. 17, 2014.

Le et al., SMNDelta7, the major product of the centromeric survival motor neuron (SMN2) gene, extends survival in mice with spinal muscular atrophy and associates with full-length SMN. Hum Mol Genet. Mar. 15, 2005;14(6):845-57. doi: 10.1093/hmg/ddi078. Epub Feb. 9, 2005.

Lefebvre et al., Identification and characterization of a spinal muscular atrophy-determining gene. Cell. Jan. 13, 1995;80(1):155-65. doi: 10.1016/0092-8674(95)90460-3.

Lesinski et al., The potential for targeting the STAT3 pathway as a novel therapy for melanoma. Future Oncol. Jul. 2013;9(7):925-7. doi: 10.2217/fon.13.83. Author Manuscript. 4 pages.

Lin et al., [Construction and evaluation of DnaB split intein high expression vector and a six amino acids cyclic peptide library]. Sheng Wu Gong Cheng Xue Bao. Nov. 2008;24(11):1924-30. Chinese.

Lindahl, T., Instability and decay of the primary structure of DNA. Nature. Apr. 22, 1993;362(6422):709-15. doi: 10.1038/362709a0.

Liu et al., Human BRCA2 protein promotes RAD51 filament formation on RPA-covered single-stranded DNA. Nat Struct Mol Biol. Oct. 2010;17(10):1260-2. doi: 10.1038/nsmb.1904. Epub Aug. 22, 2010.

Liu et al., Intrinsic Nucleotide Preference of Diversifying Base Editors Guides Antibody Ex Vivo Affinity Maturation. Cell Rep. Oct. 23, 2018;25(4):884-892.e3. doi: 10.1016/j.celrep.2018.09.090.

Lorson et al., A single nucleotide in the SMN gene regulates splicing and is responsible for spinal muscular atrophy. Proc Natl Acad Sci U S A. May 25, 1999;96(11):6307-11. doi: 10.1073/pnas.96.11.6307.

Lutz et al., Postsymptomatic restoration of SMN rescues the disease phenotype in a mouse model of severe spinal muscular atrophy. J Clin Invest. Aug. 2011;121(8):3029-41. doi: 10.1172/JCI57291. Epub Jul. 25, 2011.

Ma et al., Human RAD52 interactions with replication protein A and the RAD51 presynaptic complex. J Biol Chem. Jul. 14, 2017;292(28):11702-11713. doi: 10.1074/jbc.M117.794545. Epub May 27, 2017.

Marsden et al., The Tumor-Associated Variant RAD51 G151D Induces a Hyper-Recombination Phenotype. PLoS Genet. Aug. 11, 2016;12(8):e1006208. doi: 10.1371/journal.pgen.1006208.

Mendell et al., Single-Dose Gene-Replacement Therapy for Spinal Muscular Atrophy. N Engl J Med. Nov. 2, 2017;377(18): 1713-1722. doi: 10.1056/NEJMoa1706198.

(56) References Cited

OTHER PUBLICATIONS

Monani et al., A single nucleotide difference that alters splicing patterns distinguishes the SMA gene SMN1 from the copy gene SMN2. Hum Mol Genet. Jul. 1999;8(7):1177-83. doi: 10.1093/hmg/8.7.1177.

Murray et al., Selective vulnerability of motor neurons and dissociation of pre- and post-synaptic pathology at the neuromuscular junction in mouse models of spinal muscular atrophy. Hum Mol Genet. Apr. 1, 2008;17(7):949-62. doi: 10.1093/hmg/ddm367. Epub Dec. 8, 2007.

Murugan et al., The Revolution Continues: Newly Discovered Systems Expand the CRISPR-Cas Toolkit. Mol Cell. Oct. 5, 2017;68(1):15-25. doi: 10.1016/j.molcel.2017.09.007.

Nelson et al., In vivo genome editing improves muscle function in a mouse model of Duchenne muscular dystrophy. Science. Jan. 22, 2016;351(6271):403-7. doi: 10.1126/science.aad5143. Epub Dec. 31, 2015.

Nelson et al., The unstable repeats—three evolving faces of neurological disease. Neuron. Mar. 6, 2013;77(5):825-43. doi: 10.1016/j.neuron.2013.02.022.

Noack et al., Epitranscriptomics: A New Regulatory Mechanism of Brain Development and Function. Front Neurosci. Feb. 20, 2018;12:85. doi: 10.3389/fnins.2018.00085. 9 pages.

Ottesen, ISS-N1 makes the First FDA-approved Drug for Spinal Muscular Atrophy. Transl Neurosci. Jan. 26, 2017;8:1-6. doi: 10.1515/tnsci-2017-0001.

Parente et al., Advances in spinal muscular atrophy therapeutics. Ther Adv Neurol Disord. Feb. 5, 2018;11:1756285618754501. doi: 10.1177/1756285618754501. 13 pages.

Passini et al., Antisense oligonucleotides delivered to the mouse CNS ameliorate symptoms of severe spinal muscular atrophy. Sci Transl Med. Mar. 2, 2011;3(72):72ra18. doi: 10.1126/scitranslmed.3001777.

Pellegrini et al., Insights into DNA recombination from the structure of a RAD51-BRCA2 complex. Nature. Nov. 21, 2002;420(6913):287-93. doi: 10.1038/nature01230. Epub Nov. 10, 2002.

Porensky et al., A single administration of morpholino antisense oligomer rescues spinal muscular atrophy in mouse. Hum Mol Genet. Apr. 1, 2012;21(7):1625-38. doi: 10.1093/hmg/ddr600. Epub Dec. 20, 2011.

Prasad et al., Visualizing the assembly of human Rad51 filaments on double-stranded DNA. J Mol Biol. Oct. 27, 2006;363(3):713-28. doi: 10.1016/j.jmb.2006.08.046. Epub Aug. 22, 2006.

Rajagopal et al., High-throughput mapping of regulatory DNA. Nat Biotechnol. Feb. 2016;34(2):167-74. doi: 10.1038/nbt.3468. Epub Jan. 25, 2016.

Richardson et al., CRISPR-Cas9 genome editing in human cells occurs via the Fanconi anemia pathway. Nat Genet. Aug. 2018;50(8):1132-1139. doi: 10.1038/s41588-018-0174-0. Epub Jul. 27, 2018.

Richardson et al., Frequent chromosomal translocations induced by DNA double-strand breaks. Nature. Jun. 8, 2000;405(6787):697-700. doi: 10.1038/35015097.

Rodriguez-Muela et al., Single-Cell Analysis of SMN Reveals Its Broader Role in Neuromuscular Disease. Cell Rep. Feb. 7, 2017;18(6):1484-1498 and Supplemental Information. doi: 10.1016/j.celrep.2017.01.035.

San Filippo et al., Mechanism of eukaryotic homologous recombination. Annu Rev Biochem. 2008;77:229-57. doi: 10.1146/annurev.biochem.77.061306.125255.

Schlacher et al., Double-strand break repair-independent role for BRCA2 in blocking stalled replication fork degradation by MRE11. Cell. May 13, 2011;145(4):529-42. doi: 10.1016/j.cell.2011.03.041. Erratum in: Cell. Jun. 10, 2011;145(6):993.

Schrank et al., Inactivation of the survival motor neuron gene, a candidate gene for human spinal muscular atrophy, leads to massive cell death in early mouse embryos. Proc Natl Acad Sci USA. Sep. 2, 1997;94(18):9920-5. doi: 10.1073/pnas.94.18.9920.

Shen et al., Efficient genome modification by CRISPR-Cas9 nickase with minimal off-target effects. Nat Methods. Apr. 2014;11(4):399-402. doi: 10.1038/nmeth.2857. Epub Mar. 2, 2014.

Singh et al., Splicing of a critical exon of human Survival Motor Neuron is regulated by a unique silencer element located in the last intron. Mol Cell Biol. Feb. 2006;26(4):1333-46. doi: 10.1128/MCB.26.4.1333-1346.2006.

Song et al., RS-1 enhances CRISPR/Cas9- and TALEN-mediated knock-in efficiency. Nat Commun. Jan. 28, 2016;7:10548. doi: 10.1038/ncomms10548.

Stark et al., ATP hydrolysis by mammalian RAD51 has a key role during homology-directed DNA repair. J Biol Chem. Jun. 7, 2002;277(23):20185-94. doi: 10.1074/jbc.M112132200. Epub Mar. 28, 2002.

Sumner et al., Two breakthrough gene-targeted treatments for spinal muscular atrophy: challenges remain. J Clin Invest. Aug. 1, 2018;128(8):3219-3227. doi: 10.1172/JCI121658. Epub Jul. 9, 2018.

Talbot et al., Spinal muscular atrophy. Semin Neurol. Jun. 2001;21(2):189-97. doi: 10.1055/s-2001-15264.

Vakulskas et al., A high-fidelity Cas9 mutant delivered as a ribonucleoprotein complex enables efficient gene editing in human hematopoietic stem and progenitor cells. Nat Med. Aug. 2018;24(8):1216-1224. doi: 10.1038/s41591-018-0137-0. Epub Aug. 6, 2018.

Van Den Oord et al., Pixel Recurrent Neural Networks. Proceedings of the 33rd International Conference on Machine Learning. Journal of Machine Learning Research. Aug. 19, 2016. vol. 48. 11 pages.

Wirth et al., Mildly affected patients with spinal muscular atrophy are partially protected by an increased SMN2 copy number. Hum Genet. May 2006;119(4):422-8. doi: 10.1007/s00439-006-0156-7. Epub Mar. 1, 2006.

Woo et al., Gene activation of SMN by selective disruption of lncRNA-mediated recruitment of PRC2 for the treatment of spinal muscular atrophy. Proc Natl Acad Sci U S A. Feb. 21, 2017;114(8):E1509-E1518. doi:10.1073/pnas.1616521114. Epub Feb. 13, 2017.

Wu et al., A novel SCN9A mutation responsible for primary erythromelalgia and is resistant to the treatment of sodium channel blockers. PLoS One. 2013;8(1):e55212. doi: 10.1371/journal.pone.0055212. Epub Jan. 31, 2013. 15 pages.

Yamane et al., Deep-sequencing identification of the genomic targets of the cytidine deaminase AID and its cofactor RPA in B lymphocytes. Nat Immunol. Jan. 2011;12(1):62-9. doi: 10.1038/ni.1964. Epub Nov. 28, 2010.

Yang et al., BRCA2 function in DNA binding and recombination from a BRCA2-DSS1-ssDNA structure. Science. Sep. 13, 2002;297(5588):1837-48. doi: 10.1126/science.297.5588.1837.

Yang et al., The BRCA2 homologue Brh2 nucleates RAD51 filament formation at a dsDNA-ssDNA junction. Nature. Feb. 10, 2005;433(7026):653-7. doi: 10.1038/nature03234.

Yu et al., Dynamic control of Rad51 recombinase by self-association and interaction with BRCA2. Mol Cell. Oct. 2003;12(4):1029-41. doi: 10.1016/s1097-2765(03)00394-0.

Zhang et al., Efficient precise knockin with a double cut HDR donor after CRISPR/Cas9-mediated double-stranded DNA cleavage. Genome Biol. Feb. 20, 2017;18(1):35. doi: 10.1186/s13059-017-1164-8.

Zhang et al., Large genomic fragment deletions and insertions in mouse using CRISPR/Cas9. PLOS One. Mar. 24, 2015;10(3):e0120396. doi: 10.1371/journal.pone.0120396. 14 pages.

U.S. Appl. No. 61/836,080.

U.S. Appl. No. 62/498,686.

[No Author Listed] "FokI" from New England Biolabs Inc. Last accessed online via https://www.neb.com/products/r0109-foki#Product%20Information on Mar. 19, 2021. 1 page.

[No Author Listed] "Nucleic Acids Sizes and Molecular Weights." Printed Mar. 19, 2021. 2 pages.

[No Author Listed] "Zinc Finger Nuclease" from Wikipedia. Retrieved from https://en.wikipedia.org/w/index.php?title=Zinc_finger_nuclease&oldid=1007053318. Page last edited Feb. 16, 2021. Printed on Mar. 19, 2021.

[No Author Listed] Beast2: Bayesian evolutionary analysis by sampling trees. http://www.beast2.org/ Last accessed Apr. 28, 2021.

(56) References Cited

OTHER PUBLICATIONS

[No Author Listed] HyPhy—Hypothesis testing using Phylogenies. Last modified Apr. 21, 2017. Accessed online via http://hyphy.org/w/index.php/Main_Page on Apr. 28, 2021.

[No Author Listed] Ncbi Accession No. XP_015843220.1. C→U editing enzyme APOBEC-1 [Peromyscus maniculatus bairdii], XP002793540. Mar. 21, 2016.

[No Author Listed] Ncbi Accession No. XP_021505673.1. C→U editing enzyme APOBEC-1 [Meriones unguiculatus], XP002793541. Jun. 27, 2017.

[No Author Listed] NCBI Reference Sequence: WP_00087959824.1. Oct. 9, 2019. 2 pages.

[No Author Listed] NCBI Reference Sequence: WP_001516895.1. Mar. 13, 2021. 2 pages.

[No Author Listed] Nucleic Acid Data from New England Biolabs. Printed Sep. 28, 2021. 1 page.

[No Author Listed] Theoretical Biochemistry Group. Institute for Theoretical Chemistry. The ViennaRNA Package. Universitat Wien. https://www.tbi.univie.ac.at/RNA/. Last accessed Apr. 28, 2021.

[No Author Listed] Transcription activator-like effector nuclease. Wikipedia. Last edited Sep. 27, 2021. Accessed via https://en.wikipedia.org/w/index.php?title=Transcription_activator-like_effector_nuclease&oldid=1046813325 on Sep. 28, 2021. 9 pages.

[No Author Listed], "Human genome." Encyclopedia Britannica. Encyclopedia Brittanica, Inc. Published Feb. 15, 2019. Last accessed online via https://www.britannica.com/science/human-genome on Mar. 19, 2021. 2 pages.

[No Author Listed], *Mus musculus* (Mouse). UniProtKB Accession No. P51908 (ABEC1_MOUSE). Oct. 1, 1996. 10 pages.

Abremski et al., Bacteriophage P1 site-specific recombination. Purification and properties of the Cre recombinase protein. J Biol Chem. Feb. 10, 1984;259(3): 1509-14.

Abudayyeh et al., A cytosine deaminase for programmable single-base RNA editing. Science. Jul. 26, 2019;365(6451):382-386. doi: 10.1126/science.aax7063. Epub Jul. 11, 2019.

Abudayyeh et al., RNA targeting with CRISPR-Cas13. Nature. Oct. 12, 2017;550(7675):280-284. doi: 10.1038/nature24049. Epub Oct. 4, 2017.

Ada et al., Carbohydrate-protein conjugate vaccines. Clin Microbiol Infect. Feb. 2003;9(2):79-85. doi: 10.1046/j.1469-0691.2003.00530.x.

Adamala et al., Programmable RNA-binding protein composed of repeats of a single modular unit. Proc Natl Acad Sci U S A. May 10, 2016;113(19):E2579-88. doi: 10.1073/pnas.1519368113. Epub Apr. 26, 2016.

Adams et al., New biarsenical ligands and tetracysteine motifs for protein labeling in vitro and in vivo: synthesis and biological applications. J Am Chem Soc. May 29, 2002;124(21):6063-76. doi: 10.1021/ja017687n.

Adli, The CRISPR tool kit for genome editing and beyond. Nat Commun. May 15, 2018;9(1):1911. doi: 10.1038/s41467-018-04252-2.

Aguilo et al., Coordination of m(6)A mRNA Methylation and Gene Transcription by ZFP217 Regulates Pluripotency and Reprogramming. Cell Stem Cell. Dec. 3, 2015;17(6):689-704. doi: 10.1016/j.stem.2015.09.005. Epub Oct. 29, 2015.

Ahmad et al., Antibody-mediated specific binding and cytotoxicity of liposome-entrapped doxorubicin to lung cancer cells in vitro. Cancer Res. Sep. 1, 1992;52(17):4817-20.

Aida et al., Prime editing primarily incudes undesired outcomes in mice. bioRxiv preprint and Supplemental Information. Aug. 6, 2020. Retrieved from www.biorxiv.org. doi: 10.1101/2020.08.06.239723. 40 pages.

Aik et al., Structure of human RNA ?-methyladenine demethylase ALKBH5 provides insights into its mechanisms of nucleic acid recognition and demethylation. Nucleic Acids Res. Apr. 2014;42(7):4741-54. doi: 10.1093/nar/gku085. Epub Jan. 30, 2014.

Aird et al., Increasing Cas9-mediated homology-directed repair efficiency through covalent tethering of DNA repair template. Commun Biol. May 31, 2018;1:54. doi: 10.1038/s42003-018-0054-2.

Akcakaya et al., In vivo CRISPR editing with No. detectable genome-wide off-target mutations. Nature. Sep. 2018;561(7723):416-419. doi: 10.1038/s41586-018-0500-9. Epub Sep. 12, 2018. PMID: 30209390; Pmcid: PMC6194229.

Akins et al., Mitochondrial plasmids of Neurospora: integration into mitochondrial DNA and evidence for reverse transcription in mitochondria. Cell. Nov. 21, 1986;47(4):505-16. doi: 10.1016/0092-8674(86)90615-x.

Akinsheye et al., Fetal hemoglobin in sickle cell anemia. Blood. Jul. 7, 2011;118(1):19-27. doi: 10.1182/blood-2011-03-325258. Epub Apr. 13, 2011.

Alarcón et al., HNRNPA2B1 Is a Mediator of m(6)A-Dependent Nuclear RNA Processing Events. Cell. Sep. 10, 2015;162(6):1299-308. doi: 10.1016/j.cell.2015.08.011. Epub Aug. 27, 2015.

Alarcón et al., N6-methyladenosine marks primary microRNAs for processing. Nature. Mar. 26, 2015;519(7544):482-5. doi: 10.1038/nature14281. Epub Mar. 18, 2015.

Alexander, HFE-associated hereditary hemochromatosis. Genet Med. May 2009;11(5):307-13. doi: 10.1097/GIM.0b013e31819d30f2.

Altschul et al., Basic local alignment search tool. J Mol Biol. Oct. 5, 1990;215(3):403-10. doi: 10.1016/S0022-2836(05)80360-2.

Amato et al., Interpreting elevated fetal hemoglobin in pathology and health at the basic laboratory level: new and known γ-gene mutations associated with hereditary persistence of fetal hemoglobin. Int J Lab Hematol. Feb. 2014;36(1):13-9. doi: 10.1111/ijlh.12094. Epub Apr. 29, 2013.

Amrann et al., Tightly regulated tac promoter vectors useful for the expression of unfused and fused proteins in *Escherichia coli*. Gene. Sep. 30, 1988;69(2):301-15.

Anders et al., Chapter One: In Vitro Enzymology of Cas9. in Methods in Enzymology, eds Doudna et al. 2014: 546:1-20.

Anders et al., Structural basis of PAM-dependent target DNA recognition by the Cas9 endonuclease. Nature. Sep. 25, 2014;513(7519):569-73. doi: 10.1038/nature13579. Epub Jul. 27, 2014. Europe PMC Funders Group. Author manuscript. Available OMC Mar. 25, 2015.

Anderson, Human gene therapy. Science. May 8, 1992;256(5058):808-13. doi: 10.1126/science.1589762.

André et al., Axotomy-induced expression of calcium-activated chloride current in subpopulations of mouse dorsal root ganglion neurons. J Neurophysiol. Dec. 2003;90(6):3764-73. doi: 10.1152/jn.00449.2003. Epub Aug. 27, 2003.

Anzalone et al., Genome editing with CRISPR-Cas nucleases, base editors, transposases and prime editors. Nat Biotechnol. Jul. 2020;38(7):824-844. doi: 10.1038/s41587-020-0561-9. Epub Jun. 22, 2020.

Anzalone et al., Reprogramming eukaryotic translation with ligand-responsive synthetic RNA switches. Nat Methods. May 2016;13(5):453-8. doi: 10.1038/nmeth.3807. Epub Mar. 21, 2016.

Anzalone et al., Search-and-replace genome editing without double-strand breaks or donor DNA. Nature. Dec. 2019;576(7785):149-157. doi: 10.1038/s41586-019-1711-4. Epub Oct. 21, 2019.

Aplan, Causes of oncogenic chromosomal translocation. Trends Genet. Jan. 2006;22(1):46-55. doi: 10.1016/j.tig.2005.10.002. Epub Oct. 28, 2005.

Arakawa et al., A method to convert mRNA into a gRNA library for CRISPR/Cas9 editing of any organism. Sci Adv. Aug. 24, 2016;2(8):e1600699. doi: 10.1126/sciadv.1600699.

Araki et al., Comparative analysis of right element mutant lox sites on recombination efficiency in embryonic stem cells. BMC Biotechnol. Mar. 31, 2010;10:29. doi: 10.1186/1472-6750-10-29.

Araki et al., Site-specific recombinase, R, encoded by yeast plasmid pSR1. J Mol Biol. May 5, 1992;225(1):25-37. doi: 10.1016/0022-2836(92)91023-i.

Araki et al., Targeted integration of DNA using mutant lox sites in embryonic stem cells. Nucleic Acids Res. Feb. 15, 1997;25(4):868-72. doi: 10.1093/nar/25.4.868.

Arambula et al., Surface display of a massively variable lipoprotein by a Legionella diversity-generating retroelement. Proc Natl Acad

(56) References Cited

OTHER PUBLICATIONS

Sci U S A. May 14, 2013;110(20):8212-7. doi: 10.1073/pnas. 1301366110. Epub Apr. 30, 2013.

Arazoe et al., Targeted Nucleotide Editing Technologies for Microbial Metabolic Engineering. Biotechnol J. Sep. 2018;13(9):e1700596. doi: 10.1002/biot.201700596. Epub Jun. 19, 2018.

Arbab et al., Cloning-free CRISPR. Stem Cell Reports. Nov. 10, 2015;5(5):908-917. doi: 10.1016/j.stemcr.2015.09.022. Epub Oct. 29, 2015.

Arbab et al., Determinants of Base Editing Outcomes from Target Library Analysis and Machine Learning. Cell. Jul. 23, 2020;182(2):463-480.e30. doi: 10.1016/j.cell.2020.05.037. Epub Jun. 12, 2020.

Arezi et al., Novel mutations in Moloney Murine Leukemia Virus reverse transcriptase increase thermostability through tighter binding to template-primer. Nucleic Acids Res. Feb. 2009;37(2):473-81. doi: 10.1093/nar/gkn952. Epub Dec. 4, 2008.

Asante et al., A naturally occurring variant of the human prion protein completely prevents prion disease. Nature. Jun. 25, 2015;522(7557):478-81. doi: 10.1038/nature14510. Epub Jun. 10, 2015.

Asokan et al., The AAV vector toolkit: poised at the clinical crossroads. Mol Ther. Apr. 2012;20(4):699-708. doi: 10.1038/mt. 2011.287. Epub Jan. 24, 2012.

Atkins et al., Ribosomal frameshifting and transcriptional slippage: From genetic steganography and cryptography to adventitious use. Nucleic Acids Res. Sep. 6, 2016;44(15):7007-78. doi: 10.1093/nar/gkw530. Epub Jul. 19, 2016.

Auer et al., Highly efficient CRISPR/Cas9-mediated knock-in in zebrafish by homology-independent DNA repair. Genome Res. Jan. 2014;24(1):142-53. doi: 10.1101/gr.161638.113. Epub Oct. 31, 2013.

Auricchio et al., Exchange of surface proteins impacts on viral vector cellular specificity and transduction characteristics: the retina as a model. Hum Mol Genet. Dec. 15, 2001;10(26):3075-81. doi: 10.1093/hmg/10.26.3075.

Autieri et al., IRT-1, a novel interferon-gamma-responsive transcript encoding a growth-suppressing basic leucine zipper protein. J Biol Chem. Jun. 12, 1998;273(24):14731-7. doi: 10.1074/jbc.273.24. 14731.

Avidan et al., The processivity and fidelity of DNA synthesis exhibited by the reverse transcriptase of bovine leukemia virus. Eur J Biochem. Feb. 2002;269(3):859-67. doi: 10.1046/j.0014-2956. 2001.02719.x.

Babacic et al., CRISPR-cas gene-editing as plausible treatment of neuromuscular and nucleotide-repeat-expansion diseases: A systematic review. PLoS One. Feb. 22, 2019;14(2):e0212198. doi: 10.1371/journal.pone.0212198.

Bacman et al., Specific elimination of mutant mitochondrial genomes in patient-derived cells by mitoTALENs. Nat Med. Sep. 2013;19(9):1111-3. doi: 10.1038/nm.3261. Epub Aug. 4, 2013.

Badran et al., Continuous evolution of Bacillus thuringiensis toxins overcomes insect resistance. Nature. May 5, 2016;533(7601):58-63. doi: 10.1038/nature17938. Epub Apr. 27, 2016.
Badran et al., Development of potent in vivo mutagenesis plasmids with broad mutational spectra. Nat Commun. Oct. 7, 2015;6:8425. doi: 10.1038/ncomms9425.
Bae et al., Cas-OFFinder: a fast and versatile algorithm that searches for potential off-target sites of Cas9 RNA-guided endonucleases. Bioinformatics. May 15, 2014;30(10):1473-5. doi: 10.1093/bioinformatics/btu048. Epub Jan. 24, 2014.
Bae et al., Microhomology-based choice of Cas9 nuclease target sites. Nat Methods. Jul. 2014;11(7):705-6. doi: 10.1038/nmeth.3015.
Bagal et al., Recent progress in sodium channel modulators for pain. Bioorg Med Chem Lett. Aug. 15, 2014;24(16):3690-9. doi: 10.1016/j.bmcl.2014.06.038. Epub Jun. 21, 2014.
Bagyinszky et al., Characterization of mutations in PRNP (prion) gene and their possible roles in neurodegenerative diseases. Neuropsychiatr Dis Treat. Aug. 14, 2018;14:2067-2085. doi: 10.2147/NDT.S165445.
Balakrishnan et al., Flap endonuclease 1. Annu Rev Biochem. 2013;82:119-38. doi: 10.1146/annurev-biochem-072511-122603. Epub Feb. 28, 2013.
Baldari et al., A novel leader peptide which allows efficient secretion of a fragment of human interleukin 1 beta in *Saccharomyces cerevisiae*. EMBO J. Jan. 1987;6(1):229-34.
Banerjee et al., Cadmium inhibits mismatch repair by blocking the ATPase activity of the MSH2-MSH6 complex [published correction appears in Nucleic Acids Res. 2005;33(5):1738]. Nucleic Acids Res. 2005;33(4):1410-1419. Published Mar. 3, 2005. doi: 10.1093/nar/gki291.
Banerji et al., A lymphocyte-specific cellular enhancer is located downstream of the joining region in immunoglobulin heavy chain genes. Cell. Jul. 1983;33(3):729-40. doi: 10.1016/0092-8674(83)90015-6.
Bannert et al., Retroelements and the human genome: new perspectives on an old relation. Proc Natl Acad Sci U S A. Oct. 5, 2004;101 Suppl 2(Suppl 2):14572-9. doi: 10.1073/pnas.0404838101. Epub Aug. 13, 2004.
Banno et al., Deaminase-mediated multiplex genome editing in *Escherichia coli*. Nat Microbiol. Apr. 2018;3(4):423-429. doi: 10.1038/s41564-017-0102-6. Epub Feb. 5, 2018.
Baranauskas et al., Generation and characterization of new highly thermostable and processive M-MuLV reverse transcriptase variants. Protein Eng Des Sel. Oct. 2012;25(10):657-68. doi: 10.1093/protein/gzs034. Epub Jun. 12, 2012.
Barmania et al., C-C chemokine receptor type five (CCR5): An emerging target for the control of HIV infection. Appl Transl Genom. May 26, 2013;2:3-16. doi: 10.1016/j.atg.2013.05.004.
Barnes et al., The fidelity of Taq polymerase catalyzing PCR is improved by an-terminal deletion. Gene. Mar. 1, 1992;112(1):29-35. doi: 10.1016/0378-1119(92)90299-5.
Bartlett et al., Efficient expression of protein coding genes from the murine U1 small nuclear RNA promoters. Proc Natl Acad Sci U S A. Aug. 20, 1996;93(17):8852-7. doi: 10.1073/pnas.93.17.8852.
Bartosovic et al., N6-methyladenosine demethylase FTO targets pre-mRNAs and regulates alternative splicing and 3'-end processing. Nucleic Acids Res. Nov. 2, 2017;45(19):11356-11370. doi: 10.1093/nar/gkx778.
Basturea et al., Substrate specificity and properties of the *Escherichia coli* 16S rRNA methyltransferase, RsmE. RNA. Nov. 2007;13(11):1969-76. doi: 10.1261/rna.700507. Epub Sep. 13, 2007.
Beaudry et al., Directed evolution of an RNA enzyme. Science. Jul. 31, 1992;257(5070):635-41. doi: 10.1126/science.1496376.
Bebenek et al., Error-prone polymerization by HIV-1 reverse transcriptase. Contribution of template-primer misalignment, miscoding, and termination probability to mutational hot spots. J Biol Chem. May 15, 1993;268(14):10324-34.
Behr, Gene transfer with synthetic cationic amphiphiles: prospects for gene therapy. Bioconjug Chem. Sep.-Oct. 1994;5(5):382-9. doi: 10.1021/bc00029a002.
Bell et al., Ribozyme-catalyzed excision of targeted sequences from within RNAs. Biochemistry. Dec. 24, 2002;41(51):15327-33. doi: 10.1021/bi0267386.
Belshaw et al., Controlling programmed cell death with a cyclophilin-cyclosporin-based chemical inducer of dimerization. Chem Biol. Sep. 1996;3(9):731-8. doi: 10.1016/s1074-5521(96)90249-5.
Belshaw et al., Controlling protein association and subcellular localization with a synthetic ligand that induces heterodimerization of proteins. Proc Natl Acad Sci U S A. May 14, 1996;93(10):4604-7. doi: 10.1073/pnas.93.10.4604.
Benarroch, Hcn channels: function and clinical implications. Neurology. Jan. 15, 2013;80(3):304-10. doi: 10.1212/WNL.0b013e31827dec42.
Bennett et al., Painful and painless channelopathies. Lancet Neurol. Jun. 2014;13(6):587-99. doi: 10.1016/S1474-4422(14)70024-9. Epub May 6, 2014.
Bentin, T., A ribozyme transcribed by a ribozyme. Artif DNA PNA XNA. Apr. 2011;2(2):40-42. doi: 10.4161/adna.2.2.16852.
Berger et al., Reverse transcriptase and its associated ribonuclease H: interplay of two enzyme activities controls the yield of single-stranded complementary deoxyribonucleic acid. Biochemistry. May 10, 1983;22(10):2365-72. doi: 10.1021/bi00279a010.

(56) References Cited

OTHER PUBLICATIONS

Berges et al., Transduction of brain by herpes simplex virus vectors. Mol Ther. Jan. 2007;15(1):20-9. doi: 10.1038/sj.mt.6300018.
Berkhout et al., Identification of an active reverse transcriptase enzyme encoded by a human endogenous HERV-K retrovirus. J Virol. Mar. 1999;73(3):2365-75. doi: 10.1128/JVI.73.3.2365-2375. 1999.
Bernhart et al., Local RNA base pairing probabilities in large sequences. Bioinformatics. Mar. 1, 2006;22(5):614-5. doi: 10.1093/bioinformatics/btk014. Epub Dec. 20, 2005.
Bernstein et al., Role for a bidentate ribonuclease in the initiation step of RNA interference. Nature. Jan. 18, 2001;409(6818):363-6. doi: 10.1038/35053110.
Bertolotti et al., Toward genosafe endonuclease-boosted gene targeting using breakthrough CRISP/Cas9 for next generation stem cell gene therapy culminating in efficient ex VIVO in VIVO gene repair/genomic editing. Molecular Therapy. May 2015;23(Suppl1):S139. Abstract 350. 18th Ann Meeting of the American Society of Gene and Cell Therapy. ASGCT 2015. New Orleans, LA. May 13, 2015-May 16, 2015.
Bertrand et al., Localization of ASH1 mRNA particles in living yeast. Mol Cell. Oct. 1998;2(4):437-45. doi: 10.1016/s1097-2765(00)80143-4.
Bessen et al., High-resolution specificity profiling and off-target prediction for site-specific DNA recombinases. Nat Commun. Apr. 26, 2019;10(1):1937. doi: 10.1038/s41467-019-09987-0.
Bi et al., Pseudo attP sites in favor of transgene integration and expression in cultured porcine cells identified by Streptomyces phage phiC31 integrase. BMC Mol Biol. Sep. 8, 2013;14:20. doi: 10.1186/1471-2199-14-20.
Bibb et al., Integration and excision by the large serine recombinase phiRv1 integrase. Mol Microbiol. Mar. 2005;55(6):1896-910. doi: 10.1111/j.1365-2958.2005.04517.x.
Biehs et al., DNA Double-Strand Break Resection Occurs during Non-homologous End Joining in G1 but Is Distinct from Resection during Homologous Recombination. Mol Cell. Feb. 16, 2017;65(4):671-684.e5. doi: 10.1016/j.molcel.2016.12.016. Epub Jan. 26, 2017.
Biswas et al., A structural basis for allosteric control of DNA recombination by lambda integrase. Nature. Jun. 23, 2005;435(7045):1059-66. doi: 10.1038/nature03657.
Blaese et al., Vectors in cancer therapy: how will they deliver? Cancer Gene Ther. Dec. 1995;2(4):291-7.
Blain et al., Nuclease activities of Moloney murine leukemia virus reverse transcriptase. Mutants with altered substrate specificities. J Biol Chem. Nov. 5, 1993;268(31):23585-92.
Blaisonneau et al., A circular plasmid from the yeast *Torulaspora delbrueckii*. Plasmid. 1997;38(3):202-9. doi: 10.1006/plas.1997.1315.
Blau et al., A proliferation switch for genetically modified cells. PNAS Apr. 1, 1997 94 (7) 3076-3081; https://doi.org/10.1073/pnas.94.7.3076.
Bloom et al., Evolving strategies for enzyme engineering. Curr Opin Struct Biol. Aug. 2005;15(4):447-52.
Bodi et al., Yeast m6A Methylated mRNAs Are Enriched on Translating Ribosomes during Meiosis, and under Rapamycin Treatment. PLoS One. Jul. 17, 2015;10(7):e0132090. doi: 10.1371/journal.pone.0132090.
Boersma et al., Selection strategies for improved biocatalysts. FEBS J. May 2007;274(9):2181-95.
Bogdanove et al., Engineering altered protein-DNA recognition specificity. Nucleic Acids Res. Jun. 1, 2018;46(10):4845-4871. doi: 10.1093/nar/gky289.
Bolusani et al., Evolution of variants of yeast site-specific recombinase Flp that utilize native genomic sequences as recombination target sites. Nucleic Acids Res. 2006;34(18):5259-69. Epub Sep. 26, 2006.
Bondeson et al., Inversion of the IDS gene resulting from recombination with IDS-related sequences is a common cause of the Hunter syndrome. Hum Mol Genet. Apr. 1995;4(4):615-21. doi: 10.1093/hmg/4.4.615.
Borchardt et al., Controlling mRNA stability and translation with the CRISPR endoribonuclease Csy4. RNA. Nov. 2015;21(11):1921-30. doi: 10.1261/rna.051227.115. Epub Sep. 9, 2015.
Bourinet et al., Silencing of the Cav3.2 T-type calcium channel gene in sensory neurons demonstrates its major role in nociception. EMBO J. Jan. 26, 2005;24(2):315-24. doi: 10.1038/sj.emboj.7600515. Epub Dec. 16, 2004.
Boutabout et al., DNA synthesis fidelity by the reverse transcriptase of the yeast retrotransposon Ty1. Nucleic Acids Res. Jun. 1, 2001;29(11):2217-22. doi: 10.1093/nar/29.11.2217.
Box et al., A multi-domain protein system based on the HC fragment of tetanus toxin for targeting DNA to neuronal cells. J Drug Target. Jul. 2003;11(6):333-43. doi: 10.1080/10611863100001634667.
Braun et al., Immunogenic duplex nucleic acids are nuclease resistant. J Immunol. Sep. 15, 1988;141(6):2084-9.
Brierley et al., Viral RNA pseudoknots: versatile motifs in gene expression and replication. Nat Rev Microbiol. Aug. 2007;5(8):598-610. doi: 10.1038/nrmicro1704.
Brown et al., A mammalian protein targeted by G1-arresting rapamycin-receptor complex. Nature. Jun. 30, 1994;369(6483):756-8. doi: 10.1038/369756a0.
Brown et al., Characterization of the genetic elements required for site-specific integration of plasmid pSE211 in Saccharopolyspora erythraea. J Bacteriol. Apr. 1990;172(4):1877-88. doi: 10.1128/jb.172.4.1877-1888.1990.
Brown et al., Structural insights into the stabilization of MALAT1 noncoding RNA by a bipartite triple helix. Nat Struct Mol Biol. Jul. 2014;21(7):633-40. doi: 10.1038/nsmb.2844. Epub Jun. 22, 2014.
Brzezicha et al., Identification of human tRNA:m5C methyltransferase catalysing intron-dependent m5C formation in the first position of the anticodon of the pre-tRNA Leu (CAA). Nucleic Acids Res. 2006;34(20):6034-43. doi: 10.1093/nar/gkl765. Epub Oct. 27, 2006.
Buchschacher et al., Human immunodeficiency virus vectors for inducible expression of foreign genes. J Virol. May 1992;66(5):2731-9. doi: 10.1128/JVI.66.5.2731-2739.1992.
Buckley et al., Targeting the von Hippel-Lindau E3 ubiquitin ligase using small molecules to disrupt the VHL/HIF-1? interaction. J Am Chem Soc. Mar. 14, 2012;134(10):4465-8. doi: 10.1021/ja209924v. Epub Feb. 27, 2012.
Budker et al., Protein/amphipathic polyamine complexes enable highly efficient transfection with minimal toxicity. Biotechniques. Jul. 1997;23(1):139, 142-7. doi: 10.2144/97231rr02.
Budworth et al., A brief history of triplet repeat diseases. Methods Mol Biol. 2013;1010:3-17. doi: 10.1007/978-1-62703-411-1_1.
Burke et al., RNA Aptamers to the Adenosine Moiety of S-adenosyl Methionine: Structural Inferences From Variations on a Theme and the Reproducibility of SELEX. Nucleic Acids Res. May 15, 1997;25(10):2020-4. doi: 10.1093/nar/25.10.2020.
Burton et al., Gene delivery using herpes simplex virus vectors. DNA Cell Biol. Dec. 2002;21(12):915-36. doi: 10.1089/104454902762053864.
Buskirk et al., In vivo evolution of an RNA-based transcriptional activator. Chem Biol. Jun. 2003;10(6):533-40. doi: 10.1016/s1074-5521(03)00109-1.
Butt et al., Efficient CRISPR/Cas9-Mediated Genome Editing Using a Chimeric Single-Guide RNA Molecule. Front Plant Sci. Aug. 24, 2017;8:1441(1-8). doi: 10.3389/fpls.2017.01441.
Byrne et al., Multiplex gene regulation: a two-tiered approach to transgene regulation in transgenic mice. Proc Natl Acad Sci U S A. Jul. 1989;86(14):5473-7. doi: 10.1073/pnas.86.14.5473.
Cadwell et al., Randomization of genes by PCR mutagenesis. PCR Methods Appl. Aug. 1992;2(1):28-33. doi: 10.1101/gr.2.1.28.
Cai et al., Reconstruction of ancestral protein sequences and its applications. BMC Evol Biol. Sep. 17, 2004;4:33. doi: 10.1186/1471-2148-4-33.
Calame et al., Transcriptional controlling elements in the immunoglobulin and T cell receptor loci. Adv Immunol. 1988;43:235-75. doi: 10.1016/s0065-2776(08)60367-3.
Camarero et al., Biosynthesis of a Head-to-Tail Cyclized Protein with Improved Biological Activity. J. Am. Chem. Soc. May 29, 1999; 121(23):5597-5598. https://doi.org/10.1021/ja990929n.

(56) References Cited

OTHER PUBLICATIONS

Camper et al., Postnatal repression of the alpha-fetoprotein gene is enhancer independent. Genes Dev. Apr. 1989;3(4):537-46. doi: 10.1101/gad.3.4.537.

Camps et al., Targeted gene evolution in *Escherichia coli* using a highly error-prone DNA polymerase I. Proc Natl Acad Sci U S A. Aug. 19, 2003;100(17):9727-32. Epub Aug. 8, 2003.

Canchaya et al., Genome analysis of an inducible prophage and prophage remnants integrated in the *Streptococcus pyogenes* strain SF370. Virology. Oct. 25, 2002;302(2):245-58. doi: 10.1006/viro.2002.1570.

Canver et al., Customizing the genome as therapy for the ?-hemoglobinopathies. Blood. May 26, 2016;127(21):2536-45. doi: 10.1182/blood-2016-01-678128. Epub Apr. 6, 2016.

Carlier et al., Burkholderia cenocepacia H111 Rhy-family protein. Apr. 16, 2015. Retrieved from the Internet via https://www.ebi.ac.uk/ena/browser/api/embl/CDN65395.1?lineLimit=1000. Last retrieved Apr. 26, 2021.

Carlson et al., Negative selection and stringency modulation in phage-assisted continuous evolution. Nat Chem Biol. Mar. 2014;10(3):216-22. doi: 10.1038/nchembio.1453. Epub Feb. 2, 2014. With Supplementary Results.

Carr et al., Genome engineering. Nat Biotechnol. Dec. 2009;27(12):1151-62. doi: 10.1038/nbt.1590.

Carvalho et al., Evolution in health and medicine Sackler colloquium: Genomic disorders: a window into human gene and genome evolution. Proc Natl Acad Sci U S A. Jan. 26, 2010;107 Suppl 1(Suppl 1):1765-71. doi: 10.1073/pnas.0906222107. Epub Jan. 13, 2010.

Caspi et al., Distribution of split DnaE inteins in cyanobacteria. Mol Microbiol. Dec. 2003;50(5):1569-77. doi: 10.1046/j.1365-2958.2003.03825.x.

Cattaneo et al., SEL1L affects human pancreatic cancer cell cycle and invasiveness through modulation of PTEN and genes related to cell-matrix interactions. Neoplasia. 2005;7(11):1030-1038.

Ceccaldi et al., Repair Pathway Choices and Consequences at the Double-Strand Break. Trends Cell Biol. Jan. 2016;26(1):52-64. doi: 10.1016/j.tcb.2015.07.009. Epub Oct. 1, 2015.

Chadalavada et al., Wild-type is the optimal sequence of the HDV ribozyme under cotranscriptional conditions. RNA. Dec. 2007;13(12):2189-201. doi: 10.1261/rna.778107. Epub Oct. 23, 2007.

Chalberg et al., Integration specificity of phage phiC31 integrase in the human genome. J Mol Biol. Mar. 17, 2006;357(1):28-48. doi: 10.1016/j.jmb.2005.11.098. Epub Dec. 22, 2005.

Chalberg et al., phiC31 integrase confers genomic integration and long-term transgene expression in rat retina. Invest Ophthalmol Vis Sci. Jun. 2005;46(6):2140-6. doi: 10.1167/iovs.04-1252.

Chan et al., Molecular recording of mammalian embryogenesis. Nature. Jun. 2019;570(7759):77-82. doi: 10.1038/s41586-019-1184-5. Epub May 13, 2019.

Chan et al., Novel selection methods for DNA-encoded chemical libraries. Curr Opin Chem Biol. 2015;26:55-61. doi:10.1016/j.cbpa.2015.02.010.

Chan et al., The choice of nucleotide inserted opposite abasic sites formed within chromosomal DNA reveals the polymerase activities participating in translesion DNA synthesis. DNA Repair (Amst). Nov. 2013;12(11):878-89. doi: 10.1016/j.dnarep.2013.07.008. Epub Aug. 26, 2013.

Chapman et al., Playing the end game: DNA double-strand break repair pathway choice. Mol Cell. Aug. 24, 2012;47(4):497-510. doi: 10.1016/j.molcel.2012.07.029.

Chari et al., Unraveling CRISPR-Cas9 genome engineering parameters via a library-on-library approach. Nat Methods. Sep. 2015;12(9):823-6. doi: 10.1038/nmeth.3473. Epub Jul. 13, 2015.

Chaturvedi et al., Stabilization of triple-stranded oligonucleotide complexes: use of probes containing alternating phosphodiester and stereo-uniform cationic phosphoramidate linkages. Nucleic Acids Res. Jun. 15, 1996;24(12):2318-23.

Chavez et al., Precise Cas9 targeting enables genomic mutation prevention. Jun. 14, 2016. doi:https://doi.org/10.1101/058974. [Preprint].

Chavez et al., Therapeutic applications of the PhiC31 integrase system. Curr Gene Ther. Oct. 2011;11(5):375-81. Review.

Chawla et al., An atlas of RNA base pairs involving modified nucleobases with optimal geometries and accurate energies. Nucleic Acids Res. Aug. 18, 2015;43(14):6714-29. doi: 10.1093/nar/gkv606. Epub Jun. 27, 2015.

Chen et al., Enhanced proofreading governs CRISPR-Cas9 targeting accuracy. Nature. Oct. 19, 2017;550(7676):407-410. doi: 10.1038/nature24268. Epub Sep. 20, 2017.

Chen et al., A general strategy for the evolution of bond-forming enzymes using yeast display. Proc Natl Acad Sci U S A. Jul. 12, 2011;108(28):11399-404. doi: 10.1073/pnas.1101046108. Epub Jun. 22, 2011.

Chen et al., Alterations in PMS2, MSH2 and MLH1 expression in human prostate cancer. Int J Oncol. May 2003;22(5):1033-43.

Chen et al., Enhanced prime editing systems by manipulating cellular determinants of editing outcomes. Cell. Oct. 28, 2021;184(22):5635-5652.e29. doi: 10.1016/j.cell.2021.09.018. Epub Oct. 14, 2021.

Chen et al., Genome-wide CRISPR screen in a mouse model of tumor growth and metastasis. Cell. Mar. 12, 2015;160(6):1246-60. doi: 10.1016/j.cell.2015.02.038. Epub Mar. 5, 2015.

Chen et al., Highly Efficient Mouse Genome Editing by CRISPR Ribonucleoprotein Electroporation of Zygotes. J Biol Chem. Jul. 8, 2016;291(28):14457-67. doi: 10.1074/jbc.M116.733154. Epub May 5, 2016.

Chen et al., m(6)A RNA methylation is regulated by microRNAs and promotes reprogramming to pluripotency. Cell Stem Cell. Mar. 5, 2015;16(3):289-301. doi: 10.1016/j.stem.2015.01.016. Epub Feb. 12, 2015.

Chen et al., Targeting genomic rearrangements in tumor cells through Cas9-mediated insertion of a suicide gene. Nat Biotechnol. Jun. 2017;35(6):543-550. doi: 10.1038/nbt.3843. Epub May 1, 2017.

Cheng et al., Multiplexed activation of endogenous genes by CRISPR-on, an RNA-guided transcriptional activator system. Cell Res. Oct. 2013;23(10):1163-71. doi: 10.1038/cr.2013.122. Epub Aug. 27, 2013.

Chester et al., The apolipoprotein B mRNA editing complex performs a multifunctional cycle and suppresses nonsense-mediated decay. Embo J. Aug. 1, 2003;22(15):3971-82. doi: 10.1093/emboj/cdg369.

Chew et al., A multifunctional AAV-CRISPR-Cas9 and its host response. Nat Methods. Oct. 2016;13(10):868-74. doi: 10.1038/nmeth.3993. Epub Sep. 5, 2016. Supplementary Information.

Chin, Expanding and reprogramming the genetic code of cells and animals. Annu Rev Biochem. 2014;83:379-408. doi: 10.1146/annurev-biochem-060713-035737. Epub Feb. 10, 2014.

Cho et al., Site-specific recombination of bacteriophage P22 does not require integration host factor. J Bacteriol. Jul. 1999;181(14):4245-9. doi: 10.1128/JB.181.14.4245-4249.1999.

Cho et al., The calcium-activated chloride channel anoctamin 1 acts as a heat sensor in nociceptive neurons. Nat Neurosci. May 27, 2012;15(7):1015-21. doi: 10.1038/nn.3111.

Choe et al., Forging Ahead through Darkness: PCNA, Still the Principal Conductor at the Replication Fork. Mol Cell. Feb. 2, 2017;65(3):380-392. doi: 10.1016/j.molcel.2016.12.020.

Choi et al., (6)-methyladenosine in mRNA disrupts tRNA selection and translation-elongation dynamics. Nat Struct Mol Biol. Feb. 2016;23(2):110-5. doi: 10.1038/nsmb.3148. Epub Jan. 11, 2016.

Choi et al., Protein trans-splicing and characterization of a split family B-type DNA polymerase from the hyperthermophilic archaeal parasite Nanoarchaeum equitans. J Mol Biol. Mar. 10, 2006;356(5):1093-106. doi: 10.1016/j.jmb.2005.12.036. Epub Dec. 27, 2005.

Choi et at., Translesion synthesis across abasic lesions by human B-family and Y-family DNA polymerases ?, ?, ?, ?, ?, and REV1. J Mol Biol. Nov. 19, 2010;404(1):34-44. doi: 10.1016/j.jmb.2010.09.015. Epub Oct. 1, 2010.

Chong et al., Modulation of protein splicing of the *Saccharomyces cerevisiae* vacuolar membrane ATPase intein. J Biol Chem. Apr. 24, 1998;273(17):10567-77. doi: 10.1074/jbc.273.17.10567.

(56) References Cited

OTHER PUBLICATIONS

Chong et al., Utilizing the C-terminal cleavage activity of a protein splicing element to purify recombinant proteins in a single chromatographic step. Nucleic Acids Res. Nov. 15, 1998;26(22):5109-15. doi: 10.1093/nar/26.22.5109.

Chong et al., Protein splicing involving the *Saccharomyces cerevisiae* VMA intein. The steps in the splicing pathway, side reactions leading to protein cleavage, and establishment of an in vitro splicing system. J Biol Chem. Sep. 6, 1996;271(36):22159-68. doi: 10.1074/jbc.271.36.22159.

Chong et al., Protein splicing of the *Saccharomyces cerevisiae* VMA intein without the endonuclease motifs. J Biol Chem. Jun. 20, 1997;272(25):15587-90. doi: 10.1074/jbc.272.25.15587.

Chong et al., Single-column purification of free recombinant proteins using a self-cleavable affinity tag derived from a protein splicing element. Gene. Jun. 19, 1997;192(2):271-81. doi: 10.1016/s0378-1119(97)00105-4.

Choudhury et al., CRISPR-dCas9 mediated TET1 targeting for selective DNA demethylation at BRCA1 promoter. Oncotarget. Jul. 19, 2016;7(29):46545-46556. doi: 10.18632/oncotarget.10234.

Choudhury et al., CRISPR/Cas9 recombineering-mediated deep mutational scanning of essential genes in *Escherichia coli*. Mol Syst Biol. Mar. 2020;16(3):e9265. doi: 10.15252/msb.20199265.

Choudhury et al., Engineering RNA endonucleases with customized sequence specificities. Nat Commun. 2012;3:1147. doi: 10.1038/ncomms2154.

Choulika et al., Induction of homologous recombination in mammalian chromosomes by using the I-SceI system of *Saccharomyces cerevisiae*. Mol Cell Biol. Apr. 1995;15(4):1968-73. doi: 10.1128/MCB.15.4.1968.

Christiansen et al., Characterization of the lactococcal temperate phage TP901-1 and its site-specific integration. J Bacteriol. Feb. 1994;176(4):1069-76. doi: 10.1128/jb.176.4.1069-1076.1994.

Chuai et al., DeepCRISPR: optimized CRISPR guide RNA design by deep learning. Genome Biol. Jun. 26, 2018;19(1):80. doi: 10.1186/s13059-018-1459-4.

Chuai et al., In Silico Meets In Vivo: Towards Computational CRISPR-Based sgRNA Design. Trends Biotechnol. Jan. 2017;35(1):12-21. doi: 10.1016/j.tibtech.2016.06.008. Epub Jul. 11, 2016.

Chuang et al., Novel Heterotypic Rox Sites for Combinatorial Dre Recombination Strategies. G3 (Bethesda). Dec. 29, 2015;6(3):559-71. doi: 10.1534/g3.115.025841.

Chujo et al., Trmt61B is a methyltransferase responsible for 1-methyladenosine at position 58 of human mitochondrial tRNAs. RNA. Dec. 2012;18(12):2269-76. doi: 10.1261/rna.035600.112. Epub Oct. 24, 2012.

Clackson et al., Redesigning an FKBP-ligand interface to generate chemical dimerizers with novel specificity. Proc Natl Acad Sci U S A. Sep. 1, 1998;95(18):10437-42. doi: 10.1073/pnas.95.18.10437.

Clement et al., CRISPResso2 provides accurate and rapid genome editing sequence analysis. Nat Biotechnol. Mar. 2019;37(3):224-226. doi: 10.1038/s41587-019-0032-3.

Coffey et al., The Economic Impact of BSE on the U.S. Beef Industry: Product Value Losses, Regulatory Costs, and Consumer Reactions. Kansas State University Agricultural Experiment Station and Cooperative Extension Service. MF-2678. May 2005. 68 pages. Accessed via https://bookstore.ksre.ksu.edu/pubs/MF2678.pdf.

Cokol et al., Finding nuclear localization signals. EMBO Rep. Nov. 2000;1(5):411-5. doi: 10.1093/embo-reports/kvd092.

Cole et al., Reconstructing evolutionary adaptive paths for protein engineering. Methods Mol Biol. 2013;978:115-25. doi: 10.1007/978-1-62703-293-3_8.

Collinge, Prion diseases of humans and animals: their causes and molecular basis. Annu Rev Neurosci. 2001;24:519-50. doi: 10.1146/annurev.neuro.24.1.519.

Conrad et al., A Kaposi's sarcoma virus RNA element that increases the nuclear abundance of intronless transcripts. EMBO J. May 18, 2005;24(10):1831-41. doi: 10.1038/sj.emboj.7600662. Epub Apr. 28, 2005.

Cornu et al., Refining strategies to translate genome editing to the clinic. Nat Med. Apr. 3, 2017;23(4):415-423. doi: 10.1038/nm.4313.

Costa et al., Frequent use of the same tertiary motif by self-folding RNAs. EMBO J. Mar. 15, 1995;14(6):1276-85.

Cotton et al., Insertion of a Synthetic Peptide into a Recombinant Protein Framework: A Protein Biosensor. J. Am. Chem. Soc. Jan. 22, 1999; 121(5):1100-1. https://doi.org/10.1021/ja983804b.

Cox et al., An SCN9A channelopathy causes congenital inability to experience pain. Nature. Dec. 14, 2006;444(7121):894-8. doi: 10.1038/nature05413.

Cox et al., Congenital insensitivity to pain: novel SCN9A missense and in-frame deletion mutations. Hum Mutat. Sep. 2010;31(9):E1670-86. doi: 10.1002/humu.21325.

Cox et al., RNA editing with CRISPR-Cas13. Science. Nov. 24, 2017;358(6366):1019-1027. doi: 10.1126/science.aaq0180. Epub Oct. 25, 2017.

Cox, Proteins pinpoint double strand breaks. Elife. Oct. 29, 2013;2:e01561. doi: 10.7554/eLife.01561.

Crabtree et al., Three-part inventions: intracellular signaling and induced proximity. Trends Biochem Sci. Nov. 1996;21(11):418-22. doi: 10.1016/s0968-0004(96)20027-1.

Crick, On protein synthesis. Symp Soc Exp Biol. 1958;12:138-63.

Crystal, Transfer of genes to humans: early lessons and obstacles to success. Science. Oct. 20, 1995;270(5235):404-10. doi: 10.1126/science.270.5235.404.

Cui et al., Consequences of Cas9 cleavage in the chromosome of *Escherichia coli*. Nucleic Acids Res. May 19, 2016;44(9):4243-51. doi: 10.1093/nar/gkw223. Epub Apr. 8, 2016.

Cui et al., m6A RNA Methylation Regulates the Self-Renewal and Tumorigenesis of Glioblastoma Stem Cells. Cell Rep. Mar. 14, 2017;18(11):2622-2634. doi: 10.1016/j.celrep.2017.02.059.

Cui et al., Review of CRISPR/Cas9 sgRNA Design Tools. Interdiscip Sci. Jun. 2018;10(2):455-465. doi: 10.1007/s12539-018-0298-z. Epub Apr. 11, 2018.

Cupples et al., A set of lacZ mutations in *Escherichia coli* that allow rapid detection of each of the six base substitutions. Proc Natl Acad Sci U S A. Jul. 1989;86(14):5345-9.

Dahlgren et al., A novel mutation in ribosomal protein S4 that affects the function of a mutated RF1. Biochimie. Aug. 2000;82(8):683-91.

Dahlman et al., Orthogonal gene knockout and activation with a catalytically active Cas9 nuclease. Nat Biotechnol. Nov. 2015;33(11):1159-61. doi: 10.1038/nbt.3390.

Dandage et al., beditor: A Computational Workflow for Designing Libraries of Guide RNAs for CRISPR-Mediated Base Editing. Genetics. Jun. 2019;212(2):377-385. doi: 10.1534/genetics.119.302089. Epub Apr. 1, 2019.

Dang et al., Optimizing sgRNA structure to improve CRISPR-Cas9 knockout efficiency. Genome Biol. Dec. 15, 2015;16:280. doi: 10.1186/s13059-015-0846-3.

Das et al., The crystal structure of the monomeric reverse transcriptase from Moloney murine leukemia virus. Structure. May 2004;12(5):819-29. doi: 10.1016/j.str.2004.02.032.

Dassa et al., Fractured genes: a novel genomic arrangement involving new split inteins and a new homing endonuclease family. Nucleic Acids Res. May 2009;37(8):2560-73. doi: 10.1093/nar/gkp095. Epub Mar. 5, 2009.

Dassa et al., Trans protein splicing of cyanobacterial split inteins in endogenous and exogenous combinations. Biochemistry. Jan. 9, 2007;46(1):322-30. doi: 10.1021/bi0611762.

Database EBI Accession No. ADE34233 Jan. 29, 2004.

Database EBI Accession No. BFF09785. May 31, 2018. 2 pages.

Database EBI Accession No. BGE38086. Jul. 25, 2019. 2 pages.

Database UniProt Accession No. G8I3E0. Jan. 14, 2012.

Datsenko et al., One-step inactivation of chromosomal genes in *Escherichia coli* K-12 using PCR products. Proc Natl Acad Sci U S A. Jun. 6, 2000;97(12):6640-5.

Davidson et al., Viral vectors for gene delivery to the nervous system. Nat Rev Neurosci. May 2003;4(5):353-64. doi: 10.1038/nrn1104.

De Felipe et al., Co-translational, intraribosomal cleavage of polypeptides by the foot-and-mouth disease virus 2A peptide. J Biol

(56) References Cited

OTHER PUBLICATIONS

Chem. Mar. 28, 2003;278(13):11441-8. doi: 10.1074/jbc. M211644200. Epub Jan. 8, 2003.

De La Peña et al., The Hammerhead Ribozyme: A Long History for a Short RNA. Molecules. Jan. 4, 2017;22(1):78. doi: 10.3390/molecules22010078.

De Wit et al., The Human CD4+ T Cell Response against Mumps Virus Targets a Broadly Recognized Nucleoprotein Epitope. J Virol. Mar. 5, 2019;93(6):e01883-18. doi: 10.1128/JVI.01883-18.

Dean et al., Genetic restriction of HIV-1 infection and progression to AIDS by a deletion allele of the CKR5 structural gene. Hemophilia Growth and Development Study, Multicenter AIDS Cohort Study, Multicenter Hemophilia Cohort Study, San Francisco City Cohort, ALIVE Study. Science. Sep. 27, 1996;273(5283):1856-62. doi: 10.1126/science.273.5283.1856.

Dekosky et al., Large-scale sequence and structural comparisons of human naive and antigen-experienced antibody repertoires. Proc Natl Acad Sci U S A. May 10, 2016;113(19):E2636-45. doi: 10.1073/pnas.1525510113. Epub Apr. 25, 2016.

Delebecque et al., Organization of intracellular reactions with rationally designed RNA assemblies. Science. Jul. 22, 2011;333(6041):470-4. doi: 10.1126/science.1206938. Epub Jun. 23, 2011.

Deng et al., Widespread occurrence of N6-methyladenosine in bacterial mRNA. Nucleic Acids Res. Jul. 27, 2015;43(13):6557-67. doi: 10.1093/nar/gkv596. Epub Jun. 11, 2015.

Denizio et al., Harnessing natural DNA modifying activities for editing of the genome and epigenome. Curr Opin Chem Biol. Aug. 2018;45:10-17. doi: 10.1016/j.cbpa.2018.01.016. Epub Feb. 13, 2018.

Deriano et al., Modernizing the nonhomologous end-joining repertoire: alternative and classical NHEJ share the stage. Annu Rev Genet. 2013;47:433-55. doi: 10.1146/annurev-genet-110711-155540. Epub Sep. 11, 2013.

Deussing, Targeted mutagenesis tools for modelling psychiatric disorders. Cell Tissue Res. Oct. 2013;354(1):9-25. doi: 10.1007/s00441-013-1708-5. Epub Sep. 10, 2013.

Dever et al., CRISPR/Cas9 ?-globin gene targeting in human haematopoietic stem cells. Nature. Nov. 17, 2016;539(7629):384-389. doi: 10.1038/nature20134. Epub Nov. 7, 2016.

Deverman et al., Cre-dependent selection yields AAV variants for widespread gene transfer to the adult brain. Nat Biotechnol. Feb. 2016;34(2):204-9. doi: 10.1038/nbt.3440. Epub Feb. 1, 2016.

Devigili et al., Paroxysmal itch caused by gain-of-function Nav1.7 mutation. Pain. Sep. 2014;155(9):1702-1707. doi: 10.1016/j.pain.2014.05.006. Epub May 10, 2014.

Dianov et al., Mammalian base excision repair: the forgotten archangel. Nucleic Acids Res. Apr. 1, 2013;41(6):3483-90. doi: 10.1093/nar/gkt076. Epub Feb. 13, 2013.

Dicarlo et al., Genome engineering in *Saccharomyces cerevisiae* using CRISPR-Cas systems. Nucleic Acids Res. Apr. 2013;41(7):4336-43. doi: 10.1093/nar/gkt135. Epub Mar. 4, 2013.

Dicarlo et al., Safeguarding CRISPR-Cas9 gene drives in yeast. Nat Biotechnol. Dec. 2015;33(12):1250-1255. doi: 10.1038/nbt.3412. Epub Nov. 16, 2015.

Dickey et al., Single-stranded DNA-binding proteins: multiple domains for multiple functions. Structure. Jul. 2, 2013;21(7):1074-84. doi: 10.1016/j.str.2013.05.013.

Dickinson et al., Experimental interrogation of the path dependence and stochasticity of protein evolution using phage-assisted continuous evolution. Proc Natl Acad Sci USA. May 2013;110(22):9007-12.

Dillon, Regulating gene expression in gene therapy. Trends Biotechnol. May 1993;11(5):167-73. doi: 10.1016/0167-7799(93)90109-M.

Dingwall et al., Nuclear targeting sequences—a consensus? Trends Biochem Sci. Dec. 1991;16(12):478-81. doi: 10.1016/0968-0004(91)90184-w.

Diver et al., Single-Step Synthesis of Cell-Permeable Protein Dimerizers That Activate Signal Transduction and Gene Expression. J. Am. Chem. Soc. Jun. 4, 1997;119(22):5106-5109. https://doi.org/10.1021/ja963891c.

Doench et al., Rational design of highly active sgRNAs for CRISPR-Cas9-mediated gene inactivation. Nat Biotechnol. Dec. 2014;32(12):1262-7. doi: 10.1038/nbt.3026. Epub Sep. 3, 2014.

Dolan et al., Trans-splicing with the group I intron ribozyme from Azoarcus. RNA. Feb. 2014;20(2):202-13. doi: 10.1261/rna.041012.113. Epub Dec. 16, 2013.

Doman et al., Evaluation and minimization of Cas9-independent off-target DNA editing by cytosine base editors. Nat Biotechnol. May 2020;38(5):620-628. doi: 10.1038/s41587-020-0414-6. Epub Feb. 10, 2020.

Dominissini et al., Topology of the human and mouse m6A RNA methylomes revealed by m6A-seq. Nature. Apr. 29, 2012;485(7397):201-6. doi: 10.1038/nature11112.

Dorgan et al., An enzyme-coupled continuous spectrophotometric assay for S-adenosylmethionine-dependent methyltransferases. Anal Biochem. Mar. 15, 2006;350(2):249-55. doi: 10.1016/j.ab.2006.01.004. Epub Feb. 7, 2006.

Dorr et al., Reprogramming the specificity of sortase enzymes. Proc Natl Acad Sci U S A. Sep. 16, 2014;111(37):13343-8. doi: 10.1073/pnas.1411179111. Epub Sep. 3, 2014.

Doudna, The promise and challenge of therapeutic genome editing. Nature. Feb. 2020;578(7794):229-236. doi: 10.1038/s41586-020-1978-5. Epub Feb. 12, 2020.

Dove et al., Conversion of the omega subunit of *Escherichia coli* RNA polymerase into a transcriptional activator or an activation target. Genes Dev. Mar. 1, 1998;12(5):745-54.

Doyon et al., Directed evolution and substrate specificity profile of homing endonuclease I-SceI. J Am Chem Soc. Feb. 22, 2006;128(7):2477-84.

Drake, A constant rate of spontaneous mutation in DNA-based microbes. Proc Natl Acad Sci USA. Aug. 15, 1991;88(16):7160-4.

Duan et al., Enhancement of muscle gene delivery with pseudotyped adeno-associated virus type 5 correlates with myoblast differentiation. J Virol. Aug. 2001;75(16):7662-71. doi: 10.1128/JVI.75.16.7662-7671.2001.

Dubois et al., Retroviral RNA Dimerization: From Structure to Functions. Front Microbiol. Mar. 22, 2018;9:527. doi: 10.3389/fmicb.2018.00527.

Dunbar et al., Gene therapy comes of age. Science. Jan. 12, 2018;359(6372):eaan4672. doi: 10.1126/science.aan4672.

Dupuy et al., Le syndrome de De La Chapelle [De La Chapelle syndrome]. Presse Med. Mar. 3, 2001;30(8):369-72. French.

Durai et al., A bacterial one-hybrid selection system for interrogating zinc finger-DNA interactions. Comb Chem High Throughput Screen. May 2006;9(4):301-11.

Durai et al., Zinc finger nucleases: custom-designed molecular scissors for genome engineering of plant and mammalian cells. Nucleic Acids Res. Oct. 26, 2005;33(18):5978-90. doi: 10.1093/nar/gki912.

Edlund et al., Cell-specific expression of the rat insulin gene: evidence for role of two distinct 5' flanking elements. Science. Nov. 22, 1985;230(4728):912-6. doi: 10.1126/science.3904002.

Eick et al., Robustness of Reconstructed Ancestral Protein Functions to Statistical Uncertainty. Mol Biol Evol. Feb. 1, 2017;34(2):247-261. doi: 10.1093/molbev/msw223.

Eiler et al., Structural Basis for the Fast Self-Cleavage Reaction Catalyzed by the Twister Ribozyme. Proc Natl Acad Sci U S A. Sep. 9, 2014;111(36):13028-33. doi: 10.1073/pnas.1414571111. Epub Aug. 25, 2014.

Emery et al., HCN2 ion channels play a central role in inflammatory and neuropathic pain. Science. Sep. 9, 2011;333(6048):1462-6. doi: 10.1126/science.1206243.

Engel et al., The emerging role of mRNA methylation in normal and pathological behavior. Genes Brain Behav. Mar. 2018;17(3):e12428. doi: 10.1111/gbb.12428. Epub Nov. 17, 2017.

Engelward et al., Base excision repair deficient mice lacking the Aag alkyladenine DNA glycosylase. Proc Natl Acad Sci U S A. Nov. 25, 1997;94(24):13087-92.

(56) References Cited

OTHER PUBLICATIONS

England, Unnatural amino acid mutagenesis: a precise tool for probing protein structure and function. Biochemistry. Sep. 21, 2004;43(37):11623-9.

Enyeart et al., Biotechnological applications of mobile group II introns and their reverse transcriptases: gene targeting, RNA-seq, and non-coding RNA analysis. Mobile DNA 5, 2 (2014). https://doi.org/10.1186/1759-8753-5-2. https://doi.org/10.1186/1759-8753-5-2.

Epstein, HSV-1-based amplicon vectors: design and applications. Gene Ther. Oct. 2005;12 Suppl 1:S154-8. doi: 10.1038/sj.gt.3302617.

Eriksson et al., Recurrent de novo point mutations in lamin A cause Hutchinson-Gilford progeria syndrome. Nature. May 15, 2003;423(6937):293-8. doi: 10.1038/nature01629. Epub Apr. 25, 2003. PMID: 12714972.

Estacion et al., A sodium channel gene SCN9A polymorphism that increases nociceptor excitability. Ann Neurol. Dec. 2009;66(6):862-6. doi: 10.1002/ana.21895.

Evans et al., Protein trans-splicing and cyclization by a naturally split intein from the dnaE gene of *Synechocystis* species PCC6803. J Biol Chem. Mar. 31, 2000;275(13):9091-4. doi: 10.1074/jbc.275.13.9091.

Evans et al., Semisynthesis of cytotoxic proteins using a modified protein splicing element. Protein Sci. Nov. 1998;7(11):2256-64. doi: 10.1002/pro.5560071103.

Evans et al., The cyclization and polymerization of bacterially expressed proteins using modified self-splicing inteins. J Biol Chem. Jun. 25, 1999;274(26):18359-63. doi: 10.1074/jbc.274.26.18359.

Evans et al., The in vitro ligation of bacterially expressed proteins using an intein from Methanobacterium thermoautotrophicum. J Biol Chem. Feb. 12, 1999;274(7):3923-6. doi: 10.1074/jbc.274.7.3923.

Evers et al., CRISPR knockout screening outperforms shRNA and CRISPRi in identifying essential genes. Nat Biotechnol. Jun. 2016;34(6):631-3. doi: 10.1038/nbt.3536. Epub Apr. 25, 2016.

Extended European Search Report for EP 19181479.7, mailed Oct. 31, 2019.

Extended European Search Report for EP 19187331.4, mailed Mar. 25, 2020.

Extended European Search Report for EP18199195.1, mailed Feb. 12, 2019.

Falnes et al., DNA repair by bacterial AlkB proteins. Res Microbiol. Oct. 2003;154(8):531-8. doi: 10.1016/S0923-2508(03)00150-5.

Falnes et al., Repair of methyl lesions in DNA and RNA by oxidative demethylation. Neuroscience. Apr. 14, 2007;145(4):1222-32. doi: 10.1016/j.neuroscience.2006.11.018. Epub Dec. 18, 2006.

Farboud et al., Dramatic enhancement of genome editing by CRISPR/Cas9 through improved guide RNA design. Genetics. Apr. 2015;199(4):959-71. doi: 10.1534/genetics.115.175166. Epub Feb. 18, 2015.

Fawcett et al., Transposable elements controlling I-R hybrid dysgenesis in *D. melanogaster* are similar to mammalian LINEs. Cell. Dec. 26, 1986;47(6):1007-15. doi: 10.1016/0092-8674(86)90815-9.

Feldstein et al., Two sequences participating in the autolytic processing of satellite tobacco ringspot virus complementary RNA. Gene. Oct. 15, 1989;82(1):53-61. doi: 10.1016/0378-1119(89)90029-2.

Felletti et al., Twister Ribozymes as Highly Versatile Expression Platforms for Artificial Riboswitches. Nat Commun. Sep. 27, 2016;7:12834. doi: 10.1038/ncomms12834.

Feng et al., Crystal structures of the human RNA demethylase Alkbh5 reveal basis for substrate recognition. J Biol Chem. Apr. 25, 2014;289(17):11571-11583. doi: 10.1074/jbc.M113.546168. Epub Mar. 10, 2014.

Feng et al., Human L1 retrotransposon encodes a conserved endonuclease required for retrotransposition. Cell. Nov. 29, 1996;87(5):905-16. doi: 10.1016/s0092-8674(00)81997-2.

Ferreira Da Silva et al., Prime editing efficiency and fidelity are enhanced in the absence of mismatch repair. Nat Commun. Feb. 9, 2022;13(1):760. doi: 10.1038/s41467-022-28442-1.

Feuk, Inversion variants in the human genome: role in disease and genome architecture. Genome Med. Feb. 12, 2010;2(2):11. doi: 10.1186/gm132.

Filippov et al., A novel type of RNase III family proteins in eukaryotes. Gene. Mar. 7, 2000;245(1):213-21. doi: 10.1016/s0378-1119(99)00571-5.

Filippova et al., Guide RNA modification as a way to improve CRISPR/Cas9-based genome-editing systems. Biochimie. Dec. 2019;167:49-60. doi: 10.1016/j.biochi.2019.09.003. Epub Sep. 4, 2019.

Fire et al., Potent and specific genetic interference by double-stranded RNA in Caenorhabditis elegans. Nature. Feb. 19, 1998;391(6669):806-11. doi: 10.1038/35888.

Fischbach et al., Directed evolution can rapidly improve the activity of chimeric assembly-line enzymes. Proc Natl Acad Sci U S A. Jul. 17, 2007;104(29):11951-6. doi: 10.1073/pnas.0705348104. Epub Jul. 9, 2007.

Fitzjohn, Diversitree: comparative phylogenetic analyses of diversification in R. Methods in Evology and Evolution. Dec. 2012;3(6):1084-92 .doi: 10.1111/j.2041-210X.2012.00234.x.

Flajolet et al., Woodchuck hepatitis virus enhancer I and enhancer II are both involved in—myc2 activation in woodchuck liver tumors. J Virol. Jul. 1998;72(7):6175-80. doi: 10.1128/JVI.72.7.6175-6180.1998.

Flaman et al., A rapid PCR fidelity assay. Nucleic Acids Res. Aug. 11, 1994;22(15):3259-60. doi: 10.1093/nar/22.15.3259.

Flynn et al., CRISPR-mediated genotypic and phenotypic correction of a chronic granulomatous disease mutation in human iPS cells. Exp Hematol. Oct. 2015;43(10):838-848.e3. doi: 10.1016/j.exphem.2015.06.002. Epub Jun. 19, 2015. Including supplementary figures and data.

Fogg et al., New applications for phage integrases. J Mol Biol. Jul. 29, 2014;426(15):2703-16. doi: 10.1016/j.jmb.2014.05.014. Epub May 22, 2014.

Fogg et al., Genome Integration and Excision by a New Streptomyces Bacteriophage, ?Joe. Appl Environ Microbiol. Feb. 15, 2017;83(5):e02767-16. doi: 10.1128/AEM.02767-16.

Forster et al., Self-cleavage of virusoid RNA is performed by the proposed 55-nucleotide active site. Cell. Jul. 3, 1987;50(1):9-16. doi: 10.1016/0092-8674(87)90657-x.

Fortini et al., Different DNA polymerases are involved in the short- and long-patch base excision repair in mammalian cells. Biochemistry. Mar. 17, 1998;37(11):3575-80. doi: 10.1021/bi972999h.

Fouts et al., Sequencing Bacillus anthracis typing phages gamma and cherry reveals a common ancestry. J Bacteriol. May 2006;188(9):3402-8. doi: 10.1128/JB.188.9.3402-3408.2006.

Freitas et al., Mechanisms and signals for the nuclear import of proteins. Curr Genomics. Dec. 2009;10(8):550-7. doi: 10.2174/138920209789503941.

Fu et al., Promises and Pitfalls of Intracellular Delivery of Proteins. Bioconjugate Chemistry. Aug. 2014;25:1602-8.

Furukawa et al., In vitro selection of allosteric ribozymes that sense the bacterial second messenger c-di-GMP. Methods Mol Biol. 2014;1111:209-20. doi: 10.1007/978-1-62703-755-6_15.

Fusi et al., In Silico Predictive Modeling of CRISPR/Cas9 guide efficiency. Jun. 26, 2015; bioRxiv. http://dx.doi.org/10.1101/021568.

Gaj et al., 3rd. Genome engineering with custom recombinases. Methods Enzymol. 2014;546:79-91. doi: 10.1016/B978-0-12-801185-0.00004-0.

Gajula, Designing an Elusive CoG?GoC CRISPR Base Editor. Trends Biochem Sci. Feb. 2019;44(2):91-94. doi: 10.1016/j.tibs.2018.10.004. Epub Nov. 13, 2018.

Gangopadhyay et al., Precision Control of CRISPR-Cas9 Using Small Molecules and Light. Biochemistry. Jan. 29, 2019;58(4):234-244. doi: 10.1021/acs.biochem.8b01202. Epub Jan. 22, 2019.

Gao et al., Cationic liposome-mediated gene transfer. Gene Ther. Dec. 1995;2(10):710-22.

(56) References Cited

OTHER PUBLICATIONS

Gao et al., Prime editing in mice reveals the essentiality of a single base in driving tissue-specific gene expression. Genome Biol. Mar. 16, 2021;22(1):83. doi: 10.1186/s13059-021-02304-3.
Gao et al., Self-processing of ribozyme-flanked RNAs into guide RNAs in vitro and in vivo for CRISPR-mediated genome editing. J Integr Plant Biol. Apr. 2014;56(4):343-9. doi: 10.1111/jipb.12152. Epub Mar. 6, 2014.
Gao et al., Treatment of autosomal dominant hearing loss by in vivo delivery of genome editing agents. Nature. Jan. 11, 2018;553(7687):217-221. doi: 10.1038/nature25164. Epub Dec. 20, 2017.
Gapinske et al., CRISPR-SKIP: programmable gene splicing with single base editors. Genome Biol. Aug. 15, 2018;19(1):107. doi: 10.1186/s13059-018-1482-5.
Garcia et al., Transglycosylation: a mechanism for RNA modification (and editing?). Bioorg Chem. Jun. 2005;33(3):229-51. doi: 10.1016/j.bioorg.2005.01.001. Epub Feb. 23, 2005.
Garibyan et al., Use of the rpoB gene to determine the specificity of base substitution mutations on the *Escherichia coli* chromosome. DNA Repair (Amst). May 13, 2003;2(5):593-608.
Gaudelli et al., Programmable base editing of AoT to GoC in genomic DNA without DNA cleavage. Nature. Nov. 23, 2017;551(7681):464-471. doi: 10.1038/nature24644. Epub Oct. 25, 2017; Erratum in: Nature. May 2, 2018.
Gearing, Addgene blog. CRISPR 101: Cas9 nickase design and homology directed repair. 2018. pp. 1-12. https://blog.addgene.org/crispr-101-cas9-nickase-design-and-homlogy-directed-repair. Last retrieved online Jun. 25, 2021.
Gehrke et al., An APOBEC3A-Cas9 base editor with minimized bystander and off-target activities. Nat Biotechnol. Nov. 2018;36(10):977-982. doi: 10.1038/nbt.4199. Epub Jul. 30, 2018.
GenBank Accession No. J01600.1. Brooks et al., *E.coli* dam gene coding for DNA adenine methylase. Apr. 26, 1993.
GenBank Accession No. U07651.1. Lu, *Escherichia coli* K12 negative regulator of replication initiation (seqA) gene, complete cds. Jul. 19, 1994.
GenBank Submission; NIH/NCBI Accession No. 4UN5_B. Anders et al., Jul. 23, 2014. 5 pages.
GenBank Submission; NIH/NCBI Accession No. NM_001319224. 2. Umar et al., Apr. 21, 2021. 7 pages.
GenBank Submission; NIH/NCBI Accession No. NM_006027.4. Umar et al., Apr. 10, 2021. 7 pages.
GenBank Submission; NIH/NCBI, Accession No. AAA66622.1. Martinelli et al., May 18, 1995. 2 pages.
GenBank Submission; NIH/NCBI, Accession No. AGT42196. Farzadfar et al., Nov. 2, 2013. 2 pages.
GenBank Submission; NIH/NCBI, Accession No. AIT42264.1. Hyun et al., Oct. 15, 2014. 2 pages.
GenBank Submission; NIH/NCBI, Accession No. AKA60242.1. Tong et al., Apr. 5, 2015. 1 page.
GenBank Submission; NIH/NCBI, Accession No. AKQ21048.1. Gilles et al., Jul. 19, 2015. 1 page.
GenBank Submission; NIH/NCBI, Accession No. AKS40380.1. Nodvig et al., Aug. 2, 2015. 1 page.
GenBank Submission; NIH/NCBI, Accession No. APG80656.1. Burstein et al., Dec. 10, 2016. 1 pages.
GenBank Submission; NIH/NCBI, Accession No. AYD60528.1. Ram et al., Oct. 2, 2018. 1 page.
GenBank Submission; NIH/NCBI, Accession No. BDB43378. Zhang et al., Aug. 11, 2016. 2 pages.
GenBank Submission; NIH/NCBI, Accession No. KR710351.1. Sahni et al., Jun. 1, 2015. 2 pages.
GenBank Submission; NIH/NCBI, Accession No. NC 002737.2. Nasser et al., Feb. 7, 2021. 2 pages.
GenBank Submission; NIH/NCBI, Accession No. NM_000311.5. Alves et al., Mar. 7, 2021. 5 pages.
GenBank Submission; NIH/NCBI, Accession No. NM_001319224. Umar et al., Apr. 21, 2021. 7 pages.
GenBank Submission; NIH/NCBI, Accession No. NM_002945.3. Weiser et al., Sep. 3, 2017. 5 pages.
GenBank Submission; NIH/NCBI, Accession No. NM_002946.5. Kavli et al., Jun. 26, 2021. 5 pages.
GenBank Submission; NIH/NCBI, Accession No. NM_002947.4. Xiao et al., May 1, 2019. 4 pages.
GenBank Submission; NIH/NCBI, Accession No. NM_003686. Umar et al., Apr. 9, 2021. 7 pages.
GenBank Submission; NIH/NCBI, Accession No. NM_003686.4. Umar et al., Apr. 9, 2021. 7 pages.
GenBank Submission; NIH/NCBI, Accession No. NM_006027. Umar et al., Apr. 10, 2021. 7 pages.
GenBank Submission; NIH/NCBI, Accession No. NM_174936. Guo et al., Oct. 28, 2015. 6 pages.
GenBank Submission; NIH/NCBI, Accession No. NP_000302.1. Alves et al., Mar. 7, 2021. 4 pages.
GenBank Submission; NIH/NCBI, Accession No. NP_001243439. 1. Lee et al., Jul. 26, 2021. 4 pages.
GenBank Submission; NIH/NCBI, Accession No. NP_076161.2. Wade et al., Jun. 20, 2021. 4 pages.
GenBank Submission; NIH/NCBI, Accession No. NP_358988.1. Hoskins et al., Jan. 11, 2017. 2 pages.
GenBank Submission; NIH/NCBI, Accession No. NP_391970.1. Borriss et al., Feb. 12, 2021. 3 pages.
GenBank Submission; NIH/NCBI, Accession No. NP_628093.1. Hsiao et al., Aug. 3, 2016. 2 pages.
GenBank Submission; NIH/NCBI, Accession No. NP_955579.1. Chen et al., Aug. 13, 2018. 5 pages.
GenBank Submission; NIH/NCBI, Accession No. QBJ66766. Duan et al. Aug. 12, 2020. 2 pages.
GenBank Submission; NIH/NCBI, Accession No. RFF81513.1. Zhou et al., Aug. 21, 2018. 2 pages.
GenBank Submission; NIH/NCBI, Accession No. SNX31424.1. Weckx, S., Feb. 16, 2018. 2 pages.
GenBank Submission; NIH/NCBI, Accession No. TGH57013. Xu et al., Apr. 9, 2019. 2 pages.
GenBank Submission; NIH/NCBI, Accession No. WP_002989955. 1. No Author Listed, May 6, 2013. 1 page.
GenBank Submission; NIH/NCBI, Accession No. WP_010922251. 1. No Author Listed, May 15, 2013. 1 page.
GenBank Submission; NIH/NCBI, Accession No. WP_011054416. 1. No Author Listed, May 15, 2013. 1 page.
GenBank Submission; NIH/NCBI, Accession No. WP_011284745. 1. No Author Listed, May 16, 2013. 1 page.
GenBank Submission; NIH/NCBI, Accession No. WP_011285506. 1. No Author Listed, May 16, 2013. 1 page.
GenBank Submission; NIH/NCBI, Accession No. WP_011527619. 1. No Author Listed, May 16, 2013. 1 page.
GenBank Submission; NIH/NCBI, Accession No. WP_012560673. 1. No Author Listed, May 17, 2013. 1 page.
GenBank Submission; NIH/NCBI, Accession No. WP_014407541. 1. No Author Listed, May 18, 2013. 1 page.
GenBank Submission; NIH/NCBI, Accession No. WP_016631044. 1. Haft et al., Sep. 22, 2020. 1 page.
GenBank Submission; NIH/NCBI, Accession No. WP_020905136. 1. No Author Listed, Jul. 25, 2013. 1 page.
GenBank Submission; NIH/NCBI, Accession No. WP_023080005. 1. No Author Listed, Oct. 27, 2013. 1 page.
GenBank Submission; NIH/NCBI, Accession No. WP_023610282. 1. No Author Listed, Nov. 27, 2013. 1 page.
GenBank Submission; NIH/NCBI, Accession No. WP_030125963. 1. No Author Listed, Jul. 9, 2014. 1 page.
GenBank Submission; NIH/NCBI, Accession No. WP_030126706. 1. No Author Listed, Jul. 9, 2014. 1 page.
GenBank Submission; NIH/NCBI, Accession No. WP_031386437. No Author Listed., Sep. 23, 2019. 1 page.
GenBank Submission; NIH/NCBI, Accession No. WP_031386437. 1. No Author Listed., Sep. 23, 2019. 1 page.
GenBank Submission; NIH/NCBI, Accession No. WP_031488318. 1. No Author Listed., Aug. 5, 2014. 1 page.
GenBank Submission; NIH/NCBI, Accession No. WP_031589969. 1. Haft et al., Oct. 9, 2019. 2 pages.
GenBank Submission; NIH/NCBI, Accession No. WP_032460140. 1. No Author Listed, Oct. 4, 2014. 1 page.

(56) References Cited

OTHER PUBLICATIONS

GenBank Submission; NIH/NCBI, Accession No. WP_032461047. 1. No Author Listed, Oct. 4, 2014. 1 page.
GenBank Submission; NIH/NCBI, Accession No. WP_032462016. 1. Haft et al., Oct. 4, 2014. 1 page.
GenBank Submission; NIH/NCBI, Accession No. WP_032462936. 1. No Author Listed, Oct. 4, 2014. 1 page.
GenBank Submission; NIH/NCBI, Accession No. WP_032464890. 1. No Author Listed, Oct. 4, 2014. 1 page.
GenBank Submission; NIH/NCBI, Accession No. WP_038431314. 1. No Author Listed, Dec. 26, 2014. 1 page.
GenBank Submission; NIH/NCBI, Accession No. WP_038432938. 1. No Author Listed, Dec. 26, 2014. 1 page.
GenBank Submission; NIH/NCBI, Accession No. WP_038434062. 1. No Author Listed, Dec. 26, 2014. 1 page.
GenBank Submission; NIH/NCBI, Accession No. WP_044924278. 1. Haft et al., Oct. 9, 2019. 2 pages.
GenBank Submission; NIH/NCBI, Accession No. WP_047338501. 1. Haft et al., Oct. 9, 2019. 2 pages.
GenBank Submission; NIH/NCBI, Accession No. WP_048327215. 1. No Author Listed, Jun. 26, 2015. 1 page.
GenBank Submission; NIH/NCBI, Accession No. WP_049519324. 1. No Author Listed, Jul. 20, 2015. 1 page.
GenBank Submission; NIH/NCBI, Accession No. WP_060798984. 1. Haft et al., Oct. 9, 2019. 2 pages.
GenBank Submission; NIH/NCBI, Accession No. WP_062913273. 1. Haft et al., Oct. 9, 2019. 2 pages.
GenBank Submission; NIH/NCBI, Accession No. WP_072754838. No Author Listed., Sep. 23, 2019. 1 page.
GenBank Submission; NIH/NCBI, Accession No. WP_095142515. 1. No Author Listed., Sep. 23, 2019. 1 page.
GenBank Submission; NIH/NCBI, Accession No. WP_118538418. 1. No Author Listed., Oct. 13, 2019. 1 page.
GenBank Submission; NIH/NCBI, Accession No. WP_119223642. 1. No Author Listed., Oct. 13, 2019. 1 page.
GenBank Submission; NIH/NCBI, Accession No. WP_119227726. 1. No Author Listed., Oct. 13, 2019. 1 page.
GenBank Submission; NIH/NCBI, Accession No. WP_119623382. 1. No Author Listed., Oct. 13, 2019. 1 page.
GenBank Submission; NIH/NCBI, Accession No. WP_132221894. 1. No Author Listed., Sep. 23, 2019. 1 page.
GenBank Submission; NIH/NCBI, Accession No. WP_133478044. 1. Haft et al., Oct. 9, 2019. 2 pages.
GenBank Submission; NIH/NCBI, Accession No. YP_002004532. 1. Villegas et al., Oct. 11, 2021. 2 pages.
GenBank Submission; NIH/NCBI, Accession No. YP_006589943. 1. Lynch et al., Oct. 15, 2021. 2 pages.
GenBank Submission; NIH/NCBI, Accession No. YP_009137104. 1. Davison, Aug. 13, 2018. 2 pages.
GenBank Submission; NIH/NCBI, Accession No. YP_009283008. 1. Bernardini et al., Sep. 23, 2016. 2 pages.
George et al., Adenosine deaminases acting on RNA, RNA editing, and interferon action. J Interferon Cytokine Res. Jan. 2011;31(1):99-117. doi: 10.1089/jir.2010.0097. Epub Dec. 23, 2010. PMID: 21182352; PMCID: PMC3034097.
Gerard et al., Influence on stability in *Escherichia coli* of the carboxy-terminal structure of cloned Moloney murine leukemia virus reverse transcriptase. DNA. Aug. 1986;5(4):271-9. doi: 10.1089/dna.1986.5.271.
Gerard et al., Purification and characterization of the DNA polymerase and RNase H activities in Moloney murine sarcoma-leukemia virus. J Virol. Apr. 1975;15(4):785-97. doi: 10.1128/JVI.15.4.785-797.1975.
Gerard et al., The role of template-primer in protection of reverse transcriptase from thermal inactivation. Nucleic Acids Res. Jul. 15, 2002;30(14):3118-29. doi: 10.1093/nar/gkf417.
Gerber et al., An adenosine deaminase that generates inosine at the wobble position of tRNAs. Science. Nov. 5, 1999;286(5442):1146-9. doi: 10.1126/science.286.5442.1146.
Gete et al., Mechanisms of angiogenic incompetence in Hutchinson-Gilford progeria via downregulation of endothelial NOS. Aging Cell. Jul. 2021;20(7):e13388. doi: 10.1111/acel.13388. Epub Jun. 4, 2021.
Ghahfarokhi et al., Blastocyst Formation Rate and Transgene Expression are Associated with Gene Insertion into Safe and Non-Safe Harbors in the Cattle Genome. Sci Rep. Nov. 13, 2017;7(1): 15432. doi: 10.1038/s41598-017-15648-3.
Gibson et al., Enzymatic assembly of DNA molecules up to several hundred kilobases. Nat Methods. May 2009;6(5):343-5. doi: 10.1038/nmeth.1318. Epub Apr. 12, 2009.
Gil, Position-dependent sequence elements downstream of AAUAAA are required for efficient rabbit beta-globin mRNA 3' end formation. Cell. May 8, 1987;49(3):399-406. doi: 10.1016/0092-8674(87)90292-3.
Glasgow et al.,DNA-binding properties of the Hin recombinase. J Biol Chem. Jun. 15, 1989;264(17):10072-82.
Glassner et al., Generation of a strong mutator phenotype in yeast by imbalanced base excision repair. Proc Natl Acad Sci U S A. Aug. 18, 1998;95(17):9997-10002.
Goldberg et al., Epigenetics: a landscape takes shape. Cell. Feb. 23, 2007;128(4):635-8. doi: 10.1016/j.cell.2007.02.006.
Goldberg et al., Loss-of-function mutations in the Nav1.7 gene underlie congenital indifference to pain in multiple human populations. Clin Genet. Apr. 2007;71(4):311-9. doi: 10.1111/j.1399-0004.2007.00790.x.
Gong et al., Active DNA demethylation by oxidation and repair. Cell Res. Dec. 2011;21(12):1649-51. doi: 10.1038/cr.2011.140. Epub Aug. 23, 2011.
Goodnough et al., Development of a delivery vehicle for intracellular transport of botulinum neurotoxin antagonists. FEBS Lett. Feb. 27, 2002;513(2-3):163-8.
Gou et al., Designing single guide RNA for CIRSPR-Cas9 base editor by deep learning. Peer reviewed Thesis/Dissertation. UCLA Electronic Theses and Dissertations. Jan. 1, 2019. Retrieved from the Internet via https://escholarship.org/uc/item/7vf9z54t. Last accessed on Apr. 29, 2021.
Grainge et al., The integrase family of recombinase: organization and function of the active site. Mol Microbiol. Aug. 1999;33(3):449-56.
Gregory et al., Integration site for Streptomyces phage phiBT1 and development of site- specific integrating vectors. J Bacteriol. Sep. 2003;185(17):5320-3. doi: 10.1128/jb.185.17.5320-5323.2003.
Griffiths, Endogenous retroviruses in the human genome sequence. Genome Biol. 2001;2(6):Reviews1017. doi: 10.1186/GB-2001-2-6-reviews1017. Epub Jun. 5, 2001.
Grindley et al., Mechanisms of site-specific recombination. Annu Rev Biochem. 2006;75:567-605. doi: 10.1146/annurev.biochem.73.011303.073908.
Grishok et al., Genes and Mechanisms Related to RNA Interference Regulate Expression of the Small Temporal RNAs that Control C. elegans Developmental Timing. Jul. 13, 2001:106(1):P23-4.
Groher et al., Synthetic riboswitches—A tool comes of age. Biochim Biophys Acta. Oct. 2014;1839(10):964-973. doi: 10.1016/j.bbagrm.2014.05.005. Epub May 17, 2014.
Groth et al., Construction of transgenic *Drosophila* by using the site-specific integrase from phage phiC31. Genetics. Apr. 2004;166(4):1775-82. doi: 10.1534/genetics.166.4.1775.
Gruber et al., Strategies for measuring evolutionary conservation of RNA secondary structures. BMC Bioinformatics. Feb. 26, 2008;9:122. doi: 10.1186/1471-2105-9-122.
Gruber et al., The Vienna RNA websuite. Nucleic Acids Res. Jul. 1, 2008;36(Web Server issue):W70-4. doi: 10.1093/nar/gkn188. Epub Apr. 19, 2008.
Grunebaum et al., Recent advances in understanding and managing adenosine deaminase and purine nucleoside phosphorylase deficiencies. Curr Opin Allergy Clin Immunol. Dec. 2013;13(6):630-8. doi: 10.1097/ACI.0000000000000006.
Grünewald et al., Transcriptome-wide off-target RNA editing induced by CRISPR-guided DNA base editors. Nature. May 2019;569(7756):433-437. doi: 10.1038/s41586-019-1161-z. Epub Apr. 17, 2019.

(56) References Cited

OTHER PUBLICATIONS

Guedon et al., Current gene therapy using viral vectors for chronic pain. Mol Pain. May 13, 2015;11:27. doi: 10.1186/s12990-015-0018-1.
Gumulya et al., Exploring the past and the future of protein evolution with ancestral sequence reconstruction: the 'retro' approach to protein engineering. Biochem J. Jan. 1, 2017;474(1):1-19. doi: 10.1042/BCJ20160507.
Guo et al., Designing single guide RNA for CIRSPR-Cas9 base editor by deep learning. Peer reviewed Thesis/Dissertation. UCLA Electronic Theses and Dissertations. Jan. 1, 2019. Retrieved from the Internet via https://escholarship.org/uc/item/7vf9z54t. Last accessed on Apr. 29, 2021.
Guo et al., Evolution of Tetrahymena ribozyme mutants with increased structural stability. Nat Struct Biol. Nov. 2002;9(11):855-61. doi: 10.1038/nsb850.
Guo et al., Facile functionalization of FK506 for biological studies by the thiol-ene 'click' reaction. RSC Advances. 2014;22:11400-3.
Gupta et al., Cross-talk between cognate and noncognate RpoE sigma factors and Zn(2+)-binding anti-sigma factors regulates photooxidative stress response in Azospirillum brasilense. Antioxid Redox Signal. Jan. 1, 2014;20(1):42-59. doi: 10.1089/ars.2013.5314. Epub Jul. 19, 2013.
Gupta et al., Sequences in attB that affect the ability of phiC31 integrase to synapse and to activate DNA cleavage. Nucleic Acids Res. 2007;35(10):3407-19. doi: 10.1093/nar/gkm206. Epub May 3, 2007.
Guzman et al., Tight regulation, modulation, and high-level expression by vectors containing the arabinose PBAD promoter. J Bacteriol. 1995;177(14):4121-4130.
Haapaniemi et al., CRISPR-Cas9 genome editing induces a p53-mediated DNA damage response. Nat Med. Jul. 2018;24(7):927-930. doi: 10.1038/s41591-018-0049-z. Epub Jun. 11, 2018.
Haddada et al., Gene therapy using adenovirus vectors. Curr Top Microbiol Immunol. 1995;199 ( Pt 3):297-306. doi: 10.1007/978-3-642-79586-2_14.
Halbert et al., Repeat transduction in the mouse lung by using adeno-associated virus vectors with different serotypes. J Virol. Feb. 2000;74(3):1524-32. doi: 10.1128/jvi.74.3.1524-1532.2000.
Halmai et al., Targeted CRIPSR/dCas9-mediated reactivation of epigenetically silenced genes suggests limited escape from the inactive X chromosome. 2nd Intl Conf on Epigenetics and Bioengineering. Oct. 4, 2018; Retrieved from the Internet: https://aiche.confex.com/aiche/epibio18/webprogram/paper544785.html. Retrieved Jun. 29, 2020.
Halperin et al., CRISPR-guided DNA polymerases enable diversification of all nucleotides in a tunable window. Nature. Aug. 2018;560(7717):248-252. doi: 10.1038/s41586-018-0384-8. Epub Aug. 1, 2018.
Halvas et al., Role of murine leukemia virus reverse transcriptase deoxyribonucleoside triphosphate-binding site in retroviral replication and in vivo fidelity. J Virol. Nov. 2000;74(22):10349-58. doi: 10.1128/jvi.74.22.10349-10358.2000.
Handa et al., Template-assisted synthesis of adenine-mutagenized cDNA by a retroelement protein complex. Nucleic Acids Res. Oct. 12, 2018;46(18):9711-9725. doi: 10.1093/nar/gky620.
Hanna et al., Massively parallel assessment of human variants with base editor screens. Cell. Feb. 15, 2021;184(4):1064-1080.e20. doi: 10.1016/j.cell.2021.01.012.
Hanson et al., Codon optimality, bias and usage in translation and mRNA decay. Nat Rev Mol Cell Biol. Jan. 2018;19(1):20-30. doi: 10.1038/nrm.2017.91. Epub Oct. 11, 2017.
Hardt et al.,Missense variants in hMLH1 identified in patients from the German HNPCC consortium and functional studies. Fam Cancer. Jun. 2011;10(2):273-84. doi: 10.1007/s10689-011-9431-4.
Harms et al., Evolutionary biochemistry: revealing the historical and physical causes of protein properties. Nat Rev Genet. Aug. 2013;14(8):559-71. doi: 10.1038/nrg3540.
Harmsen et al., DNA mismatch repair and oligonucleotide end-protection promote base-pair substitution distal from a CRISPR/Cas9-induced DNA break. Nucleic Acids Res. Apr. 6, 2018;46(6):2945-2955. doi: 10.1093/nar/gky076.
Harrington et al., A thermostable Cas9 with increased lifetime in human plasma. Nat Commun. Nov. 10, 2017;8(1):1424. doi: 10.1038/s41467-017-01408-4.
Harrington et al., A thermostable Cas9 with increased lifetime in human plasma. Nat Commun. Nov. 10, 2017;8(1):1424. doi: 10.1038/s41467-017-01408-4. Posted May 16, 2017 as bioRxiv preprint. Doi.org/10.1101/138867.
Hasegawa et al., Spontaneous mutagenesis associated with nucleotide excision repair in *Escherichia coli*. Genes Cells. May 2008;13(5):459-69. doi: 10.1111/j.1365-2443.2008.01185.x.
Hector et al., CDKL5 variants: Improving our understanding of a rare neurologic disorder. Neurol Genet. Dec. 15, 2017;3(6):e200. doi: 10.1212/NXG.0000000000000200.
Heidenreich et al., Non-homologous end joining as an important mutagenic process in cell cycle-arrested cells. EMBO J. May 1, 2003;22(9):2274-83. doi: 10.1093/emboj/cdg203.
Held et al., In vivo correction of murine hereditary tyrosinemia type I by phiC31 integrase-mediated gene delivery. Mol Ther. Mar. 2005;11(3):399-408. doi: 10.1016/j.ymthe.2004.11.001.
Hendricks et al., The S. cerevisiae Mag1 3-methyladenine DNA glycosylase modulates susceptibility to homologous recombination. DNA Repair (Amst). 2002;1(8):645-659.
Hermonat et al., Use of adeno-associated virus as a mammalian DNA cloning vector: transduction of neomycin resistance into mammalian tissue culture cells. Proc Natl Acad Sci U S A. Oct. 1984;81(20):6466-70. doi: 10.1073/pnas.81.20.6466.
Herschhorn et al., Retroviral reverse transcriptases. Cell Mol Life Sci. Aug. 2010;67(16):2717-47. doi: 10.1007/s00018-010-0346-2. Epub Apr. 1, 2010.
Herzig et al., A Novel Leu92 Mutant of HIV-1 Reverse Transcriptase with a Selective Deficiency in Strand Transfer Causes a Loss of Viral Replication. J Virol. Aug. 2015;89(16):8119-29. doi: 10.1128/JVI.00809-15. Epub May 20, 2015.
Higgs et al., Genetic complexity in sickle cell disease. Proc Natl Acad Sci U S A. Aug. 19, 2008;105(33):11595-6. doi: 10.1073/pnas.0806633105. Epub Aug. 11, 2008.
Hilbers et al., New developments in structure determination of pseudoknots. Biopolymers. 1998;48(2-3):137-53. doi: 10.1002/(SICI)1097-0282(1998)48:2<137::AID-BIP4>3.0.CO;2-H.
Hille et al., The Biology of CRISPR-Cas: Backward and Forward. Cell. Mar. 8, 2018;172(6):1239-1259. doi: 10.1016/j.cell.2017.11.032.
Hoang et al., UFBoot2: Improving the Ultrafast Bootstrap Approximation. Mol Biol Evol. Feb. 1, 2018;35(2):518-522. doi: 10.1093/molbev/msx281.
Hoernes et al., Translating the epitranscriptome. Wiley Interdiscip Rev RNA. Jan. 2017;8(1):e1375. doi: 10.1002/wrna.1375. Epub Jun. 27, 2016.
Hoess et al., DNA specificity of the Cre recombinase resides in the 25 kDa carboxyl domain of the protein. J Mol Biol. Dec. 20, 1990;216(4):873-82. doi: 10.1016/S0022-2836(99)80007-2.
Hollis et al., Phage integrases for the construction and manipulation of transgenic mammals. Reprod Biol Endocrinol. Nov. 7, 2003;1:79. doi: 10.1186/1477-7827-1-79.
Holsinger et al., Signal transduction in T lymphocytes using a conditional allele of Sos. Proc Natl Acad Sci U S A. Oct. 10, 1995;92(21):9810-4. doi: 10.1073/pnas.92.21.9810.
Holt et al., Human hematopoietic stem/progenitor cells modified by zinc-finger nucleases targeted to CCR5 control HIV-1 in vivo. Nat Biotechnol. Aug. 2010;28(8):839-47. doi: 10.1038/nbt.1663. Epub Jul. 2, 2010.
Hoogenboom et al., Natural and designer binding sites made by phage display technology. Immunol Today. Aug. 2000;21(8):371-8.
Horvath et al., Diversity, Activity, and Evolution of CRISPR Loci in *Streptococcus thermophilus*. J Bacteriol. Feb. 2008;190(4):1401-12. doi: 10.1128/JB.01415-07. Epub Dec. 7, 2007.
Hotta et al., [Neurotropic viruses—classification, structure and characteristics]. Nihon Rinsho. Apr. 1997;55(4):777-82. Japanese.

(56) References Cited

OTHER PUBLICATIONS

Housden et al., Identification of potential drug targets for tuberous sclerosis complex by synthetic screens combining CRISPR-based knockouts with RNAi. Sci Signal. Sep. 8, 2015;8(393):rs9. doi: 10.1126/scisignal.aab3729.

Hsu et al., DNA targeting specificity of RNA-guided Cas9 nucleases. Nat Biotechnol. Sep. 2013;31(9):827-32. doi: 10.1038/nbt.2647. Epub Jul. 21, 2013. Supplementary Information. 27 pages.

Hsu et al., PrimeDesign software for rapid and simplified design of prime editing guide RNAs. Nat Commun. Feb. 15, 2021;12(1):1034. doi: 10.1038/s41467-021-21337-7.

Hu et al., Evolved Cas9 variants with broad PAM compatibility and high DNA specificity. Nature. Apr. 5, 2018;556(7699):57-63 and Extended/Supplementary Data. doi: 10.1038/nature26155. Epub Feb. 28, 2018. 21 pages.

Hu et al., Evolved Cas9 variants with broad PAM compatibility and high DNA specificity. Nature. Apr. 5, 2018;556(7699):57-63. doi: 10.1038/nature26155. Epub Feb. 28, 2018.

Hua et al., Expanding the base editing scope in rice by using Cas9 variants. Plant Biotechnol J. Feb. 2019;17(2):499-504. doi: 10.1111/pbi.12993. Epub Oct. 5, 2018.

Hua et al., Precise A•T to G•C Base Editing in the Rice Genome. Mol Plant. Apr. 2, 2018;11(4):627-630. doi: 10.1016/j.molp.2018.02.007. Epub Feb. 21, 2018.

Huang et al., Circularly permuted and PAM-modified Cas9 variants broaden the targeting scope of base editors. Nat Biotechnol. Jun. 2019;37(6):626-631. doi: 10.1038/s41587-019-0134-y. Epub May 20, 2019. Including Supplementary Information.

Huang et al., Precision genome editing using cytosine and adenine base editors in mammalian cells. Nat Protoc. Feb. 2021;16(2):1089-1128. doi: 10.1038/s41596-020-00450-9. Epub Jan. 18, 2021.

Huggins et al., Flap endonuclease 1 efficiently cleaves base excision repair and DNA replication intermediates assembled into nucleosomes. Mol Cell. Nov. 2002;10(5):1201-11. doi: 10.1016/s1097-2765(02)00736-0.

Hung et al., Protein localization in disease and therapy. J Cell Sci. Oct. 15, 2011;124(Pt 20):3381-92. doi: 10.1242/jcs.089110.

Hwang et al., Web-based design and analysis tools for CRISPR base editing. BMC Bioinformatics. Dec. 27, 2018;19(1):542. doi: 10.1186/s12859-018-2585-4.

Ibba et al., Relaxing the substrate specificity of an aminoacyl-tRNA synthetase allows in vitro and in vivo synthesis of proteins containing unnatural amino acids. FEBS Lett. May 15, 1995;364(3):272-5.

Ibba et al., Substrate specificity is determined by amino acid binding pocket size in *Escherichia coli* phenylalanyl-tRNA synthetase. Biochemistry. Jun. 14, 1994;33(23):7107-12.

Ihry et al., p53 inhibits CRISPR-Cas9 engineering in human pluripotent stem cells. Nat Med. Jul. 2018;24(7):939-946. doi: 10.1038/s41591-018-0050-6. Epub Jun. 11, 2018.

Iida et al., A site-specific, conservative recombination system carried by bacteriophage P1. Mapping the recombinase gene cin and the cross-over sites cix for the inversion of the C segment. EMBO J. 1982;1(11):1445-53.

Iida et al., The Min DNA inversion enzyme of plasmid p15B of *Escherichia coli* 15T-: a new member of the Din family of site-specific recombinases. Mol Microbiol. Jun. 1990;4(6):991-7. doi: 10.1111/j.1365-2958.1990.tb00671.x.

Imanishi et al., Detection of N6-methyladenosine based on the methyl-sensitivity of MazF RNA endonuclease. Chem Commun (Camb). Nov. 30, 2017;53(96):12930-12933. doi: 10.1039/c7cc07699a.

Imburgio et al., Studies of promoter recognition and start site selection by T7 RNA polymerase using a comprehensive collection of promoter variants. Biochemistry. Aug. 29, 2000;39(34):10419-30.

Ingram, A specific chemical difference between the globins of normal human and sickle-cell anaemia haemoglobin. Nature. Oct. 13, 1956;178(4537):792-4. doi: 10.1038/178792a0.

International Preliminary Report on Patentability for PCT/US2014/048390, mailed on Mar. 7, 2019.

International Preliminary Report on Patentability for PCT/US2017/045381, mailed Feb. 14, 2019.

International Preliminary Report on Patentability for PCT/US2017/046144, mailed Feb. 21, 2019.

International Preliminary Report on Patentability for PCT/US2017/056671, mailed on Apr. 25, 2019.

International Preliminary Report on Patentability for PCT/US2017/068105, mailed on Jul. 4, 2019.

International Preliminary Report on Patentability for PCT/US2017/068114, mailed on Jul. 4, 2019.

International Preliminary Report on Patentability for PCT/US2018/021664, mailed on Sep. 19, 2019.

International Preliminary Report on Patentability for PCT/US2018/021878, mailed on Sep. 19, 2019.

International Preliminary Report on Patentability for PCT/US2018/021880, mailed on Sep. 19, 2019.

International Preliminary Report on Patentability for PCT/US2018/024208, mailed on Oct. 3, 2019.

International Preliminary Report on Patentability for PCT/US2018/032460, mailed Nov. 21, 2019.

International Preliminary Report on Patentability for PCT/US2018/044242, mailed Feb. 6, 2020.

International Prelminary Report on Patentability for PCT/US2018/048969, mailed Mar. 12, 2020.

International Search Report and Written Opinion for PCT/US2014/052231, mailed Jan. 30, 2015 (Corrected Version).

International Search Report and Written Opinion for PCT/US2018/044242, mailed Nov. 21, 2019.

International Search Report for PCT/US2018/021664, mailed Jun. 21, 2018.

International Search Report for PCT/US2018/021878, mailed Aug. 20, 2018.

International Search Report for PCT/US2018/021880, mailed Jun. 20, 2018.

International Search Report for PCT/US2018/024208, mailed Aug. 23, 2018.

International Search Report for PCT/US2018/025887, mailed Jun. 21, 2018.

International Search Report for PCT/US2018/032460, mailed Jul. 11, 2018.

International Search Report for PCT/US2018/048969, mailed Jul. 31, 2019.

Invitation to Pay Additional Fees for PCT/US2018/021878, mailed Jun. 8, 2018.

Irion et al., Identification and targeting of the ROSA26 locus in human embryonic stem cells. Nat Biotechnol. Dec. 2007;25(12):1477-82. doi: 10.1038/nbt1362. Epub Nov. 25, 2007.

Isaacs et al., Engineered riboregulators enable post-transcriptional control of gene expression. Nat Biotechnol. Jul. 2004;22(7):841-7. doi: 10.1038/nbt986. Epub Jun. 20, 2004.

Iwai et al., Circular beta-lactamase: stability enhancement by cyclizing the backbone. FEBS Lett. Oct. 8, 1999;459(2):166-72. doi: 10.1016/s0014-5793(99)01220-x.

Iwai et al., Highly efficient protein trans-splicing by a naturally split DnaE intein from Nostoc punctiforme. FEBS Lett. Mar. 20, 2006;580(7):1853-8. doi: 10.1016/j.febslet.2006.02.045. Epub Feb. 24, 2006.

Jaffrey et al., Emerging links between m6A and misregulated mRNA methylation in cancer. Genome Med. Jan. 12, 2017;9(1):2. doi: 10.1186/s13073-016-0395-8.

Jardine et al., HIV-1 Vaccines. Priming a broadly neutralizing antibody response to HIV-1 using a germline-targeting immunogen. Science. Jul. 10, 2015;349(6244):156-61. doi: 10.1126/science.aac5894. Epub Jun. 18, 2015.

Jasin et al., Repair of strand breaks by homologous recombination. Cold Spring Harb Perspect Biol. Nov. 1, 2013;5(11):a012740. doi: 10.1101/cshperspect.a012740.

Jeggo, DNA breakage and repair. Adv Genet. 1998;38:185-218. doi: 10.1016/s0065-2660(08)60144-3.

(56) References Cited

OTHER PUBLICATIONS

Jemiely et al., Novel "anti-reverse" cap analogs with superior translational properties. RNA. Sep. 2003;9(9):1108-22. doi: 10.1261/rna.5430403.

Jeong et al., Measurement of deoxyinosine adduct: Can it be a reliable tool to assess oxidative or nitrosative DNA damage? Toxicol Lett. Oct. 17, 2012;214(2):226-33. doi: 10.1016/j.toxlet.2012.08.013. Epub Aug. 23, 2012.

Jia et al., The MLH1 ATPase domain is needed for suppressing aberrant formation of interstitial telomeric sequences. DNA Repair (Amst). May 2018;65:20-25. doi: 10.1016/j.dnarep.2018.03.002. Epub Mar. 7, 2018.

Jiang et al., CRISPR-Cas9 Structures and Mechanisms. Annu Rev Biophys. May 22, 2017;46:505-529. doi: 10.1146/annurev-biophys-062215-010822. Epub Mar. 30, 2017.

Jiang et al., Structural Biology. A Cas9-guide RNA Complex Preorganized for Target DNA Recognition. Science. Jun. 26, 2015;348(6242):1477-81. doi: 10.1126/science.aab1452.

Jiricny, The multifaceted mismatch-repair system. Nat Rev Mol Cell Biol. May 2006;7(5):335-46. doi: 10.1038/nrm1907.

Johann et al., GLVR1, a receptor for gibbon ape leukemia virus, is homologous to a phosphate permease of Neurospora crassa and is expressed at high levels in the brain and thymus. J Virol. Mar. 1992;66(3):1635-40. doi: 10.1128/JVI.66.3.1635-1640.1992.

Johansson et al., RNA Recognition by the MS2 Phage Coat Protein. Seminars in Virology. 1997;8(3):176-85. https://doi.org/10.1006/smvy.1997.0120.

Johansson et al., Selenocysteine in proteins-properties and biotechnological use. Biochim Biophys Acta. Oct. 30, 2005;1726(1):1-13. Epub Jun. 1, 2005.

Johns et al., The promise and peril of continuous in vitro evolution. J Mol Evol. Aug. 2005;61(2):253-63. Epub Jun. 27, 2005.

Johnson et al., Trans insertion-splicing: ribozyme-catalyzed insertion of targeted sequences into RNAs. Biochemistry. Aug. 9, 2005;44(31):10702-10. doi: 10.1021/bi0504815.

Joho et al., Identification of a region of the bacteriophage T3 and T7 RNA polymerases that determines promoter specificity. J Mol Biol. Sep. 5, 1990;215(1):31-9.

Joyce et al., Amplification, mutation and selection of catalytic RNA. Gene. Oct. 15, 1989;82(1):83-7. doi: 10.1016/0378-1119(89)90033-4.

Jyothy et al., Translocation Down syndrome. Indian J Med Sci. Mar. 2002;56(3):122-6.

Kacian et al., Purification of the DNA polymerase of avian myeloblastosis virus. Biochim Biophys Acta. Sep. 24, 1971;246(3):365-83. doi: 10.1016/0005-2787(71)90773-8.

Kaczmarczyk et al., Manipulating the Prion Protein Gene Sequence and Expression Levels with CRISPR/Cas9. PLoS One. Apr. 29, 2016;11(4):e0154604. doi: 10.1371/journal.pone.0154604.

Kadoch et al., Reversible disruption of mSWI/SNF (BAF) complexes by the SS18-SSX oncogenic fusion in synovial sarcoma. Cell. Mar. 28, 2013;153(1):71-85. doi: 10.1016/j.cell.2013.02.036.

Kahmann et al., G inversion in bacteriophage Mu DNA is stimulated by a site within the invertase gene and a host factor. Cell. Jul. 1985;41(3):771-80. doi: 10.1016/s0092-8674(85)80058-1.

Kalyaanamoorthy et al., ModelFinder: fast model selection for accurate phylogenetic estimates. Nat Methods. Jun. 2017;14(6):587-589. doi: 10.1038/nmeth.4285. Epub May 8, 2017.

Kang et al., Precision genome engineering through adenine base editing in plants. Nat Plants. Jul. 2018;4(7):427-431. doi: 10.1038/s41477-018-0178-x. Epub Jun. 4, 2018. Erratum in: Nat Plants. Sep. 2018;4(9):730.

Kao et al., Cleavage specificity of *Saccharomyces cerevisiae* flap endonuclease 1 suggests a double-flap structure as the cellular substrate. J Biol Chem. Apr. 26, 2002;277(17):14379-89. doi: 10.1074/jbc.M110662200. Epub Feb. 1, 2002.

Karimova et al., Discovery of Nigri/nox and Panto/pox site-specific recombinase systems facilitates advanced genome engineering. Sci Rep. Jul. 22, 2016;6:30130. doi: 10.1038/srep30130.

Karimova et al., Vika/vox, a novel efficient and specific Cre/loxP-like site-specific recombination system. Nucleic Acids Res. Jan. 2013;41(2):e37. doi: 10.1093/nar/gks1037. Epub Nov. 9, 2012.

Katafuchi et al., DNA polymerases involved in the incorporation of oxidized nucleotides into DNA: their efficiency and template base preference. Mutat Res. Nov. 28, 2010;703(1):24-31. doi: 10.1016/j.mrgentox.2010.06.004. Epub Jun. 11, 2010.

Kato et al., Improved purification and enzymatic properties of three forms of reverse transcriptase from avian myeloblastosis virus. J Virol Methods. Dec. 1984;9(4):325-39. doi: 10.1016/0166-0934(84)90058-2.

Katoh et al., MAFFT multiple sequence alignment software version 7: improvements in performance and usability. Mol Biol Evol. Apr. 2013;30(4):772-80. doi: 10.1093/molbev/mst010. Epub Jan. 16, 2013.

Kaufman et al., Translational efficiency of polycistronic mRNAs and their utilization to express heterologous genes in mammalian cells. EMBO J. Jan. 1987;6(1):187-93.

Kavli et al., Excision of cytosine and thymine from DNA by mutants of human uracil-DNA glycosylase. EMBO J. Jul. 1, 1996;15(13):3442-7.

Kawarasaki et al., Enhanced crossover SCRATCHY: construction and high-throughput screening of a combinatorial library containing multiple non-homologous crossovers. Nucleic Acids Res. Nov. 1, 2003;31(21):e126.

Keijzers et al., Human exonuclease 1 (EXO1) activity characterization and its function on flap structures. Biosci Rep. Apr. 25, 2015;35(3):e00206. doi: 10.1042/BSR20150058.

Kelman, PCNA: structure, functions and interactions. Oncogene. Feb. 13, 1997;14(6):629-40. doi: 10.1038/sj.onc.1200886.

Keravala et al., A diversity of serine phage integrases mediate site-specific recombination in mammalian cells. Mol Genet Genomics. Aug. 2006;276(2):135-46. doi: 10.1007/s00438-006-0129-5. Epub May 13, 2006.

Kessel et al., Murine developmental control genes. Science. Jul. 27, 1990;249(4967):374-9. doi: 10.1126/science.1974085.

Kessler et al., Gene delivery to skeletal muscle results in sustained expression and systemic delivery of a therapeutic protein. Proc Natl Acad Sci U S A. Nov. 26, 1996;93(24):14082-7. doi: 10.1073/pnas.93.24.14082.

Ketha et al., Application of bioinformatics-coupled experimental analysis reveals a new transport-competent nuclear localization signal in the nucleoprotein of Influenza A virus strain. BMC Cell Biol. Apr. 28, 2008; 9:22. https://doi.org/10.1186/1471-2121-9-22.

Kilcher et al., Brochothrix thermosphacta bacteriophages feature heterogeneous and highly mosaic genomes and utilize unique prophage insertion sites. J Bacteriol. Oct. 2010;192(20):5441-53. doi: 10.1128/JB.00709-10. Epub Aug. 13, 2010.

Kim et al., DJ-1, a novel regulator of the tumor suppressor PTEN. Cancer Cell. 2005;7(3):263-273.

Kim et al., High cleavage efficiency of a 2A peptide derived from porcine teschovirus-1 in human cell lines, zebrafish and mice. PLoS One. 2011;6(4):e18556. doi: 10.1371/journal.pone.0018556. Epub Apr. 29, 2011.

Kim et al., In vivo genome editing with a small Cas9 orthologue derived from Campylobacter jejuni. Nat Commun. Feb. 21, 2017;8:14500. doi: 10.1038/ncomms14500. PMID: 28220790; PMCID: PMC5473640.

Kim et al., In vivo high-throughput profiling of CRISPR-Cpf1 activity. Nat Methods. Feb. 2017;14(2):153-159. doi: 10.1038/nmeth.4104. Epub Dec. 19, 2016.

Kim et al., Mycobacteriophage Bxb1 integrates into the *Mycobacterium smegmatis* groEL1 gene. Mol Microbiol. Oct. 2003;50(2):463-73. doi: 10.1046/j.1365-2958.2003.03723.x.

Kim et al., Rescue of high-specificity Cas9 variants using sgRNAs with matched 5' nucleotides. Genome Biol. Nov. 15, 2017;18(1):218. doi: 10.1186/s13059-017-1355-3.

Kim et al., Structural and kinetic characterization of *Escherichia coli* TadA, the wobble-specific tRNA deaminase. Biochemistry. May 23, 2006;45(20):6407-16. doi: 10.1021/bi0522394. PMID: 16700551.

(56) References Cited

OTHER PUBLICATIONS

King et al., No gain, No pain: NaV1.7 as an analgesic target. ACS Chem Neurosci. Sep. 17, 2014;5(9):749-51. doi: 10.1021/cn500171p. Epub Aug. 11, 2014.

Klapacz et al., Frameshift mutagenesis and microsatellite instability induced by human alkyladenine DNA glycosylase. Mol Cell. Mar. 26, 2010;37(6):843-53. doi: 10.1016/j.molcel.2010.01.038.

Kleiner et al., In vitro selection of a DNA-templated small-molecule library reveals a class of macrocyclic kinase inhibitors. J Am Chem Soc. Aug. 25, 2010;132(33):11779-91. doi: 10.1021/ja104903x.

Kleinstiver et al., Engineered CRISPR-Cas9 nucleases with altered PAM specificities. Nature. Jul. 23, 2015;523(7561):481-5 and Supplementary Materials. doi: 10.1038/nature14592. Epub Jun. 22, 2015. 27 pages.

Klement et al., Discrimination between bacteriophage T3 and T7 promoters by the T3 and T7 RNA polymerases depends primarily upon a three base-pair region located 10 to 12 base-pairs upstream from the start site. J Mol Biol. Sep. 5, 1990;215(1):21-9.

Klompe et al., Transposon-encoded CRISPR-Cas systems direct RNA-guided DNA integration. Nature. Jul. 2019;571(7764):219-225. doi: 10.1038/s41586-019-1323-z. Epub Jun. 12, 2019.

Knott et al., Guide-bound structures of an RNA-targeting A-cleaving CRISPR-Cas13a enzyme. Nat Struct Mol Biol. Oct. 2017;24(10):825-833. doi: 10.1038/nsmb.3466. Epub Sep. 11, 2017.

Koblan et al., Improving cytidine and adenine base editors by expression optimization and ancestral reconstruction. Nat Biotechnol. Oct. 2018;36(9):843-846. doi: 10.1038/nbt.4172. Epub May 29, 2018.

Kobori et al., Deep Sequencing Analysis of Aptazyme Variants Based on a Pistol Ribozyme. ACS Synth Biol. Jul. 2, 20171;6(7):1283-1288. doi: 10.1021/acssynbio.7b00057. Epub Apr. 14, 2017.

Kohli et al., A portable hot spot recognition loop transfers sequence preferences from APOBEC family members to activation-induced cytidine deaminase. J Biol Chem. Aug. 21, 2009;284(34):22898-904. doi: 10.1074/jbc.M109.025536. Epub Jun. 26, 2009.

Koike-Yusa et al., Genome-wide recessive genetic screening in mammalian cells with a lentiviral CRISPR-guide RNA library. Nat Biotechnol. Mar. 2014;32(3):267-73. doi: 10.1038/nbt.2800. Epub Dec. 23, 2013.

Kolot et al., Site promiscuity of coliphage HK022 integrase as a tool for gene therapy. Gene Ther. Jul. 2015;22(7):521-7. doi: 10.1038/gt.2015.9. Epub Mar. 12, 2015.

Kolot et al., Site-specific recombination in mammalian cells expressing the Int recombinase of bacteriophage HK022. Mol Biol Rep. Aug. 1999;26(3):207-13. doi: 10.1023/a:1007096701720.

Komor, Editing the Genome Without Double-Stranded DNA Breaks. ACS Chem Biol. Feb. 16, 2018;13(2):383-388. doi: 10.1021/acschembio.7b00710. Epub Oct. 9, 2017.

Konermann et al., Genome-scale transcriptional activation by an engineered CRISPR-Cas9 complex. Nature. Jan. 29, 2015;517(7536):583-8. doi: 10.1038/nature14136. Epub Dec. 10, 2014.

Koonin et al., Diversity, classification and evolution of CRISPR-Cas systems. Curr Opin Microbiol. 2017;37:67?78. doi:10.1016/j.mib.2017.05.008.

Kosicki et al., Repair of double-strand breaks induced by CRISPR-Cas9 leads to large deletions and complex rearrangements. Nat Biotechnol. Sep. 2018;36(8):765-771. doi: 10.1038/nbt.4192. Epub Jul. 16, 2018.

Kotewicz et al., Cloning and overexpression of Moloney murine leukemia virus reverse transcriptase in *Escherichia coli*. Gene. 1985;35(3):249-58. doi: 10.1016/0378-1119(85)90003-4.

Kotewicz et al., Isolation of cloned Moloney murine leukemia virus reverse transcriptase lacking ribonuclease H activity. Nucleic Acids Res. Jan. 11, 1988;16(1):265-77. doi: 10.1093/nar/16.1.265.

Kotin, Prospects for the use of adeno-associated virus as a vector for human gene therapy. Hum Gene Ther. Jul. 1994;5(7):793-801. doi: 10.1089/hum.1994.5.7-793.

Kowalski et al., Delivering the Messenger: Advances in Technologies for Therapeutic mRNA Delivery. Mol Ther. Apr. 10, 2019;27(4):710-728. doi: 10.1016/j.ymthe.2019.02.012. Epub Feb. 19, 2019.

Kozak, An analysis of 5'-noncoding sequences from 699 vertebrate messenger RNAs. Nucleic Acids Res. Oct. 26, 1987;15(20):8125-48. doi: 10.1093/nar/15.20.8125.

Kraft et al., Deletions, Inversions, Duplications: Engineering of Structural Variants using CRISPR/Cas in Mice. Cell Rep. Feb. 10, 2015;10(5):833-839. doi: 10.1016/j.celrep.2015.01.016. Epub Feb. 7, 2015.

Kremer et al., Adenovirus and adeno-associated virus mediated gene transfer. Br Med Bull. Jan. 1995;51(1):31-44. doi: 10.1093/oxfordjournals.bmb.a072951.

Krokan et al., Uracil in DNA—occurrence, consequences and repair. Oncogene. Dec. 16, 2002;21(58):8935-48. doi: 10.1038/sj.onc.1205996.

Krokan et al., Base excision repair. Cold Spring Harb Perspect Biol. Apr. 1, 2013;5(4):a012583. doi: 10.1101/cshperspect.a012583.

Krzywkowski et al., Limited reverse transcriptase activity of phi29 DNA polymerase. Nucleic Acids Res. Apr. 20, 2018;46(7):3625-3632. doi: 10.1093/nar/gky190.

Kumar et al., Gene therapy for chronic neuropathic pain: how does it work and where do we stand today? Pain Med. May 2011;12(5):808-22. doi: 10.1111/j.1526-4637.2011.01120.x.

Kunkel et al., Eukaryotic Mismatch Repair in Relation to DNA Replication. Annu Rev Genet. 2015;49:291-313. doi: 10.1146/annurev-genet-112414-054722.

Kurjan et al., Structure of a yeast pheromone gene (MF alpha): a putative alpha-factor precursor contains four tandem copies of mature alpha-factor. Cell. Oct. 1982;30(3):933-43. doi: 10.1016/0092-8674(82)90298-7.

Kuscu et al., CRISPR-Cas9-AID base editor is a powerful gain-of-function screening tool. Nat Methods. Nov. 29, 2016;13(12):983-984. doi: 10.1038/nmeth.4076.

Kwart et al., Precise and efficient scarless genome editing in stem cells using CORRECT. Nat Protoc. Feb. 2017;12(2):329-354. doi: 10.1038/nprot.2016.171. Epub Jan. 19, 2017.

Kweon et al., Fusion guide RNAs for orthogonal gene manipulation with Cas9 and Cpf1. Nat Commun. Nov. 23, 2017;8(1):1723. doi: 10.1038/s41467-017-01650-w. Erratum in: Nat Commun. Jan. 16, 2018;9(1):303.

Kügler et al., Human synapsin 1 gene promoter confers highly neuron-specific long-term transgene expression from an adenoviral vector in the adult rat brain depending on the transduced area. Gene Ther. Feb. 2003;10(4):337-47. doi: 10.1038/sj.gt.3301905.

Lada et al., Mutator effects and mutation signatures of editing deaminases produced in bacteria and yeast. Biochemistry (Mosc). Jan. 2011;76(1):131-46.

Lakich et al., Inversions disrupting the factor VIII gene are a common cause of severe haemophilia A. Nat Genet. Nov. 1993;5(3):236-41. doi: 10.1038/ng1193-236.

Lancaster et al., Limited trafficking of a neurotropic virus through inefficient retrograde axonal transport and the type I interferon response. PLoS Pathog. Mar. 5, 2010;6(3):e1000791. doi: 10.1371/journal.ppat.1000791.

Landrum et al., ClinVar: public archive of relationships among sequence variation and human phenotype. Nucleic Acids Res. Jan. 2014;42(Database issue):D980-5. doi: 10.1093/nar/gkt1113. Epub Nov. 14, 2013.

Lauer et al., Construction, characterization, and use of two Listeria monocytogenes site-specific phage integration vectors. J Bacteriol. Aug. 2002;184(15):4177-86. doi: 10.1128/jb.184.15.4177-4186.2002.

Lawyer et al., High-level expression, purification, and enzymatic characterization of full-length Thermus aquaticus DNA polymerase and a truncated form deficient in 5' to 3' exonuclease activity. PCR Methods Appl. May 1993;2(4):275-87. doi: 10.1101/gr.2.4.275.

Lazarevic et al., Nucleotide sequence of the Bacillus subtilis temperate bacteriophage SPbetac2. Microbiology (Reading). May 1999;145 (Pt 5):1055-1067. doi: 10.1099/13500872-145-5-1055.

(56) References Cited

OTHER PUBLICATIONS

Le Grice et al., Purification and characterization of recombinant equine infectious anemia virus reverse transcriptase. J Virol. Dec. 1991;65(12):7004-7. doi: 10.1128/JVI.65.12.7004-7007.1991.

Leaver-Fay et al., ROSETTA3: an object-oriented software suite for the simulation and design of macromolecules. Methods Enzymol. 2011;487:545-74. doi: 10.1016/B978-0-12-381270-4.00019-6.

Leconte et al., A population-based experimental model for protein evolution: effects of mutation rate and selection stringency on evolutionary outcomes. Biochemistry. Feb. 26, 2013;52(8): 1490-9. doi: 10.1021/bi3016185. Epub Feb. 14, 2013.

Lee et al., A monoclonal antibody that targets a NaV1.7 channel voltage sensor for pain and itch relief. Cell. Jun. 5, 2014;157(6):1393-1404. doi: 10.1016/j.cell.2014.03.064. Epub May 22, 2014. Retraction in: Cell. Jun. 25, 2020;181(7):1695.

Lee et al., Group I Intron-Based Therapeutics Through Trans-Splicing Reaction. Prog Mol Biol Transl Sci. 2018;159:79-100. doi: 10.1016/bs.pmbts.2018.07.001. Epub Aug. 9, 2018.

Lee et al., Site-specific integration of mycobacteriophage L5: integration-proficient vectors for *Mycobacterium smegmatis, Mycobacterium tuberculosis*, and bacille Calmette-Guérin. Proc Natl Acad Sci U S A. Apr. 15, 1991;88(8):3111-5. doi: 10.1073/pnas.88.8.3111.

Lee et al., Synthetically modified guide RNA and donor DNA are a versatile platform for CRISPR-Cas9 engineering. Elife. May 2, 2017;6:e25312. doi: 10.7554/eLife.25312.

Lee et al., Targeted chromosomal deletions in human cells using zinc finger nucleases. Genome Res. Jan. 2010 20: 81-89; Published in Advance Dec. 1, 2009, doi:10.1101/gr.099747.109.

Lee et al., Transcriptional regulation and its misregulation in disease. Cell. Mar. 14, 2013;152(6):1237-51. doi: 10.1016/j.cell. 2013.02.014.

Lei et al., Site-specificity of serine integrase demonstrated by the attB sequence preference of ?BT1 integrase. FEBS Lett. Apr. 2018;592(8):1389-1399. doi: 10.1002/1873-3468.13023. Epub Mar. 25, 2018.

Leipold et al., A de novo gain-of-function mutation in SCN11A causes loss of pain perception. Nat Genet. Nov. 2013;45(11):1399-404. doi: 10.1038/ng.2767. Epub Sep. 15, 2013.

Lemos et al., CRISPR/Cas9 cleavages in budding yeast reveal templated insertions and strand-specific insertion/deletion profiles. Proc Natl Acad Sci U S A. Feb. 27, 2018;115(9):E2040-E2047. doi: 10.1073/pnas.1716855115. Epub Feb. 13, 2018.

Levy et al., Cytosine and adenine base editing of the brain, liver, retina, heart and skeletal muscle of mice via adeno-associated viruses. Nat Biomed Eng. 2020;4(1):97-110. doi:10.1038/s41551-019-0501-5.

Levy et al., Membrane-associated guanylate kinase dynamics reveal regional and developmental specificity of synapse stability. J Physiol. Mar. 1, 2017;595(5):1699-1709. doi: 10.1113/JP273147. Epub Jan. 18, 2017.

Lew et al., Protein splicing in vitro with a semisynthetic two-component minimal intein. J Biol Chem. Jun. 26, 1998;273(26):15887-90. doi: 10.1074/jbc.273.26.15887.

Lewis et al., Cytosine deamination and the precipitous decline of spontaneous mutation during Earth's history. Proc Natl Acad Sci U S A. Jul. 19, 2016;113(29):8194-9. doi: 10.1073/pnas.1607580113. Epub Jul. 5, 2016.

Lewis et al., RNA modifications and structures cooperate to guide RNA-protein interactions. Nat Rev Mol Cell Biol. Mar. 2017;18(3):202-210. doi: 10.1038/nrm.2016.163. Epub Feb. 1, 2017.

Li et al., A Radioactivity-Based Assay for Screening Human m6A-RNA Methyltransferase, METTL3-METTL14 Complex, and Demethylase ALKBH5. J Biomol Screen. Mar. 2016;21(3):290-7. doi: 10.1177/1087057115623264. Epub Dec. 23, 2015.

Li et al., Fast and accurate short read alignment with Burrows-Wheeler transform. Bioinformatics. Jul. 15, 2009;25(14):1754-60. doi: 10.1093/bioinformatics/btp324. Epub May 18, 2009.

Li et al., Lagging strand DNA synthesis at the eukaryotic replication fork involves binding and stimulation of FEN-1 by proliferating cell nuclear antigen. J Biol Chem. Sep. 22, 1995;270(38):22109-12. doi: 10.1074/jbc.270.38.22109.

Li et al., Loss of post-translational modification sites in disease. Pac Symp Biocomput. 2010:337-47. doi: 10.1142/9789814295291_0036.

Li et al., Programmable Single and Multiplex Base-Editing in Bombyx mori Using RNA-Guided Cytidine Deaminases. G3 (Bethesda). May 4, 2018;8(5):1701-1709. doi: 10.1534/g3.118.200134.

Li et al., Protein trans-splicing as a means for viral vector-mediated in vivo gene therapy. Hum Gene Ther. Sep. 2008;19(9):958-64. doi: 10.1089/hum.2008.009.

Li et al., RSEM: accurate transcript quantification from RNA-Seq data with or without a reference genome. BMC Bioinformatics. Aug. 4, 2011;12:323. doi: 10.1186/1471-2105-12-323.

Li, Mechanisms and functions of DNA mismatch repair. Cell Res. Jan. 2008;18(1):85-98. doi: 10.1038/cr.2007.115.

Liang et al., Correction of ?-thalassemia mutant by base editor in human embryos. Protein Cell. Nov. 2017;8(11):811-822. doi: 10.1007/s13238-017-0475-6. Epub Sep. 23, 2017.

Liang et al., Homology-directed repair is a major double-strand break repair pathway in mammalian cells. Proc Natl Acad Sci U S A. Apr. 28, 1998;95(9):5172-7. doi: 10.1073/pnas.95.9.5172.

Liao et al., One-step assembly of large CRISPR arrays enables multi-functional targeting and reveals constraints on array design. bioRxiv. May 2, 2018. doi: 10.1101/312421. 45 pages.

Liefke et al., The oxidative demethylase ALKBH3 marks hyperactive gene promoters in human cancer cells. Genome Med. Jun. 30, 2015;7(1):66. doi: 10.1186/s13073-015-0180-0.

Lienert et al., Two- and three-input TALE-based AND logic computation in embryonic stem cells. Nucleic Acids Res. Nov. 2013;41(21):9967-75. doi: 10.1093/nar/gkt758. Epub Aug. 27, 2013.

Lilley, D.M. The Varkud Satellite Ribozyme. RNA. Feb. 2004;10(2):151-8.doi: 10.1261/rna.5217104.

Lim et al., Crystal structure of the moloney murine leukemia virus RNase H domain. J Virol. Sep. 2006;80(17):8379-89. doi: 10.1128/JVI.00750-06.

Lim et al., Viral vectors for neurotrophic factor delivery: a gene therapy approach for neurodegenerative diseases of the CNS. Pharmacol Res. Jan. 2010;61(1):14-26. doi: 10.1016/j.phrs.2009.10.002. Epub Oct. 17, 2009.

Lin et al., The human REV1 gene codes for a DNA template-dependent dCMP transferase. Nucleic Acids Res. Nov. 15, 1999;27(22):4468-75. doi: 10.1093/nar/27.22.4468.

Liu et al., Split dnaE genes encoding multiple novel inteins in Trichodesmium erythraeum. J Biol Chem. Jul. 18, 2003;278(29):26315-8. doi: 10.1074/jbc.C300202200. Epub May 24, 2003.

Liu et al., A METTL3-METTL14 complex mediates mammalian nuclear RNA N6-adenosine methylation. Nat Chem Biol. Feb. 2014;10(2):93-5. doi: 10.1038/nchembio.1432. Epub Dec. 6, 2013.

Liu et al., Adding new chemistries to the genetic code. Annu Rev Biochem. 2010;79:413-44. doi: 10.1146/annurev.biochem.052308.105824.

Liu et al., Calcineurin is a common target of cyclophilin-cyclosporin A and FKBP-FK506 complexes. Cell. Aug. 23, 1991;66(4):807-15. doi: 10.1016/0092-8674(91)90124-h.

Liu et al., CasX enzymes comprise a distinct family of RNA-guided genome editors. Nature. Feb. 2019;566(7743):218-223. doi: 10.1038/s41586-019-0908-x. Epub Feb. 4, 2019. Author manuscript entitled CRISPR-CasX is an RNA-dominated enzyme active for human genome editing.

Liu et al., Direct Promoter Repression by BCL11A Controls the Fetal to Adult Hemoglobin Switch. Cell. Apr. 5, 2018;173(2):430-442.e17. doi: 10.1016/j.cell.2018.03.016. Epub Mar. 29, 2018.

Liu et al., Editing DNA Methylation in the Mammalian Genome. Cell. Sep. 22, 2016;167(1):233- 247.e17. doi: 10.1016/j.cell.2016.08.056.

Liu et al., Flap endonuclease 1: a central component of DNA metabolism. Annu Rev Biochem. 2004;73:589-615. doi:10.1146/annurev.biochem.73.012803.092453.

Liu et al., Functional Nucleic Acid Sensors. Chem Rev. May 2009; 109(5):1948-98. doi: 10.1021/cr030183i.

(56) References Cited

OTHER PUBLICATIONS

Liu et al., Genetic incorporation of unnatural amino acids into proteins in mammalian cells. Nat Methods. Mar. 2007;4(3):239-44. Epub Feb. 25, 2007.

Liu et al., Highly efficient RNA-guided base editing in rabbit. Nat Commun. Jul. 13, 2018;9(1):2717. doi: 10.1038/s41467-018-05232-2.

Liu et al., (6)-methyladenosine-dependent RNA structural switches regulate RNA-protein interactions. Nature. Feb. 26, 2015;518(7540):560-4. doi: 10.1038/nature14234.

Liu et al., Probing N6-methyladenosine RNA modification status at single nucleotide resolution in mRNA and long noncoding RNA. RNA. Dec. 2013;19(12):1848-56. doi: 10.1261/rna.041178.113. Epub Oct. 18, 2013.

Liu et al., Reverse transcriptase of foamy virus. Purification of the enzymes and immunological identification. Arch Virol. 1977;55(3):187-200. doi: 10.1007/BF01319905.

Liu et al., Reverse transcriptase-mediated tropism switching in Bordetella bacteriophage. Science. Mar. 15, 2002;295(5562):2091-4. doi: 10.1126/science.1067467.

Liu et al., *Saccharomyces cerevisiae* flap endonuclease 1 uses flap equilibration to maintain triplet repeat stability. Mol Cell Biol. May 2004;24(9):4049-64. doi: 10.1128/MCB.24.9.4049-4064.2004.

Liu et al., The Molecular Architecture for RNA-Guided RNA Cleavage by Cas13a. Cell. Aug. 10, 2017;170(4):714-726.e10. doi: 10.1016/j.cell.2017.06.050. Epub Jul. 27, 2017.

Loessner et al., Complete nucleotide sequence, molecular analysis and genome structure of bacteriophage A118 of Listeria monocytogenes: implications for phage evolution. Mol Microbiol. Jan. 2000;35(2):324-40. doi: 10.1046/j.1365-2958.2000.01720.x.

Long et al., Postnatal genome editing partially restores dystrophin expression in a mouse model of muscular dystrophy. Science. Jan. 22, 2016;351(6271):400-3. doi: 10.1126/science.aad5725. Epub Dec. 31, 2015.

Lopez-Girona et al., Cereblon is a direct protein target for immunomodulatory and antiproliferative activities of lenalidomide and pomalidomide. Leukemia. Nov. 2012;26(11):2326-35. doi: 10.1038/leu.2012.119. Epub May 3, 2012.

Lorenz et al., ViennaRNA Package 2.0. Algorithms Mol Biol. Nov. 24, 2011;6:26. doi: 10.1186/1748-7188-6-26.

Luan et al., Reverse transcription of R2Bm RNA is primed by a nick at the chromosomal target site: a mechanism for non-LTR retrotransposition. Cell. Feb. 26, 1993;72(4):595-605. doi: 10.1016/0092-8674(93)90078-5.

Luckow et al., High level expression of nonfused foreign genes with Autographa californica nuclear polyhedrosis virus expression vectors. Virology. May 1989;170(1):31-9. doi: 10.1016/0042-6822(89)90348-6.

Lukacsovich et al., Repair of a specific double-strand break generated within a mammalian chromosome by yeast endonuclease I-SceI. Nucleic Acids Res. Dec. 25, 1994;22(25):5649-57. doi: 10.1093/nar/22.25.5649.

Lynch, Evolution of the mutation rate. Trends Genet. Aug. 2010;26(8):345-52. doi: 10.1016/j.tig.2010.05.003. Epub Jun. 30, 2010.

Lüke et al., Partial purification and characterization of the reverse transcriptase of the simian immunodeficiency virus TYO-7 isolated from an African green monkey. Biochemistry. Feb. 20, 1990;29(7):1764-9. doi: 10.1021/bi00459a015.

Ma et al., Identification of pseudo attP sites for phage phiC31 integrase in bovine genome. Biochem Biophys Res Commun. Jul. 7, 2006;345(3):984-8. doi: 10.1016/j.bbrc.2006.04.145. Epub May 3, 2006.

Ma et al., In vitro protein engineering using synthetic tRNA(Ala) with different anticodons. Biochemistry. Aug. 10, 1993;32(31):7939-45.

Ma et al., PhiC31 integrase induces efficient site-specific recombination in the Capra hircus genome. DNA Cell Biol. Aug. 2014;33(8):484-91. doi: 10.1089/dna.2013.2124. Epub Apr. 22, 2014.

Ma et al., Single-Stranded DNA Cleavage by Divergent CRISPR-Cas9 Enzymes. Mol Cell. Nov. 5, 2015;60(3):398-407. doi: 10.1016/j.molcel.2015.10.030.

Maas et al., Identification and characterization of a human tRNA-specific adenosine deaminase related to the ADAR family of pre-mRNA editing enzymes. Proc Natl Acad Sci U S A. Aug. 3, 1999;96(16):8895-900. doi: 10.1073/pnas.96.16.8895.

Macbeth et al., Inositol hexakisphosphate is bound in the ADAR2 core and required for RNA editing. Science. Sep. 2, 2005;309(5740):1534-9. doi: 10.1126/science.1113150.

Macrae et al., Ribonuclease revisited: structural insights into ribonuclease III family enzymes. Curr Opin Struct Biol. Feb. 2007;17(1):138-45. doi: 10.1016/j.sbi.2006.12.002. Epub Dec. 27, 2006.

Madura et al., Structural basis for ineffective T-cell responses to MHC anchor residue-improved "heteroclitic" peptides. Eur J Immunol. Feb. 2015;45(2):584-91. doi: 10.1002/eji.201445114. Epub Dec. 28, 2014.

Magin et al., Corf, the Rev/Rex homologue of HTDV/HERV-K, encodes an arginine-rich nuclear localization signal that exerts a trans-dominant phenotype when mutated. Virology. Aug. 15, 2000;274(1):11-6. doi: 10.1006/viro.2000.0438.

Maizels et al., Initiation of homologous recombination at DNA nicks. Nucleic Acids Res. Aug. 21, 2018;46(14):6962-6973. doi: 10.1093/nar/gky588.

Makarova et al., Classification and Nomenclature of CRISPR-Cas Systems: Where from Here? Crispr J. Oct. 2018;1(5):325-336. doi: 10.1089/crispr.2018.0033.

Makeyev et al., Evolutionary potential of an RNA virus. J Virol. Feb. 2004;78(4):2114-20.

Malashkevich et al., Crystal structure of tRNA adenosine deaminase TadA from *Escherichia coli*. Deposited: Mar. 10, 2005 Released: Feb. 21, 2006 doi:10.2210/pdb1z3a/pdb (2006).

Malito et al., Structural basis for lack of toxicity of the diphtheria toxin mutant CRM197. Proc Natl Acad Sci U S A. Apr. 3, 2012;109(14):5229-34. doi: 10.1073/pnas.1201964109. Epub Mar. 19, 2012.

Mandal et al., Efficient ablation of genes in human hematopoietic stem and effector cells using CRISPR/Cas9. Cell Stem Cell. Nov. 6, 2014;15(5):643-52. doi: 10.1016/j.stem.2014.10.004. Epub Nov. 6, 2014.

Mandal et al., Riboswitches Control Fundamental Biochemical Pathways in Bacillus Subtilis and Other Bacteria. Cell. May 30, 2003;113(5):577-86. doi: 10.1016/s0092-8674(03)00391-x.

Marceau, Functions of single-strand DNA-binding proteins in DNA replication, recombination, and repair. Methods Mol Biol. 2012;922:1-21. doi: 10.1007/978-1-62703-032-8_1.

Maresca et al., Obligate ligation-gated recombination (ObLiGaRe): custom-designed nuclease-mediated targeted integration through nonhomologous end joining. Genome Res. Mar. 2013;23(3):539-46. Doi: 10.1101/gr.145441.112. Epub Nov. 14, 2012.

Martinez et al., Hypermutagenesis of RNA using human immunodeficiency virus type 1 reverse transcriptase and biased dNTP concentrations. Proc Natl Acad Sci U S A. Dec. 6, 1994;91(25):11787-91. doi: 10.1073/pnas.91.25.11787.

Martsolf et al., Complete trisomy 17p a relatively new syndrome. Ann Genet. 1988;31(3):172-4.

Martz, L., Nav-i-gating antibodies for pain. Science-Business eXchange. Jun. 12, 2014;7(662):1-2. doi: 10.1038/scibx.2014.662.

Mascola et al., HIV-1 neutralizing antibodies: understanding nature's pathways. Immunol Rev. Jul. 2013;254(1):225-44. doi: 10.1111/imr.12075.

Mathys et al., Characterization of a self-splicing mini-intein and its conversion into autocatalytic- and C-terminal cleavage elements: facile production of protein building blocks for protein ligation. Gene. Apr. 29, 1999;231(1-2):1-13. doi: 10.1016/s0378-1119(99)00103-1.

Matsuura et al., A gene essential for the site-specific excision of actinophage r4 prophage genome from the chromosome of a lysogen. J Gen Appl Microbiol. 1995;41(1):53-61.

Matthews, Structures of human ADAR2 bound to dsRNA reveal base-flipping mechanism and basis for site selectivity. Nat Struct Mol Biol. May 2016;23(5):426-33. doi: 10.1038/nsmb.3203. Epub Apr. 11, 2016.

(56) References Cited

OTHER PUBLICATIONS

May et al., Emergent lineages of mumps virus suggest the need for a polyvalent vaccine. Int J Infect Dis. Jan. 2018;66:1-4. doi: 10.1016/j.ijid.2017.09.024. Epub Oct. 4, 2017.
McCarroll et al., Copy-number variation and association studies of human disease. Nat Genet. Jul. 2007;39(7 Suppl):S37-42. doi: 10.1038/ng2080.
Mconald et al., Characterization of mutations at the mouse phenylalanine hydroxylase locus. Genomics. Feb. 1, 1997;39(3):402-5. doi: 10.1006/geno.1996.4508.
Mcinerney et al., Error Rate Comparison during Polymerase Chain Reaction by DNA Polymerase. Mol Biol Int. 2014;2014:287430. doi: 10.1155/2014/287430. Epub Aug. 17, 2014.
Mckenna et al., Recording development with single cell dynamic lineage tracing. Development. Jun. 27, 2019;146(12):dev169730. doi: 10.1242/dev.169730.
Mckenna et al., Whole-organism lineage tracing by combinatorial and cumulative genome editing. Science. Jul. 29, 2016;353(6298):aaf7907. doi: 10.1126/science.aaf7907. Epub May 26, 2016.
Mcvey et al., MMEJ repair of double-strand breaks (director's cut): deleted sequences and alternative endings. Trends Genet. Nov. 2008;24(11):529-38. doi: 10.1016/j.tig.2008.08.007. Epub Sep. 21, 2008.
Mead et al., A novel protective prion protein variant that colocalizes with kuru exposure. Engl J Med. Nov. 19, 2009;361(21):2056-65. doi: 10.1056/NEJMoa0809716.
Meinke et al., Cre Recombinase and Other Tyrosine Recombinases. Chem Rev. Oct. 26, 2016;116(20):12785-12820. doi: 10.1021/acs.chemrev.6b00077. Epub May 10, 2016.
Menéndez-Arias, Mutation rates and intrinsic fidelity of retroviral reverse transcriptases. Viruses. Dec. 2009;1(3):1137-65. doi: 10.3390/v1031137. Epub Dec. 4, 2009.
Mertens et al., Site-specific recombination in bacteriophage Mu: characterization of binding sites for the DNA invertase Gin. EMBO J. Apr. 1988;7(4):1219-27.
Meyer et al., Comprehensive analysis of mRNA methylation reveals enrichment in 3' UTRs and near stop codons. Cell. Jun. 22, 2012;149(7):1635-46. doi: 10.1016/j.cell.2012.05.003. Epub May 17, 2012.
Meyer et al., Library generation by gene shuffling. Curr Protoc Mol Biol. Jan. 6, 2014;105:Unit 15.12.. doi: 10.1002/0471142727.mb1512s105.
Meyer et al., Ribosome biogenesis factor Tsr3 is the aminocarboxypropyl transferase responsible for 18S rRNA hypermodification in yeast and humans. Nucleic Acids Res. May 19, 2016;44(9):4304-16. doi: 10.1093/nar/gkw244. Epub Apr. 15, 2016.
Meyer et al., The dynamic epitranscriptome: N6-methyladenosine and gene expression control. Nat Rev Mol Cell Biol. May 2014;15(5):313-26. doi: 10.1038/nrm3785. Epub Apr. 9, 2014.
Michel et al., Mitochondrial class II introns encode proteins related to the reverse transcriptases of retroviruses. Nature. Aug. 15-21, 1985;316(6029):641-3. doi: 10.1038/316641a0.
Mihai et al., PTEN inhibition improves wound healing in lung epithelia through changes in cellular mechanics that enhance migration. Am J Physiol Lung Cell Mol Physiol. 2012;302(3):L287-L299.
Mijakovic et al., Bacterial single-stranded DNA-binding proteins are phosphorylated on tyrosine. Nucleic Acids Res. Mar. 20, 2006;34(5):1588-96. doi: 10.1093/nar/gkj514.
Miller et al., Construction and properties of retrovirus packaging cells based on gibbon ape leukemia virus. J Virol. May 1991;65(5):2220-4. doi: 10.1128/JVI.65.5.2220-2224.1991.
Miller, Human gene therapy comes of age. Nature. Jun. 11, 1992;357(6378):455-60. doi: 10.1038/357455a0.
Mills et al., Protein splicing in trans by purified- and C-terminal fragments of the *Mycobacterium tuberculosis* RecA intein. Proc Natl Acad Sci U S A. Mar. 31, 1998;95(7):3543-8. doi: 10.1073/pnas.95.7.3543.

Mir et al., Two Active Site Divalent Ions in the Crystal Structure of the Hammerhead Ribozyme Bound to a Transition State Analogue. Biochemistry. . Feb. 2, 2016;55(4):633-6. doi: 10.1021/acs.biochem.5b01139. Epub Jan. 19, 2016.
Mir et al., Type II-C CRISPR-Cas9 Biology, Mechanism, and Application. ACS Chem Biol. Feb. 16, 2018;13(2):357-365. doi: 10.1021/acschembio.7b00855. Epub Dec. 20, 2017.
Mishina et al., Conditional gene targeting on the pure C57BL/6 genetic background. Neurosci Res. Jun. 2007;58(2):105-12. doi: 10.1016/j.neures.2007.01.004. Epub Jan. 18, 2007.
Mitani et al., Delivering therapeutic genes—matching approach and application. Trends Biotechnol. May 1993;11(5):162-6. doi: 10.1016/0167-7799(93)90108-L.
Mitton-Fry et al., Poly(A) tail recognition by a viral RNA element through assembly of a triple helix. Science. Nov. 26, 2010;330(6008):1244-7. doi: 10.1126/science.1195858.
Miyaoka et al., Systematic quantification of HDR and NHEJ reveals effects of locus, nuclease, and cell type on genome-editing. Sci Rep. Mar. 31, 2016;6:23549. doi: 10.1038/srep23549.
Moede et al., Identification of a nuclear localization signal, RRMKWKK, in the homeodomain transcription factor PDX-1. FEBS Lett. Nov. 19, 1999;461(3):229-34. doi: 10.1016/s0014-5793(99)01446-5.
Mohr et al., A Reverse Transcriptase-Cas1 Fusion Protein Contains a Cas6 Domain Required for Both Crispr RNA Biogenesis and RNA Spacer Acquisition. Mol Cell. Nov. 15, 2018;72(4):700-714.e8. doi: 10.1016/j.molcel.2018.09.013. Epub Oct. 18, 2018.
Mohr et al., A Reverse Transcriptase-Cas1 Fusion Protein Contains a Cas6 Domain Required for Both Crispr RNA Biogenesis and RNA Spacer Acquisition. Mol Cell. Nov. 15, 2018;72(4):700-714.e8. doi: 10.1016/j.molcel.2018.09.013. Epub Oct. 18, 2018. Including Supplemental Information.
Mohr et al., Thermostable group II intron reverse transcriptase fusion proteins and their use in cDNA synthesis and next-generation RNA sequencing. RNA. Jul. 2013;19(7):958-70. doi: 10.1261/rna.039743.113. Epub May 22, 2013.
Mol et al., Crystal structure and mutational analysis of human uracil-DNA glycosylase: structural basis for specificity and catalysis. Cell. Mar. 24, 1995;80(6):869-78. doi: 10.1016/0092-8674(95)90290-2.
Monot et al., The specificity and flexibility of l1 reverse transcription priming at imperfect T-tracts. PLoS Genet. May 2013;9(5):e1003499. doi: 10.1371/journal.pgen.1003499. Epub May 9, 2013.
Mootz et al., Protein splicing triggered by a small molecule. J Am Chem Soc. Aug. 7, 2002;124(31):9044-5 and Supporting Information. doi: 10.1021/ja0267690. 4 pages.
Moreno-Mateos et al., CRISPRscan: designing highly efficient sgRNAs for CRISPR-Cas9 targeting in vivo. Nat Methods. Oct. 2015;12(10):982-8. doi: 10.1038/nmeth.3543. Epub Aug. 31, 2015.
Morita et al., The site-specific recombination system of actinophage TG1. FEMS Microbiol Lett. Aug. 2009;297(2):234-40. doi: 10.1111/j.1574-6968.2009.01683.x.
Mougiakos et al., Characterizing a thermostable Cas9 for bacterial genome editing and silencing. Nat Commun. Nov. 21, 2017;8(1):1647. doi: 10.1038/s41467-017-01591-4.
Muir et al., Expressed protein ligation: a general method for protein engineering. Proc Natl Acad Sci U S A. Jun. 9, 1998;95(12):6705-10. doi: 10.1073/pnas.95.12.6705.
Muller et al., Nucleotide exchange and excision technology (NExT) DNA shuffling: a robust method for DNA fragmentation and directed evolution. Nucleic Acids Res. Aug. 1, 2005;33(13):e117. doi: 10.1093/nar/gni116. PMID: 16061932; PMCID: PMC1182171.
Muller, U.F., Design and Experimental Evolution of trans-Splicing Group I Intron Ribozymes. Molecules. Jan. 2, 2017;22(1):75. doi: 10.3390/molecules22010075.
Mumtsidu et al., Structural features of the single-stranded DNA-binding protein of Epstein-Barr virus. J Struct Biol. Feb. 2008;161(2):172-87. doi: 10.1016/j.jsb.2007.10.014. Epub Nov. 1, 2007.
Muzyczka et al., Adeno-associated virus (AAV) vectors: will they work? J Clin Invest. Oct. 1994;94(4):1351. doi: 10.1172/JCI117468.

(56) References Cited

OTHER PUBLICATIONS

Myerowitz et al., The major defect in Ashkenazi Jews with Tay-Sachs disease is an insertion in the gene for the alpha-chain of beta-hexosaminidase. J Biol Chem. Dec. 15, 1988;263(35):18587-9.
Myers et al., Insulin signal transduction and the IRS proteins. Annu Rev Pharmacol Toxicol. 1996;36:615-58. doi: 10.1146/annurev.pa. 36.040196.003151.
Nabel et al., Direct gene transfer for immunotherapy and immunization. Trends Biotechnol. May 1993;11(5):211-5. doi: 10.1016/0167-7799(93)90117-R.
Nahar et al., A G-quadruplex motif at the 3' end of sgRNAs improves CRISPR-Cas9 based genome editing efficiency. Chem Commun (Camb). Mar. 7, 2018;54(19):2377-2380. doi: 10.1039/c7cc08893k. Epub Feb. 16, 2018.
Nakade et al., Microhomology-mediated end-joining-dependent integration of donor DNA in cells and animals using TALENs and CRISPR/Cas9. Nat Commun. Nov. 20, 2014;5:5560. doi: 10.1038/ncomms6560.
Nakamura et al., Codon usage tabulated from international DNA sequence databases: status for the year 2000. Nucleic Acids Res. Jan. 1, 2000;28(1):292. doi: 10.1093/nar/28.1.292.
Naorem et al., DGR mutagenic transposition occurs via hypermutagenic reverse transcription primed by nicked template RNA. Proc Natl Acad Sci U S A. Nov. 21, 2017;114(47):E10187-E10195. doi: 10.1073/pnas.1715952114. Epub Nov. 6, 2017.
Nern et al., Multiple new site-specific recombinases for use in manipulating animal genomes. Proc Natl Acad Sci U S A. Aug. 23, 2011;108(34):14198-203. doi: 10.1073/pnas.1111704108. Epub Aug. 9, 2011.
Nguyen et al., Evolutionary drivers of thermoadaptation in enzyme catalysis. Science. Jan. 20, 2017;355(6322):289-294. doi: 10.1126/science.aah3717. Epub Dec. 22, 2016.
Nguyen et al., IQ-TREE: a fast and effective stochastic algorithm for estimating maximum-likelihood phylogenies. Mol Biol Evol. Jan. 2015;32(1):268-74. doi: 10.1093/molbev/msu300. Epub Nov. 3, 2014.
Ni et al., A PCSK9-binding antibody that structurally mimics the EGF(A) domain of LDL-receptor reduces LDL cholesterol in vivo. J Lipid Res. 2011;52:76-86.
Nishida et al., Targeted nucleotide editing using hybrid prokaryotic and vertebrate adaptive immune systems. Science. Sep. 16, 2016;353(6305). pii: aaf8729. doi: 10.1126/science.aaf8729. Epub Aug. 4, 2016.
Nishikura, Functions and regulation of RNA editing by ADAR deaminases. Annu Rev Biochem. 2010;79:321-349. doi:10.1146/annurev-biochem-060208-105251.
Nishimasu et al., Crystal Structure of *Staphylococcus aureus* Cas9. Cell. Aug. 27, 2015;162(5): 1113-26. doi: 10.1016/j.cell.2015.08.007.
Nishimasu et al., Engineered CRISPR-Cas9 nuclease with expanded targeting space. Science. Sep. 21, 2018;361(6408):1259-1262. doi: 10.1126/science.aas9129. Epub Aug. 30, 2018.
Nomura et al., Controlling Mammalian Gene Expression by Allosteric Hepatitis Delta Virus Ribozymes. ACS Synth Biol. Dec. 20, 2013;2(12):684-9. doi: 10.1021/sb400037a. Epub May 22, 2013.
Nottingham et al., RNA-seq of human reference RNA samples using a thermostable group II intron reverse transcriptase. RNA. Apr. 2016;22(4):597-613. doi: 10.1261/rna.055558.115. Epub Jan. 29, 2016.
Nowak et al., Characterization of single-stranded DNA-binding proteins from the psychrophilic bacteria *Desulfotalea psychrophila, Flavobacterium psychrophilum, Psychrobacter arcticus, Psychrobacter cryohalolentis, Psychromonas ingrahamii, Psychroflexus torquis,* and *Photobacterium profundum.* BMC Microbiol. Apr. 14, 2014;14:91. doi: 10.1186/1471-2180-14-91.
Nowak et al., Guide RNA Engineering for Versatile Cas9 Functionality. Nucleic Acids Res. Nov. 16, 2016;44(20):9555-9564. doi: 10.1093/nar/gkw908. Epub Oct. 12, 2016.
Nowak et al., Structural analysis of monomeric retroviral reverse transcriptase in complex with an RNA/DNA hybrid. Nucleic Acids Res. Apr. 1, 2013;41(6):3874-87. doi: 10.1093/nar/gkt053. Epub Feb. 4, 2013.
Numrych et al., A comparison of the effects of single-base and triple-base changes in the integrase arm-type binding sites on the site-specific recombination of bacteriophage lambda. Nucleic Acids Res. Jul. 11, 1990;18(13):3953-9. doi: 10.1093/nar/18.13.3953.
Nyerges et al., A highly precise and portable genome engineering method allows comparison of mutational effects across bacterial species. Proc Natl Acad Sci U S A. Mar. 1, 2016;113(9):2502-7. doi: 10.1073/pnas.1520040113. Epub Feb. 16, 2016.
O'Maille et al., Structure-based combinatorial protein engineering (SCOPE). J Mol Biol. Aug. 23, 2002;321(4):677-91.
Oakes et al., CRISPR-Cas9 Circular Permutants as Programmable Scaffolds for Genome Modification. Cell. Jan. 10, 2019;176(1-2):254-267.e16. doi: 10.1016/j.cell.2018.11.052.
Oakes et al., Profiling of engineering hotspots identifies an allosteric CRISPR-Cas9 switch. Nat Biotechnol. Jun. 2016;34(6):646-51. doi: 10.1038/nbt.3528. Epub May 2, 2016.
Odsbu et al., Specific -terminal interactions of the *Escherichia coli* SeqA protein are required to form multimers that restrain negative supercoils and form foci. Genes Cells. Nov. 2005;10(11):1039-49.
Oeemig et al., Solution structure of DnaE intein from Nostoc punctiforme: structural basis for the design of a new split intein suitable for site-specific chemical modification. FEBS Lett. May 6, 2009;583(9):1451-6.
Oh et al., Positional cloning of a gene for Hermansky-Pudlak syndrome, a disorder of cytoplasmic organelles. Nat Genet. Nov. 1996;14(3):300-6. doi: 10.1038/ng1196-300.
Ohe et al., Purification and properties of xanthine dehydrogenase from Streptomyces cyanogenus. J Biochem. Jul. 1979;86(1):45-53.
Olivares et al., Site-specific genomic integration produces therapeutic Factor IX levels in mice. Nat Biotechnol. Nov. 2002;20(11):1124-8. doi: 10.1038/nbt753. Epub Oct. 15, 2002.
Olorunniji et al., Purification and In Vitro Characterization of Zinc Finger Recombinases. Methods Mol Biol. 2017;1642:229-245. doi: 10.1007/978-1-4939-7169-5_15.
Olorunniji et al., Site-specific recombinases: molecular machines for the Genetic Revolution. Biochem J. Mar. 15, 2016;473(6):673-84. doi: 10.1042/BJ20151112.
Olorunniji et al., Synapsis and catalysis by activated Tn3 resolvase mutants. Nucleic Acids Res. Dec. 2008;36(22):7181-91. doi: 10.1093/nar/gkn885. Epub Nov. 10, 2008.
Orlando et al., Zinc-finger nuclease-driven targeted integration into mammalian genomes using donors with limited chromosomal homology. Nucleic Acids Res. Aug. 2010;38(15):e152. doi: 10.1093/nar/gkq512. Epub Jun. 8, 2010.
Orthwein et al., A mechanism for the suppression of homologous recombination in G1 cells. Nature. Dec. 17, 2015;528(7582):422-6. doi: 10.1038/nature16142. Epub Dec. 9, 2015.
Ortiz-Urda et al., Stable nonviral genetic correction of inherited human skin disease. Nat Med. Oct. 2002;8(10):1166-70. doi: 10.1038/nm766. Epub Sep. 16, 2002. Erratum in: Nat Med. Feb. 2003;9(2):237.
Ostermeier et al., A combinatorial approach to hybrid enzymes independent of DNA homology. Nat Biotechnol. Dec. 1999;17(12):1205-9.
Ostertag et al., Biology of mammalian L1 retrotransposons. Annu Rev Genet. 2001;35:501-38. doi: 10.1146/annurev.genet.35.102401.091032.
Otomo et al., Improved segmental isotope labeling of proteins and application to a larger protein. J Biomol NMR. Jun. 1999;14(2):105-14. doi: 10.1023/a:1008308128050.
Otomo et al., NMR observation of selected segments in a larger protein: central-segment isotope labeling through intein-mediated ligation. Biochemistry. Dec. 7, 1999;38(49):16040-4. doi: 10.1021/bi991902j.
Otto et al., The probability of fixation in populations of changing size. Genetics. Jun. 1997;146(2):723-33.
Packer et al., Methods for the directed evolution of proteins. Nat Rev Genet. Jul. 2015;16(7):379-94. doi: 10.1038/nrg3927. Epub Jun. 9, 2015.

(56) References Cited

OTHER PUBLICATIONS

Packer et al., Phage-assisted continuous evolution of proteases with altered substrate specificity. Nat Commun. Oct. 16, 2017;8(1):956. doi: 10.1038/s41467-017-01055-9.
Paige et al., RNA mimics of green fluorescent protein. Science. Jul. 29, 2011;333(6042):642-6. doi:10.1126/science.1207339.
Paquet et al., Efficient introduction of specific homozygous and heterozygous mutations using CRISPR/Cas9. Nature. May 5, 2016;533(7601):125-9. doi: 10.1038/nature17664. Epub Apr. 27, 2016.
Park et al., Digenome-seq web tool for profiling CRISPR specificity. Nat Methods. May 30, 2017;14(6):548-549. doi: 10.1038/nmeth. 4262.
Park et al., Highly efficient editing of the ?-globin gene in patient-derived hematopoietic stem and progenitor cells to treat sickle cell disease. Nucleic Acids Res. Sep. 5, 2019;47(15):7955-7972. doi: 10.1093/nar/gkz475.
Park et al., Sendai virus, an RNA virus with no risk of genomic integration, delivers CRISPR/Cas9 for efficient gene editing. Mol Ther Methods Clin Dev. Aug. 24, 2016;3:16057. doi: 10.1038/mtm. 2016.57.
Partial European Search Report for Application No. EP 19187331.4, mailed Dec. 19, 2019.
Patel et al., Flap endonucleases pass 5'-flaps through a flexible arch using a disorder-thread-order mechanism to confer specificity for free 5'-ends. Nucleic Acids Res. May 2012;40(10):4507-19. doi: 10.1093/nar/gks051. Epub Feb. 8, 2012.
Pawson et al., Protein phosphorylation in signaling—50 years and counting. Trends Biochem Sci. Jun. 2005;30(6):286-90. doi: 10.1016/j.tibs.2005.04.013.
Pellenz et al., New human chromosomal safe harbor sites for genome engineering with CRISPR/Cas9, TAL effector and homing endonucleases. Aug. 20, 2018. bioRxiv doi: https://doi.org/10.1101/396390.
Perach et al., Catalytic features of the recombinant reverse transcriptase of bovine leukemia virus expressed in bacteria. Virology. Jun. 20, 1999;259(1):176-89. doi: 10.1006/viro.1999.9761.
Perler et al., Protein splicing and autoproteolysis mechanisms. Curr Opin Chem Biol. Oct. 1997;1(3):292-9. doi: 10.1016/s1367-5931(97)80065-8.
Perler et al., Protein splicing elements: inteins and exteins—a definition of terms and recommended nomenclature. Nucleic Acids Res. Apr. 11, 1994;22(7):1125-7. doi: 10.1093/nar/22.7.1125.
Perler, InBase, the New England Biolabs Intein Database. Nucleic Acids Res. Jan. 1, 1999;27(1):346-7. doi: 10.1093/nar/27.1.346.
Perler, Protein splicing of inteins and hedgehog autoproteolysis: structure, function, and evolution. Cell. Jan. 9, 1998;92(1):1-4. doi: 10.1016/s0092-8674(00)80892-2.
Perreault et al., Mixed deoxyribo- and ribo-oligonucleotides with catalytic activity. Nature. Apr. 5, 1990;344(6266):565-7. doi: 10.1038/344565a0.
Petersen-Mahrt et al., AID mutates *E. coli* suggesting a DNA deamination mechanism for antibody diversification. Nature. Jul. 4, 2002;418(6893):99-103.
Peyrottes et al., Oligodeoxynucleoside phosphoramidates (P-NH2): synthesis and thermal stability of duplexes with DNA and RNA targets. Nucleic Acids Res. May 15, 1996;24(10):1841- 8.
Pfeiffer et al., Mechanisms of DNA double-strand break repair and their potential to induce chromosomal aberrations. Mutagenesis. Jul. 2000;15(4):289-302. doi: 10.1093/mutage/15.4.289.
Pickart et al., Ubiquitin: structures, functions, mechanisms. Biochim Biophys Acta. Nov. 29, 2004;1695(1-3):55-72. doi: 10.1016/j.bbamcr. 2004.09.019.
Pieken et al., Kinetic characterization of ribonuclease-resistant 2'-modified hammerhead ribozymes. Science. Jul. 19, 1991;253(5017):314-7. doi: 10.1126/science.1857967.
Pinkert et al., An albumin enhancer located 10 kb upstream functions along with its promoter to direct efficient, liver-specific expression in transgenic mice. Genes Dev. May 1987;1(3):268-76. doi: 10.1101/gad.1.3.268.
Pirakitikulr et al., PCRless library mutagenesis via oligonucleotide recombination in yeast. Protein Sci. Dec. 2010;19(12):2336-46. doi: 10.1002/pro.513.
Popp et al., Sortagging: a versatile method for protein labeling. Nat Chem Biol. Nov. 2007;3(11):707-8. doi: 10.1038/nchembio.2007. 31. Epub Sep. 23, 2007.
Posnick et al., Imbalanced base excision repair increases spontaneous mutation and alkylation sensitivity in *Escherichia coli*. J Bacteriol. Nov. 1999;181(21):6763-71.
Pospísilová et al., Hydrolytic cleavage of N6-substituted adenine derivatives by eukaryotic adenine and adenosine deaminases. Biosci Rep. 2008;28(6):335-347. doi:10.1042/BSR20080081.
Prasad et al., Rev1 is a base excision repair enzyme with 5'-deoxyribose phosphate lyase activity. Nucleic Acids Res. Dec. 15, 2016;44(22):10824-10833. doi: 10.1093/nar/gkw869. Epub Sep. 28, 2016.
Pruschy et al., Mechanistic studies of a signaling pathway activated by the organic dimerizer FK1012. Chem Biol. Nov. 1994;1(3):163-72. doi: 10.1016/1074-5521(94)90006-x.
Pu et al., Evolution of a split RNA polymerase as a versatile biosensor platform. Nat Chem Biol. Apr. 2017;13(4):432-438. doi: 10.1038/nchembio.2299. Epub Feb. 13, 2017.
Qu et al., Global mapping of binding sites for phic31 integrase in transgenic maden-darby bovine kidney cells using ChIP-seq. Hereditas. Jan. 14, 2019;156:3. doi: 10.1186/s41065-018-0079-z.
Queen et al., Immunoglobulin gene transcription is activated by downstream sequence elements. Cell. Jul. 1983;33(3):741-8. doi: 10.1016/0092-8674(83)90016-8.
Radany et al., Increased spontaneous mutation frequency in human cells expressing the phage PBS2-encoded inhibitor of uracil-DNA glycosylase. Mutat Res. Sep. 15, 2000;461(1):41-58. doi: 10.1016/s0921-8777(00)00040-9.
Raghavan et al., Abstract 27: Therapeutic Targeting of Human Lipid Genes with in vivo CRISPR-Cas9 Genome Editing. Oral Abstract Presentations: Lipoprotein Metabolism and Therapeutic Targets. Arterioscler THromb Vasc Biol. 2015;35(Suppl. 1):Abstract 27. 5 pages.
Raillard et al., Targeting sites within HIV-1 cDNA with a DNA-cleaving ribozyme. Biochemistry. Sep. 10, 1996;35(36):11693-701. doi: 10.1021/bi960845g.
Raina et al., PROTAC-induced BET protein degradation as a therapy for castration-resistant prostate cancer. Proc Natl Acad Sci U S A. Jun. 28, 2016;113(26):7124-9. doi: 10.1073/pnas. 1521738113. Epub Jun. 6, 2016.
Ranzau et al., Genome, Epigenome, and Transcriptome Editing via Chemical Modification of Nucleobases in Living Cells. Biochemistry. Feb. 5, 2019;58(5):330-335. doi: 10.1021/acs.biochem. 8b00958. Epub Dec. 12, 2018.
Rashel et al., A novel site-specific recombination system derived from bacteriophage phiMR11. Biochem Biophys Res Commun. Apr. 4, 2008;368(2):192-8. doi: 10.1016/j.bbrc.2008.01.045. Epub Jan. 22, 2008.
Rasila et al., Critical evaluation of random mutagenesis by error-prone polymerase chain reaction protocols, *Escherichia coli* mutator strain, and hydroxylamine treatment. Anal Biochem. May 1, 2009;388(1):71-80. doi: 10.1016/j.ab.2009.02.008. Epub Feb. 10, 2009.
Raskin et al., Substitution of a single bacteriophage T3 residue in bacteriophage T7 RNA polymerase at position 748 results in a switch in promoter specificity. J Mol Biol. Nov. 20, 1992;228(2):506-15.
Raskin et al., T7 RNA polymerase mutants with altered promoter specificities. Proc Natl Acad Sci U S A. Apr. 15, 1993;90(8):3147-51.
Rauch et al., Programmable RNA Binding Proteins for Imaging and Therapeutics. Biochemistry. Jan. 30, 2018;57(4):363-364. doi: 10.1021/acs.biochem.7b01101. Epub Nov. 17, 2017.
Ray et al., A compendium of RNA-binding motifs for decoding gene regulation. Nature. Jul. 11, 2013;499(7457):172-7. doi: 10.1038/nature12311.
Rebar et al., Phage display methods for selecting zinc finger proteins with novel DNA-binding specificities. Methods Enzymol. 1996;267:129-49.

(56) References Cited

OTHER PUBLICATIONS

Rees et al., Analysis and minimization of cellular RNA editing by DNA adenine base editors. Sci Adv. May 8, 2019;5(5):eaax5717. doi: 10.1126/sciadv.aax5717.

Rees et al., Base editing: precision chemistry on the genome and transcriptome of living cells. Nat Rev Genet. Dec. 2018;19(12):770-788. doi: 10.1038/s41576-018-0059-1.

Rees et al., Development of hRad51-Cas9 nickase fusions that mediate HDR without double-stranded breaks. Nat Commun. May 17, 2019;10(1):2212. doi: 10.1038/s41467-019-09983-4.

Relph et al., Recent developments and current status of gene therapy using viral vectors in the United Kingdom. BMJ. 2004;329(7470):839-842. doi:10.1136/bmj.329.7470.839.

Remy et al., Gene transfer with a series of lipophilic DNA-binding molecules. Bioconjug Chem. Nov.-Dec. 1994;5(6):647-54. doi: 10.1021/bc00030a021.

Ren et al., In-line Alignment and $Mg^{2}$? Coordination at the Cleavage Site of the env22 Twister Ribozyme. Nat Commun. Nov. 20, 2014;5:5534. doi: 10.1038/ncomms6534.

Ren et al., Pistol Ribozyme Adopts a Pseudoknot Fold Facilitating Site-Specific In-Line Cleavage. Nat Chem Biol. Sep. 2016;12(9):702-8. doi: 10.1038/nchembio.2125. Epub Jul. 11, 2016.

Ribeiro et al., Protein Engineering Strategies to Expand CRISPR-Cas9 Applications. Int J Genomics. Aug. 2, 2018;2018:1652567. doi: 10.1155/2018/1652567.

Ringrose et al., The Kw recombinase, an integrase from Kluyveromyces waltii. Eur J Biochem. Sep. 15, 1997;248(3):903-12. doi: 10.1111/j.1432-1033.1997.00903.x.

Risso et al., Hyperstability and substrate promiscuity in laboratory resurrections of Precambrian ?-lactamases. J Am Chem Soc. Feb. 27, 2013;135(8):2899-902. doi: 10.1021/ja311630a. Epub Feb. 14, 2013.

Ritchie et al., limma powers differential expression analyses for RNA-sequencing and microarray studies. Nucleic Acids Res. Apr. 20, 2015;43(7):e47. doi: 10.1093/nar/gkv007. Epub Jan. 20, 2015.

Robertson et al., DNA repair in mammalian cells: Base excision repair: the long and short of it. Cell Mol Life Sci. Mar. 2009;66(6):981-93. doi: 10.1007/s00018-009-8736-z.

Robertson et al., Selection in vitro of an RNA enzyme that specifically cleaves single-stranded DNA. Nature. Mar. 29, 1990;344(6265):467-8. doi: 10.1038/344467a0.

Robinson et al., The protein tyrosine kinase family of the human genome. Oncogene. Nov. 20, 2000;19(49):5548-57. doi: 10.1038/sj.onc.1203957.

Rogozin et al., Evolution and diversification of lamprey antigen receptors: evidence for involvement of an AID-APOBEC family cytosine deaminase. Nat Immunol. Jun. 2007;8(6):647-56. doi: 10.1038/ni1463. Epub Apr. 29, 2007.

Roth et al., A widespread self-cleaving ribozyme class is revealed by bioinformatics. Nat Chem Biol. Jan. 2014;10(1):56-60. doi: 10.1038/nchembio.1386. Epub Nov. 17, 2013.

Roth et al., Purification and characterization of murine retroviral reverse transcriptase expressed in *Escherichia coli*. J Biol Chem. Aug. 5, 1985;260(16):9326-35.

Rouet et al., Expression of a site-specific endonuclease stimulates homologous recombination in mammalian cells. Proc Natl Acad Sci U S A. Jun. 21, 1994;91(13):6064-8. doi: 10.1073/pnas.91.13.6064.

Rouet et al., Introduction of double-strand breaks into the genome of mouse cells by expression of a rare-cutting endonuclease. Mol Cell Biol. Dec. 1994;14(12):8096-106. doi: 10.1128/mcb.14.12.8096.

Rouet et al., Receptor-Mediated Delivery of CRISPR-Cas9 Endonuclease for Cell-Type-Specific Gene Editing. J Am Chem Soc. May 30, 2018;140(21):6596-6603. doi: 10.1021/jacs.8b01551. Epub May 18, 2018.

Roundtree et al., YTHDC1 mediates nuclear export of N6-methyladenosine methylated mRNAs. Elife. Oct. 6, 2017;6:e31311. doi: 10.7554/eLife.31311.

Rowland et al., Sin recombinase from *Staphylococcus aureus*: synaptic complex architecture and transposon targeting. Mol Microbiol. May 2002;44(3):607-19. doi: 10.1046/j.1365-2958.2002.02897.x.

Rowley, Chromosome translocations: dangerous liaisons revisited. Nat Rev Cancer. Dec. 2001;1(3):245-50. doi: 10.1038/35106108.

Rubio et al., An adenosine-to-inosine tRNA-editing enzyme that can perform C-to-U deamination of DNA. Proc Natl Acad Sci U S A. May 8, 2007;104(19):7821-6. doi: 10.1073/pnas.0702394104. Epub May 1, 2007. PMID: 17483465; PMCID: PMC1876531.

Rubio et al., Transfer RNA travels from the cytoplasm to organelles. Wiley Interdiscip Rev RNA. Nov.-Dec. 2011;2(6):802-17. doi: 10.1002/wrna.93. Epub Jul. 11, 2011.

Rutherford et al., Attachment site recognition and regulation of directionality by the serine integrases. Nucleic Acids Res. Sep. 2013;41(17):8341-56. doi: 10.1093/nar/gkt580. Epub Jul. 2, 2013.

Ryu et al., Adenine base editing in mouse embryos and an adult mouse model of Duchenne muscular dystrophy. Nat Biotechnol. Jul. 2018;36(6):536-539. doi: 10.1038/nbt.4148. Epub Apr. 27, 2018.

Rüfer et al., Non-contact positions impose site selectivity on Cre recombinase. Nucleic Acids Res. Jul. 1, 2002;30(13):2764-71. doi: 10.1093/nar/gkf399.

Sadowski, The Flp recombinase of the 2-microns plasmid of *Saccharomyces cerevisiae*. Prog Nucleic Acid Res Mol Biol. 1995;51:53-91.

Sakuma et al., MMEJ-assisted gene knock-in using TALENs and CRISPR-Cas9 with the PITCh systems. Nat Protoc. Jan. 2016;11(1):118-33. doi: 10.1038/nprot.2015.140. Epub Dec. 17, 2015.

Sale et al., Y-family DNA polymerases and their role in tolerance of cellular DNA damage. Nat Rev Mol Cell Biol. Feb. 23, 2012;13(3):141-52. doi: 10.1038/nrm3289.

Samanta et al., A reverse transcriptase ribozyme. Elife. Sep. 26, 2017;6:e31153. doi: 10.7554/eLife.31153.

Samulski et al., Helper-free stocks of recombinant adeno-associated viruses: normal integration does not require viral gene expression. J Virol. Sep. 1989;63(9):3822-8. doi: 10.1128/JVI.63.9.3822-3828.1989.

Sang et al., A unique uracil-DNA binding protein of the uracil DNA glycosylase superfamily. Nucleic Acids Res. Sep. 30, 2015;43(17):8452-63. doi: 10.1093/nar/gkv854. Epub Aug. 24, 2015.

Santoro et al., Directed evolution of the site specificity of Cre recombinase. Proc Natl Acad Sci U S A. Apr. 2, 2002;99(7):4185-90. Epub Mar. 19, 2002.

Saparbaev et al., Excision of hypoxanthine from DNA containing dIMP residues by the *Escherichia coli*, yeast, rat, and human alkylpurine DNA glycosylases. Proc Natl Acad Sci U S A. Jun. 21, 1994;91(13):5873-7. doi: 10.1073/pnas.91.13.5873.

Sapunar et al., Dorsal root ganglion—a potential new therapeutic target for neuropathic pain. J Pain Res. 2012;5:31-8. doi: 10.2147/JPR.S26603. Epub Feb. 16, 2012.

Sarkar et al., HIV-1 proviral DNA excision using an evolved recombinase. Science. Jun. 29, 2007;316(5833):1912-5. doi: 10.1126/science.1141453.

Sasidharan et al., The selection of acceptable protein mutations. PNAS; Jun. 12, 2007;104(24):10080-5. www.pnas.org/cgi/doi/10.1073.pnas.0703737104.

Satomura et al., Precise genome-wide base editing by the CRISPR Nickase system in yeast. Sci Rep. May 18, 2017;7(1):2095. doi: 10.1038/s41598-017-02013-7.

Sauer et al., DNA recombination with a heterospecific Cre homolog identified from comparison of the pac-c1 regions of P1-related phages. Nucleic Acids Res. Nov. 18, 2004;32(20):6086-95. doi: 10.1093/nar/gkh941.

Savic et al., Covalent linkage of the DNA repair template to the CRISPR-Cas9 nuclease enhances homology-directed repair. Elife. May 29, 2018;7:e33761. doi: 10.7554/eLife.33761.

Saville et al., A site-specific self-cleavage reaction performed by a novel RNA in Neurospora mitochondria. Cell. May 18, 1990;61(4):685-96. doi: 10.1016/0092-8674(90)90480-3.

Savva et al., The structural basis of specific base-excision repair by uracil-DNA glycosylase. Nature. Feb. 9, 1995;373(6514):487-93. doi: 10.1038/373487a0.

(56) References Cited

OTHER PUBLICATIONS

Schaaper et al., Base selection, proofreading, and mismatch repair during DNA replication in *Escherichia coli*. J Biol Chem. Nov. 15, 1993;268(32):23762-5.
Schaaper et al., Spectra of spontaneous mutations in *Escherichia coli* strains defective in mismatch correction: the nature of in vivo DNA replication errors. Proc Natl Acad Sci U S A. Sep. 1987;84(17):6220-4.
Schaefer et al., Understanding RNA modifications: the promises and technological bottlenecks of the 'epitranscriptome'. Open Biol. May 2017;7(5):170077. doi: 10.1098/rsob.170077.
Schechner et al., Multiplexable, locus-specific targeting of long RNAs with CRISPR-Display. Nat Methods. Jul. 2015; 12(7):664-70. doi: 10.1038/nmeth.3433. Epub Jun. 1, 2015.
Schechner et al., Multiplexable, locus-specific targeting of long RNAs with CRISPR-Display. Nat Methods. Jul. 2015;12(7):664-70. doi: 10.1038/nmeth.3433. Epub Jun. 1, 2015. Author manuscript entitled CRISPR Display: A modular method for locus-specific targeting of long noncoding RNAs and synthetic RNA devices in vivo.
Schek et al., Definition of the upstream efficiency element of the simian virus 40 late polyadenylation signal by using in vitro analyses. Mol Cell Biol. Dec. 1992;12(12):5386-93. doi: 10.1128/mcb.12.12.5386.
Schenk et al., MPDU1 mutations underlie a novel human congenital disorder of glycosylation, designated type If. J Clin Invest. Dec. 2001;108(11):1687-95. doi: 10.1172/JCI13419.
Schmitz et al., Behavioral abnormalities in prion protein knockout mice and the potential relevance of PrP(C) for the cytoskeleton. Prion. 2014;8(6):381-6. doi: 10.4161/19336896.2014.983746.
Schultz et al., Expression and secretion in yeast of a 400-kDa envelope glycoprotein derived from Epstein-Barr virus. Gene. 1987;54(1):113-23. doi: 10.1016/0378-1119(87)90353-2.
Schultz et al., Oligo-2'-fluoro-2'-deoxynucleotide N3'→P5' phosphoramidates: synthesis and properties. Nucleic Acids Res. Aug. 1, 1996;24(15):2966-73.
Schöller et al., Interactions, localization, and phosphorylation of the m6A generating METTL3-METTL14-WTAP complex. RNA. Apr. 2018;24(4):499-512. doi: 10.1261/rna.064063.117. Epub Jan. 18, 2018.
Score Results for Luetticken et al., Complete genome sequence of a *Streptococcus dysgalactiae* subsp. RT *equisimilis* strain possessing Lancefield's group A antigen. RL Submitted to the EMBL/GenBank/DDBJ databases. May 2012. 3 pages.
Score Results for Okumura et al., Evolutionary paths of streptococcal and staphylococcal superantigens. RL BMC Genomics. 2012;13:404-404. 3 pages.
Score Results for Shimomura et al., Complete Genome Sequencing and Analysis of a Lancefield Group G RT *Streptococcus dysagalactiae* Subsp. *equisimilis* Strain Causing Streptococcal RT Toxic Shock Syndrome (Stss). RL BMC Genomics. 2011;12:17-17. 3 pages.
Scott et al., Production of cyclic peptides and proteins in vivo. Proc Natl Acad Sci U S A. Nov. 23, 1999;96(24):13638-43. doi: 10.1073/pnas.96.24.13638.
Sebastián-Martín et al., Transcriptional inaccuracy threshold attenuates differences in RNA-dependent DNA synthesis fidelity between retroviral reverse transcriptases. Sci Rep. Jan. 12, 2018;8(1):627. doi: 10.1038/s41598-017-18974-8.
Seed, An LFA-3 cDNA encodes a phospholipid-linked membrane protein homologous to its receptor CD2. Nature. Oct. 29-Nov. 4, 1987;329(6142):840-2. doi: 10.1038/329840a0.
Serrano-Heras et al., Protein p56 from the Bacillus subtilis phage phi29 inhibits DNA-binding ability of uracil-DNA glycosylase. Nucleic Acids Res. 2007;35(16):5393-401. Epub Aug. 13, 2007.
Severinov et al., Expressed protein ligation, a novel method for studying protein-protein interactions in transcription. J Biol Chem. Jun. 26, 1998;273(26):16205-9. doi: 10.1074/jbc.273.26.16205.
Sha et al., Monobodies and other synthetic binding proteins for expanding protein science. Protein Sci. May 2017;26(5):910-924. doi: 10.1002/pro.3148. Epub Mar. 24, 2017.
Shah et al., Protospacer recognition motifs: mixed identities and functional diversity. RNA Biol. May 2013;10(5):891-9. doi: 10.4161/rna.23764. Epub Feb. 12, 2013.
Shalem et al., High-throughput functional genomics using CRISPR-Cas9. Nat Rev Genet. May 2015;16(5):299-311. doi: 10.1038/nrg3899. Epub Apr. 9, 2015.
Sharer et al., The ARF-like 2 (ARL2)-binding protein, BART. Purification, cloning, and initial characterization. J Biol Chem. Sep. 24, 1999;274(39):27553-61. doi: 10.1074/jbc.274.39.27553.
Sharma et al., Identification of novel methyltransferases, Bmt5 and Bmt6, responsible for the m3U methylations of 25S rRNA in *Saccharomyces cerevisiae*. Nucleic Acids Res. Mar. 2014;42(5):3246-60. doi: 10.1093/nar/gkt1281. Epub Dec. 11, 2013.
Sharon et al., Functional Genetic Variants Revealed by Massively Parallel Precise Genome Editing. Cell. Oct. 4, 2018;175(2):544-557.e16. doi: 10.1016/j.cell.2018.08.057. Epub Sep. 20, 2018.
Shaw et al., Implications of human genome architecture for rearrangement-based disorders: the genomic basis of disease. Hum Mol Genet. Apr. 1, 2004;13 Spec No. 1:R57-64. doi: 10.1093/hmg/ddh073. Epub Feb. 5, 2004.
Shechner et al., Multiplexable, locus-specific targeting of long RNAs with CRISPR-Display. Nat Methods. Jul. 2015;12(7):664-70. doi: 10.1038/nmeth.3433. Epub Jun. 1, 2015.
Shen et al., Herpes simplex virus 1 (HSV-1) for cancer treatment. Cancer Gene Ther. Nov. 2006;13(11):975-92. doi: 10.1038/sj.cgt.7700946. Epub Apr. 7, 2006.
Shen et al., Predictable and precise template-free CRISPR editing of pathogenic variants. Nature. Nov. 2018;563(7733):646-651. doi: 10.1038/s41586-018-0686-x. Epub Nov. 7, 2018. Erratum in: Nature. Mar. 2019;567(7746):E1-E2.
Shen, Data processing, Modeling and Analysis scripts for CRISPR-inDelphi. GitHub—maxwshen/indelphi-dataprocessinganalysis at 6b68e3cec73c9358fef6e5f178a935f3c2a4118f. Apr. 10, 2018. Retrieved online via https://github.com/maxwshen/indelphi-sataprocessinganalysis/tree/6b68e3cec73c9358fef6e5f178a935f3c2a4118f Last retrieved on Jul. 26, 2021. 2 pages.
Sherwood et al., Discovery of directional and nondirectional pioneer transcription factors by modeling DNase profile magnitude and shape. Nat Biotechnol. Feb. 2014;32(2):171-178. doi: 10.1038/nbt.2798. Epub Jan. 19, 2014.
Shi et al., Structural basis for targeted DNA cytosine deamination and mutagenesis by APOBEC3A and APOBEC3B. Nat Struct Mol Biol. Feb. 2017;24(2):131-139. doi: 10.1038/nsmb.3344. Epub Dec. 19, 2016.
Shi et al., YTHDF3 facilitates translation and decay of N6-methyladenosine-modified RNA. Cell Res. Mar. 2017;27(3):315-328. doi: 10.1038/cr.2017.15. Epub Jan. 20, 2017.
Shin et al., CRISPR/Cas9 targeting events cause complex deletions and insertions at 17 sites in the mouse genome. Nat Commun. May 31, 2017;8:15464. doi: 10.1038/ncomms15464.
Shindo et al., A Comparison of Two Single-Stranded DNA Binding Models by Mutational Analysis of APOBEC3G. Biology (Basel). Aug. 2, 2012;1(2):260-76. doi: 10.3390/biology1020260.
Shingledecker et al., Molecular dissection of the *Mycobacterium tuberculosis* RecA intein: design of a minimal intein and of a trans-splicing system involving two intein fragments. Gene. Jan. 30, 1998;207(2):187-95. doi: 10.1016/s0378-1119(97)00624-0.
Shmakov et al., Diversity and evolution of class 2 CRISPR-Cas systems. Nat Rev Microbiol. Mar. 2017;15(3):169-182. doi: 10.1038/nrmicro.2016.184. Epub Jan. 23, 2017.
Shultz et al., A genome-wide analysis of FRT-like sequences in the human genome. PLoS One. Mar. 23, 2011;6(3):e18077. doi: 10.1371/journal.pone.0018077.
Silas et al., Direct CRISPR spacer acquisition from RNA by a natural reverse transcriptase-Cas1 fusion protein. Science. Feb. 26, 2016;351(6276):aad4234. doi: 10.1126/science.aad4234.
Silva et al., Selective disruption of the DNA polymerase III α-β complex by the umuD gene products. Nucleic Acids Res. Jul. 2012;40(12):5511-22. doi: 10.1093/nar/gks229. Epub Mar. 9, 2012.
Singh et al., Cross-talk between diverse serine integrases. J Mol Biol. Jan. 23, 2014;426(2):318-31. doi: 10.1016/j.jmb.2013.10.013. Epub Oct. 22, 2013.

(56) References Cited

OTHER PUBLICATIONS

Singh et al., Real-time observation of DNA recognition and rejection by the RNA-guided endonuclease Cas9. Nat Commun. Sep. 14, 2016;7:12778. doi: 10.1038/ncomms12778.
Singh et al., Real-time observation of DNA target interrogation and product release by the RNA-guided endonuclease CRISPR Cpf1 (Cas12a). Proc Natl Acad Sci U S A. May 22, 2018;115(21):5444-5449. doi: 10.1073/pnas.1718686115. Epub May 7, 2018.
Sivalingam et al., Biosafety assessment of site-directed transgene integration in human umbilical cord-lining cells. Mol Ther. Jul. 2010;18(7):1346-56. doi: 10.1038/mt.2010.61. Epub Apr. 27, 2010.
Sledz et al., Structural insights into the molecular mechanism of the m(6)A writer complex. Elife. Sep. 14, 2016;5:e18434. doi: 10.7554/eLife.18434.
Slupphaug et al., A nucleotide-flipping mechanism from the structure of human uracil-DNA glycosylase bound to DNA. Nature. Nov. 7, 1996;384(6604):87-92. doi: 10.1038/384087a0.
Smargon et al., Cas13b Is a Type VI-B CRISPR-Associated RNA-Guided RNase Differentially Regulated by Accessory Proteins Csx27 and Csx28. Mol Cell. Feb. 16, 2017;65(4):618-630.e7. doi: 10.1016/j.molcel.2016.12.023. Epub Jan. 5, 2017.
Smith et al., Herpesvirus transport to the nervous system and back again. Annu Rev Microbiol. 2012;66:153-76. doi: 10.1146/annurev-micro-092611-150051. Epub Jun. 15, 2012.
Smith et al., Production of human beta interferon in insect cells infected with a baculovirus expression vector. Mol Cell Biol. Dec. 1983;3(12):2156-65. doi: 10.1128/mcb.3.12.2156.
Smith et al., Single-step purification of polypeptides expressed in *Escherichia coli* as fusions with glutathione S-transferase. Gene. Jul. 15, 1988;67(1):31-40. doi: 10.1016/0378-1119(88)90005-4.
Smith, Phage-encoded Serine Integrases and Other Large Serine Recombinases. Microbiol Spectr. Aug. 2015;3(4). doi: 10.1128/microbiolspec.MDNA3-0059-2014.
Somanathan et al., AAV vectors expressing LDLR gain-of-function variants demonstrate increased efficacy in mouse models of familial hypercholesterolemia. Circ Res. Aug. 29, 2014;115(6):591-9. doi: 10.1161/CIRCRESAHA.115.304008. Epub Jul. 14, 2014.
Sommerfelt et al., Receptor interference groups of 20 retroviruses plating on human cells. Virology. May 1990;176(1):58-69. doi: 10.1016/0042-6822(90)90230-o.
Southworth et al., Control of protein splicing by intein fragment reassembly. EMBO J. Feb. 16, 1998;17(4):918-26. doi: 10.1093/emboj/17.4.918.
Southworth et al., Purification of proteins fused to either the amino or carboxy terminus of the *Mycobacterium xenopi* gyrase A intein. Biotechniques. Jul. 1999;27(1):110-4, 116, 118-20. doi: 10.2144/99271st04.
Spencer et al., A general strategy for producing conditional alleles of Src-like tyrosine kinases. Proc Natl Acad Sci U S A. Oct. 10, 1995;92(21):9805-9. doi: 10.1073/pnas.92.21.9805.
Spencer et al., Controlling signal transduction with synthetic ligands. Science. Nov. 12, 1993;262(5136):1019-24. doi: 10.1126/science.7694365.
Spencer et al., Functional analysis of Fas signaling in vivo using synthetic inducers of dimerization. Curr Biol. Jul. 1, 1996;6(7):839-47. doi: 10.1016/s0960-9822(02)00607-3.
Srivastava et al., An inhibitor of nonhomologous end-joining abrogates double-strand break repair and impedes cancer progression. Cell. Dec. 21, 2012;151(7):1474-87. doi: 10.1016/j.cell.2012.11.054.
Stadtman, Selenocysteine. Annu Rev Biochem. 1996;65:83-100.
Stamos et al., Structure of a Thermostable Group II Intron Reverse Transcriptase with Template-Primer and Its Functional and Evolutionary Implications. Mol Cell. Dec. 7, 2017;68(5):926-939.e4. doi: 10.1016/j.molcel.2017.10.024. Epub Nov. 16, 2017.
Steele et al., The prion protein knockout mouse: a phenotype under challenge. Prion. Apr.-Jun. 2007;1(2):83-93. doi: 10.4161/pri.1.2.4346. Epub Apr. 25, 2007.

Steiner et al., The neurotropic herpes viruses: herpes simplex and varicella-zoster. Lancet Neurol. Nov. 2007;6(11):1015-28. doi: 10.1016/S1474-4422(07)70267-3.
Stella et al., Structure of the Cpf1 endonuclease R-loop complex after target DNA cleavage. Nature. Jun. 22, 2017;546(7659):559-563. doi: 10.1038/nature22398. Epub May 31, 2017.
Stenson et al., The Human Gene Mutation Database: towards a comprehensive repository of inherited mutation data for medical research, genetic diagnosis and next-generation sequencing studies. Hum Genet. Jun. 2017;136(6):665-677. doi: 10.1007/s00439-017-1779-6. Epub Mar. 27, 2017.
Sternberg et al., Conformational control of DNA target cleavage by CRISPR-Cas9. Nature. Nov. 5, 2015;527(7576):110-3. doi: 10.1038/nature15544. Epub Oct. 28, 2015.
Sterne-Weiler et al., Exon identity crisis: disease-causing mutations that disrupt the splicing code. Genome Biol. Jan. 23, 2014;15(1):201. doi: 10.1186/gb4150.
Stevens et al., A promiscuous split intein with expanded protein engineering applications. Proc Natl Acad Sci U S A. Aug. 8, 2017;114(32):8538-8543. doi: 10.1073/pnas.1701083114. Epub Jul. 24, 2017.
Stockwell et al., Probing the role of homomeric and heteromeric receptor interactions in TGF-beta signaling using small molecule dimerizers. Curr Biol. Jun. 18, 1998;8(13):761-70. doi: 10.1016/s0960-9822(98)70299-4.
Strecker et al., RNA-guided DNA insertion with CRISPR-associated transposases. Science. Jul. 5, 2019;365(6448):48-53. doi: 10.1126/science.aax9181. Epub Jun. 6, 2019.
Strutt et al., RNA-dependent RNA targeting by CRISPR-Cas9. Elife. Jan. 5, 2018;7:e32724. doi: 10.7554/eLife.32724.
Su et al., Human DNA polymerase η has reverse transcriptase activity in cellular environments. J Biol Chem. Apr. 12, 2019;294(15):6073-6081. doi: 10.1074/jbc.RA119.007925. Epub Mar. 6, 2019.
Sullenger et al., Ribozyme-mediated repair of defective mRNA by targeted, trans-splicing. Nature. Oct. 13, 1994;371(6498):619-22. doi: 10.1038/371619a0.
Sun et al., The CRISPR/Cas9 system for gene editing and its potential application in pain research. Transl Periop & Pain Med. Aug. 3, 2016;1(3):22-33.
Surun et al., High Efficiency Gene Correction in Hematopoietic Cells by Donor-Template-Free CRISPR/Cas9 Genome Editing. Mol Ther Nucleic Acids. Mar. 2, 2018;10:1-8. doi: 10.1016/j.omtn.2017.11.001. Epub Nov. 10, 2017.
Suzuki et al., Crystal structures reveal an elusive functional domain of pyrrolysyl-tRNA synthetase. Nat Chem Biol. Dec. 2017;13(12):1261-1266. doi: 10.1038/nchembio.2497. Epub Oct. 16, 2017.
Suzuki et al., In vivo genome editing via CRISPR/Cas9 mediated homology-independent targeted integration. Nature. Dec. 1, 2016;540(7631):144-149. doi: 10.1038/nature20565. Epub Nov. 16, 2016.
Suzuki et al., VCre/VloxP and SCre/SloxP: new site-specific recombination systems for genome engineering. Nucleic Acids Res. Apr. 2011;39(8):e49. doi: 10.1093/nar/gkq1280. Epub Feb. 1, 2011.
Tabebordbar et al., In vivo gene editing in dystrophic mouse muscle and muscle stem cells. Science. Jan. 22, 2016;351(6271):407-411. doi: 10.1126/science.aad5177. Epub Dec. 31, 2015.
Tahara et al., Potent and Selective Inhibitors of 8-Oxoguanine DNA Glycosylase. J Am Chem Soc. Feb. 14, 2018;140(6):2105-2114. doi: 10.1021/jacs.7b09316. Epub Feb. 5, 2018.
Tajiri et al., Functional cooperation of MutT, MutM and MutY proteins in preventing mutations caused by spontaneous oxidation of guanine nucleotide in *Escherichia coli*. Mutat Res. May 1995;336(3):257-67. doi: 10.1016/0921-8777(94)00062-b.
Takimoto et al., Stereochemical basis for engineered pyrrolysyl-tRNA synthetase and the efficient in vivo incorporation of structurally divergent non-native amino acids. ACS Chem Biol. Jul. 15, 2011;6(7):733-43. doi: 10.1021/cb200057a. Epub May 5, 2011.
Tambunan et al., Vaccine Design for H5N1 Based on B- and T-cell Epitope Predictions. Bioinform Biol Insights. Apr. 28, 2016;10:27-35. doi: 10.4137/BBI.S38378.

(56) References Cited

OTHER PUBLICATIONS

Tanenbaum et al., A protein-tagging system for signal amplification in gene expression and fluorescence imaging. Cell. Oct. 23, 2014;159(3):635-46. doi: 10.1016/j.cell.2014.09.039. Epub Oct. 9, 2014.

Tanese et al., Expression of enzymatically active reverse transcriptase in *Escherichia coli*. Proc Natl Acad Sci U S A. Aug. 1985;82(15):4944-8. doi: 10.1073/pnas.82.15.4944.

Tang et al., Evaluation of Bioinformatic Programmes for the Analysis of Variants within Splice Site Consensus Regions. Adv Bioinformatics. 2016;2016:5614058. doi: 10.1155/2016/5614058. Epub May 24, 2016.

Tang et al., Rewritable multi-event analog recording in bacterial and mammalian cells. Science. Apr. 13, 2018;360(6385):eaap8992. doi: 10.1126/science.aap8992. Epub Feb. 15, 2018.

Tassabehji, Williams-Beuren syndrome: a challenge for genotype-phenotype correlations. Hum Mol Genet. Oct. 15, 2003;12 Spec No. 2:R229-37. doi: 10.1093/hmg/ddg299. Epub Sep. 2, 2003.

Taube et al., Reverse transcriptase of mouse mammary tumour virus: expression in bacteria, purification and biochemical characterization. Biochem J. Feb. 1, 1998;329 ( Pt 3)(Pt 3):579-87. doi: 10.1042/bj3290579. Erratum in: Biochem J Jun. 15, 1998;332(Pt 3):808.

Tee et al., Polishing the craft of genetic diversity creation in directed evolution. Biotechnol Adv. Dec. 2013;31(8):1707-21. doi: 10.1016/j.biotechadv.2013.08.021. Epub Sep. 6, 2013.

Telenti et al., The *Mycobacterium xenopi* GyrA protein splicing element: characterization of a minimal intein. J Bacteriol. Oct. 1997;179(20):6378-82. doi: 10.1128/jb.179.20.6378-6382.1997.

Telesnitsky et al., RNase H domain mutations affect the interaction between Moloney murine leukemia virus reverse transcriptase and its primer-template. Proc Natl Acad Sci U S A. Feb. 15, 1993;90(4):1276-80. doi: 10.1073/pnas.90.4.1276.

Teng et al., Mutational analysis of apolipoprotein B mRNA editing enzyme (APOBEC1). structure-function relationships of RNA editing and dimerization. J Lipid Res. Apr. 1999;40(4):623-35.

Thompson et al., The Future of Multiplexed Eukaryotic Genome Engineering. ACS Chem Biol. Feb. 16, 2018;13(2):313-325. doi: 10.1021/acschembio.7b00842. Epub Dec. 28, 2017.

Thomson et al., Mutational analysis of loxP sites for efficient Cre-mediated insertion into genomic DNA. Genesis. Jul. 2003;36(3):162-7. doi: 10.1002/gene.10211.

Thuronyi et al., Continuous evolution of base editors with expanded target compatibility and improved activity. Nat Biotechnol. Sep. 2019;37(9):1070-1079. doi: 10.1038/s41587-019-0193-0. Epub Jul. 22, 2019.

Thyagarajan et al., Creation of engineered human embryonic stem cell lines using phiC31 integrase. Stem Cells. Jan. 2008;26(1):119-26. doi: 10.1634/stemcells.2007-0283. Epub Oct. 25, 2007.

Tinland et al., The T-DNA-linked VirD2 protein contains two distinct functional nuclear localization signals. Proc Natl Acad Sci U S A. Aug. 15, 1992;89(16):7442-6. doi: 10.1073/pnas.89.16.7442.

Tom et al., Mechanism whereby proliferating cell nuclear antigen stimulates flap endonuclease 1. J Biol Chem. Apr. 7, 2000;275(14):10498-505. doi: 10.1074/jbc.275.14.10498.

Tone et al., Single-stranded DNA binding protein Gp5 of Bacillus subtilis phage ?29 is required for viral DNA replication in growth-temperature dependent fashion. Biosci Biotechnol Biochem. 2012;76(12):2351-3. doi: 10.1271/bbb.120587. Epub Dec. 7, 2012.

Toor et al., Crystal structure of a self-spliced group II intron. Science. Apr. 4, 2008;320(5872):77-82. doi: 10.1126/science. 1153803.

Toro et al., On the Origin and Evolutionary Relationships of the Reverse Transcriptases Associated With Type III CRISPR-Cas Systems. Front Microbiol. Jun. 15, 2018;9:1317. doi: 10.3389/fmicb. 2018.01317.

Toro et al., The Reverse Transcriptases Associated with CRISPR-Cas Systems. Sci Rep. Aug. 2, 2017;7(1):7089. doi: 10.1038/s41598-017-07828-y.

Torres et al., Non-integrative lentivirus drives high-frequency cre-mediated cassette exchange in human cells. PLoS One. 2011;6(5):e19794. doi: 10.1371/journal.pone.0019794. Epub May 23, 2011.

Townsend et al., Role of HFE in iron metabolism, hereditary haemochromatosis, anaemia of chronic disease, and secondary iron overload. Lancet. Mar. 2, 2002;359(9308):786-90. doi: 10.1016/S0140-6736(02)07885-6.

Townsend et al., Role of HFE in iron metabolism, hereditary haemochromatosis, anaemia of chronic disease, and secondary iron overload. Lancet. Mar. 2, 2002;359(9308):786-90. doi: 10.1016/S0140-6736(02)07885-6. Erratum in: Lancet Jul. 13, 2002;360(9327):176.

Tracewell et al., Directed enzyme evolution: climbing fitness peaks one amino acid at a time. Curr Opin Chem Biol. Feb. 2009;13(1):3-9. doi: 10.1016/j.cbpa.2009.01.017. Epub Feb. 25, 2009.

Tratschin et al., A human parvovirus, adeno-associated virus, as a eucaryotic vector: transient expression and encapsidation of the procaryotic gene for chloramphenicol acetyltransferase. Mol Cell Biol. Oct. 1984;4(10):2072-81. doi: 10.1128/mcb.4.10.2072.

Tratschin et al., Adeno-associated virus vector for high-frequency integration, expression, and rescue of genes in mammalian cells. Mol Cell Biol. Nov. 1985;5(11):3251-60. doi: 10.1128/mcb.5.11. 3251.

Traxler et al., A genome-editing strategy to treat ?-hemoglobinopathies that recapitulates a mutation associated with a benign genetic condition. Nat Med. Sep. 2016;22(9):987-90. doi: 10.1038/nm. 4170. Epub Aug. 15, 2016.

Trojan et al., Functional analysis of hMLH1 variants and HNPCC-related mutations using a human expression system. Gastroenterology. Jan. 2002;122(1):211-9. doi: 10.1053/gast.2002.30296.

Trudeau et al., On the Potential Origins of the High Stability of Reconstructed Ancestral Proteins. Mol Biol Evol. Oct. 2016;33(10):2633-41. doi: 10.1093/molbev/msw138. Epub Jul. 12, 2016.

Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 2015.

Tsai et al., CIRCLE-seq: a highly sensitive in vitro screen for genome-wide CRISPR-Cas9 nuclease off-targets. Nat Methods. Jun. 2017;14(6):607-614. doi: 10.1038/nmeth.4278. Epub May 1, 2017.

Tsang et al., Specialization of the DNA-cleaving activity of a group I ribozyme through in vitro evolution. J Mol Biol. Sep. 13, 1996;262(1):31-42. doi: 10.1006/jmbi.1996.0496.

Tsutakawa et al., Human flap endonuclease structures, DNA double-base flipping, and a unified understanding of the FEN1 superfamily. Cell. Apr. 15, 2011;145(2):198-211. doi: 10.1016/j.cell.2011.03. 004.

Tycko et al., Pairwise library screen systematically interrogates *Staphylococcus aureus* Cas9 specificity in human cells. bioRxiv. doi: https://doi.org/10.1101/269399 Posted Feb. 22, 2018.

UniProt Consortium, UniProt: the universal protein knowledgebase. Nucleic Acids Res. Mar. 16, 2018;46(5):2699. doi: 10.1093/nar/gky092.

UniProtKB Submission; Accession No. F0NH53. May 3, 2011. 4 pages.

UniProtKB Submission; Accession No. F0NN87. May 3, 2011. 4 pages.

UniProtKB Submission; Accession No. G3ECR1.2. No Author Listed., Aug. 12, 2020, 8 pages.

UniProtKB Submission; Accession No. P04264. No Author Listed., Apr. 7, 2021. 12 pages.

UniProtKB Submission; Accession No. P0DOC6. No Author Listed., Oct. 5, 2016. 5 pages.

UniProtKB Submission; Accession No. T0D7A2. Oct. 16, 2013. 10 pages.

UniProtKB Submission; Accession No. U2UMQ6. No Author Listed., Apr. 7, 2021, 11 pages.

Urasaki et al., Functional dissection of the Tol2 transposable element identified the minimal cis-sequence and a highly repetitive

(56) References Cited

OTHER PUBLICATIONS sequence in the subterminal region essential for transposition. Genetics. Oct. 2006;174(2):639-49. doi: 10.1534/genetics.106.060244. Epub Sep. 7, 2006.

Usman et al., Exploiting the chemical synthesis of RNA. Trends Biochem Sci. Sep. 1992;17(9):334-9. doi: 10.1016/0968-0004(92)90306-t.

Van Brunt et al., Genetically Encoded Azide Containing Amino Acid in Mammalian Cells Enables Site-Specific Antibody-Drug Conjugates Using Click Cycloaddition Chemistry. Bioconjug Chem. Nov. 18, 2015;26(11):2249-60. doi: 10.1021/acs.bioconjchem.5b00359. Epub Sep. 11, 2015.

Van Brunt et al., Molecular Farming: Transgenic Animals as Bioreactors. Biotechnology (Y). 1988;6(10):1149-1154. doi: 10.1038/nbt1088-1149.

Van Overbeek et al., DNA Repair Profiling Reveals Nonrandom Outcomes at Cas9-Mediated Breaks. Mol Cell. Aug. 18, 2016;63(4):633-646. doi: 10.1016/j.molcel.2016.06.037. Epub Aug. 4, 2016.

Van Wijk et al., Identification of 51 novel exons of the Usher syndrome type 2A (USH2A) gene that encode multiple conserved functional domains and that are mutated in patients with Usher syndrome type II. Am J Hum Genet. Apr. 2004;74(4):738-44. doi: 10.1086/383096. Epub Mar. 10, 2004.

Varga et al., Progressive vascular smooth muscle cell defects in a mouse model of Hutchinson-Gilford progeria syndrome. Proc Natl Acad Sci U S A. Feb. 28, 2006;103(9):3250-5. doi: 10.1073/pnas.0600012103. Epub Feb. 21, 2006.

Vellore et al., A group II intron-type open reading frame from the thermophile Bacillus (Geobacillus) stearothermophilus encodes a heat-stable reverse transcriptase. Appl Environ Microbiol. Dec. 2004;70(12):7140-7. doi: 10.1128/AEM.70.12.7140-7147.2004.

Venken et al., Genome-wide manipulations of *Drosophila melanogaster* with transposons, Flp recombinase, and FC31 integrase. Methods Mol Biol. 2012;859:203-28. doi: 10.1007/978-1-61779-603-6_12.

Verma, The reverse transcriptase. Biochim Biophys Acta. Mar. 21, 1977;473(1):1-38. doi: 10.1016/0304-419x(77)90005-1.

Vigne et al., Third-generation adenovectors for gene therapy. Restor Neurol Neurosci. Jan. 1, 1995;8(1):35-6. doi: 10.3233/RNN-1995-81208.

Vik et al., Endonuclease V cleaves at inosines in RNA. Nat Commun. 2013;4:2271. doi: 10.1038/ncomms3271.

Vilenchik et al., Endogenous DNA double-strand breaks: production, fidelity of repair, and induction of cancer. Proc Natl Acad Sci U S A. Oct. 28, 2003;100(22):12871-6. doi: 10.1073/pnas.2135498100. Epub Oct. 17, 2003.

Villiger et al., Treatment of a metabolic liver disease by in vivo genome base editing in adult mice. Nat Med. Oct. 2018;24(10):1519-1525. doi: 10.1038/s41591-018-0209-1. Epub Oct. 8, 2018.

Voigt et al., Rational evolutionary design: the theory of in vitro protein evolution. Adv Protein Chem. 2000;55:79-160.

Vriend et al., Nick-initiated homologous recombination: Protecting the genome, one strand at a time. DNA Repair (Amst). Feb. 2017;50:1-13. doi: 10.1016/j.dnarep.2016.12.005. Epub Dec. 29, 2016.

Wang et al. CRISPR-Cas9 and CRISPR-Assisted Cytidine Deaminase Enable Precise and Efficient Genome Editing in Klebsiella pneumoniae. Appl Environ Microbiol. 2018;84(23):e01834-18. Published Nov. 15, 2018. doi:10.1128/AEM.01834-18.

Wang et al., AID upmutants isolated using a high-throughput screen highlight the immunity/cancer balance limiting DNA deaminase activity. Nat Struct Mol Biol. Jul. 2009;16(7):769-76. doi: 10.1038/nsmb.1623. Epub Jun. 21, 2009.

Wang et al., Continuous directed evolutions of proteins with improved soluble expression. Nature Chemical Biology. Nat Publishing Group. Aug. 20, 2018; 14(10):972-980.

Wang et al., Enhanced base editing by co-expression of free uracil DNA glycosylase inhibitor. Cell Res. Oct. 2017;27(1):1289-92. doi: 10.1038/cr.2017.111. Epub Aug. 29, 2017.

Wang et al., Evolution of new nonantibody proteins via iterative somatic hypermutation. Proc Natl Acad Sci U S A. Nov. 30, 2004;101(48):16745-9. Epub Nov. 19, 2004.

Wang et al., Expanding the genetic code. Annu Rev Biophys Biomol Struct. 2006;35:225-49. Review.

Wang et al., Highly efficient CRISPR/HDR-mediated knock-in for mouse embryonic stem cells and zygotes. Biotechniques. 2015:59,201-2;204;206-8.

Wang et al., (6)-methyladenosine Modulates Messenger RNA Translation Efficiency. Cell. Jun. 4, 2015;161(6):1388-99. doi: 10.1016/j.cell.2015.05.014.

Wang et al., N6-methyladenosine-dependent regulation of messenger RNA stability. Nature. Jan. 2, 2014;505(7481):117-20. doi: 10.1038/nature12730. Epub Nov. 27, 2013.

Wang et al., Optimized paired-sgRNA/Cas9 cloning and expression cassette triggers high-efficiency multiplex genome editing in kiwifruit. Plant Biotechnol J. Aug. 2018;16(8):1424-1433. doi: 10.1111/pbi.12884. Epub Feb. 6, 2018.

Wang et al., Programming cells by multiplex genome engineering and accelerated evolution. Nature. Aug. 13, 2009;460(7257):894-8. Epub Jul. 26, 2009.

Wang et al., Reading RNA methylation codes through methyl-specific binding proteins. RNA Biol. 2014;11(6):669-72. doi: 10.4161/rna.28829. Epub Apr. 24, 2014.

Wang et al., *Staphylococcus aureus* protein SAUGI acts as a uracil-DNA glycosylase inhibitor. Nucleic Acids Res. Jan. 2014;42(2):1354-64. doi: 10.1093/nar/gkt964. Epub Oct. 22, 2013.

Wang et al., Structural basis of (6)-adenosine methylation by the METTL3-METTL14 complex. Nature. Jun. 23, 2016;534(7608):575-8. doi: 10.1038/nature18298. Epub May 25, 2016.

Watowich, The erythropoietin receptor: molecular structure and hematopoietic signaling pathways. J Investig Med. Oct. 2011;59(7):1067-72. doi: 10.2310/JIM.0b013e31820fb28c.

Waxman et al., Regulating excitability of peripheral afferents: emerging ion channel targets. Nat Neurosci. Feb. 2014;17(2):153-63. doi: 10.1038/nn.3602. Epub Jan. 28, 2014.

Weill et al., DNA polymerases in adaptive immunity. Nat Rev Immunol. Apr. 2008;8(4):302-12. doi: 10.1038/nri2281. Epub Mar. 14, 2008.

Weinberg et al., New Classes of Self-Cleaving Ribozymes Revealed by Comparative Genomics Analysis. Nat Chem Biol. Aug. 2015;11(8):606-10. doi: 10.1038/nchembio.1846. Epub Jul. 13, 2015.

Weiss et al., Loss-of-function mutations in sodium channel Nav1.7 cause anosmia. Nature. Apr. 14, 2011;472(7342):186-90. doi: 10.1038/nature09975. Epub Mar. 23, 2011.

Wen et al., Inclusion of a universal tetanus toxoid CD4(+) T cell epitope P2 significantly enhanced the immunogenicity of recombinant rotavirus ?VP8 subunit parenteral vaccines. Vaccine. Jul. 31, 2014;32(35):4420-4427. doi: 10.1016/j.vaccine.2014.06.060. Epub Jun. 21, 2014.

West et al., Gene expression in adeno-associated virus vectors: the effects of chimeric mRNA structure, helper virus, and adenovirus VA1 RNA. Virology. Sep. 1987;160(1):38-47. doi: 10.1016/0042-6822(87)90041-9.

Wharton et al., A new-specificity mutant of 434 repressor that defines an amino acid-base pair contact. Nature. Apr. 30-May 6, 1987;326(6116):888-91.

Wharton et al., Changing the binding specificity of a repressor by redesigning an alpha-helix. Nature. Aug. 15-21, 1985;316(6029):601-5.

Wheeler et al., The thermostability and specificity of ancient proteins. Curr Opin Struct Biol. Jun. 2016;38:37-43. doi: 10.1016/j.sbi.2016.05.015. Epub Jun. 9, 2016.

Wienert et al., KLF1 drives the expression of fetal hemoglobin in British HPFH. Blood. Aug. 10, 2017;130(6):803-807. doi: 10.1182/blood-2017-02-767400. Epub Jun. 28, 2017.

Wijesinghe et al., Efficient deamination of 5-methylcytosines in DNA by human APOBEC3A, but not by AID or APOBEC3G. Nucleic Acids Res. Oct. 2012;40(18):9206-17. doi: 10.1093/nar/gks685. Epub Jul. 13, 2012.

(56) References Cited

OTHER PUBLICATIONS

Williams et al., Assessing the accuracy of ancestral protein reconstruction methods. PLoS Comput Biol. Jun. 23, 2006;2(6):e69. doi: 10.1371/journal.pcbi.0020069. Epub Jun. 23, 2006.
Wills et al., Pseudoknot-dependent read-through of retroviral gag termination codons: importance of sequences in the spacer and loop 2. EMBO J. Sep. 1, 1994;13(17):4137-44. doi: 10.1002/j.1460-2075. 1994.tb06731.x.
Wilson et al., Assessing annotation transfer for genomics: quantifying the relations between protein sequence, structure and function through traditional and probabilistic scores. J Mol Biol 2000;297:233-49.
Wilson et al., Formation of infectious hybrid virions with gibbon ape leukemia virus and human T-cell leukemia virus retroviral envelope glycoproteins and the gag and pol proteins of Moloney murine leukemia virus. J Virol. May 1989;63(5):2374-8. doi: 10.1128/JVI.63.5.2374-2378.1989.
Wilson et al., In Vitro Selection of Functional Nucleic Acids. Annu Rev Biochem. 1999;68:611-47. doi: 10.1146/annurev.biochem.68. 1.611.
Wilson et al., Kinase dynamics. Using ancient protein kinases to unravel a modern cancer drug's mechanism. Science. Feb. 20, 2015;347(6224):882-6. doi: 10.1126/science.aaa1823.
Winoto et al., A novel, inducible and T cell-specific enhancer located at the 3' end of the T cell receptor alpha locus. EMBO J. Mar. 1989;8(3):729-33.
Winter et al., Drug Development. Phthalimide conjugation as a strategy for in vivo target protein degradation. Science. Jun. 19, 2015;348(6241):1376-81. doi:; 10.1126/science.aab1433. Epub May 21, 2015.
Wold, Replication protein A: a heterotrimeric, single-stranded DNA-binding protein required for eukaryotic DNA metabolism. Annu Rev Biochem. 1997;66:61-92. doi: 10.1146/annurev.biochem.66.1. 61.
Wong et al., A statistical analysis of random mutagenesis methods used for directed protein evolution. J Mol Biol. Jan. 27, 2006;355(4):858-71. Epub Nov. 17, 2005.
Wong et al., The Diversity Challenge in Directed Protein Evolution. Comb Chem High Throughput Screen. May 2006;9(4):271-88.
Wood et al., A genetic system yields self-cleaving inteins for bioseparations. Nat Biotechnol. Sep. 1999;17(9):889-92. doi: 10.1038/12879.
Woods et al., The phenotype of congenital insensitivity to pain due to the NaV1.9 variant p.L811P. Eur J Hum Genet. May 2015;23(5):561-3. doi: 10.1038/ejhg.2014.166. Epub Aug. 13, 2014.
Wright et al., Continuous in vitro evolution of catalytic function. Science. Apr. 25, 1997;276(5312):614-7.
Wright et al., Rational design of a split-Cas9 enzyme complex. Proc Natl Acad Sci U S A. Mar. 10, 2015;112(10):2984-9. doi: 10.1073/pnas.1501698112. Epub Feb. 23, 2015.
Wu et al., Human single-stranded DNA binding proteins: guardians of genome stability. Acta Biochim Biophys Sin (Shanghai). Jul. 2016;48(7):671-7. doi: 10.1093/abbs/gmw044. Epub May 23, 2016.
Wu et al., Protein trans-splicing and functional mini-inteins of a cyanobacterial dnaB intein. Biochim Biophys Acta. Sep. 8, 1998;1387(1-2):422-32. doi: 10.1016/s0167-4838(98)00157-5.
Wu et al., Protein trans-splicing by a split intein encoded in a split DnaE gene of *Synechocystis* sp. PCC6803. Proc Natl Acad Sci U S A. Aug. 4, 1998;95(16):9226-31. doi: 10.1073/pnas.95.16.9226.
Wu et al., Readers, writers and erasers of N6-methylated adenosine modification. Curr Opin Struct Biol. Dec. 2017;47:67-76. doi: 10.1016/j.sbi.2017.05.011. Epub Jun. 16, 2017.
Xiang et al., RNA m6A methylation regulates the ultraviolet-induced DNA damage response. Nature. Mar. 23, 2017;543(7646):573-576. doi: 10.1038/nature21671. Epub Mar. 15, 2017.
Xiao et al., Genetic incorporation of multiple unnatural amino acids into proteins in mammalian cells. Angew Chem Int Ed Engl. Dec. 23, 2013;52(52):14080-3. doi: 10.1002/anie.201308137. Epub Nov. 8, 2013.
Xiao et al., Nuclear m(6)A Reader YTHDC1 Regulates mRNA Splicing. Mol Cell. Feb. 18, 2016;61(4):507-519. doi: 10.1016/j.molcel.2016.01.012. Epub Feb. 11, 2016.
Xie et al., Adjusting the attB site in donor plasmid improves the efficiency of ?C31 integrase system. DNA Cell Biol. Jul. 2012;31(7):1335-40. doi: 10.1089/dna.2011.1590. Epub Apr. 10, 2012.
Xiong et al., Origin and evolution of retroelements based upon their reverse transcriptase sequences. EMBO J. Oct. 1990;9(10):3353-62.
Xu et al., Accuracy and efficiency define Bxb1 integrase as the best of fifteen candidate serine recombinases for the integration of DNA into the human genome. BMC Biotechnol. Oct. 20, 2013;13:87. doi: 10.1186/1472-6750-13-87.
Xu et al., Chemical ligation of folded recombinant proteins: segmental isotopic labeling of domains for NMR studies. Proc Natl Acad Sci U S A. Jan. 19, 1999;96(2):388-93. doi: 10.1073/pnas. 96.2.388.
Xu et al., Protein splicing: an analysis of the branched intermediate and its resolution by succinimide formation. EMBO J. Dec. 1, 1994;13(23):5517-22.
Xu et al., PTMD: A Database of Human Disease-associated Post-translational Modifications. Genomics Proteomics Bioinformatics. Aug. 2018;16(4):244-251. doi: 10.1016/j.gpb.2018.06.004. Epub Sep. 21, 2018.
Xu et al., Structures of human ALKBH5 demethylase reveal a unique binding mode for specific single-stranded N6-methyladenosine RNA demethylation. J Biol Chem. Jun. 20, 2014;289(25):17299-311. doi: 10.1074/jbc.M114.550350. Epub Apr. 28, 2014.
Xu et al., The mechanism of protein splicing and its modulation by mutation. EMBO J. Oct. 1, 1996;15(19):5146-53.
Yamada et al., Crystal Structure of the Minimal Cas9 from Campylobacter jejuni Reveals the Molecular Diversity in the CRISPR-Cas9 Systems. Mol Cell. Mar. 16, 2017;65(6):P1109-1121./doi.org/10.1016/j.molcel.2017.02.007.
Yamamoto et al., The ons and offs of inducible transgenic technology: a review. Neurobiol Dis. Dec. 2001;8(6):923-32.
Yamano et al., Crystal Structure of Cpf1 in Complex with Guide RNA and Target DNA. Cell. May 5, 2016;165(4):949-62 and Supplemental Info. doi: 10.1016/j.cell.2016.04.003. Epub Apr. 21, 2016.
Yamazaki et al., Segmental Isotope Labeling for Protein NMR Using Peptide Splicing. J. Am. Chem. Soc. May 22, 1998; 120(22):5591-2. https://doi.org/10.1021/ja9807760.
Yan et al., Cas13d Is a Compact RNA-Targeting Type VI CRISPR Effector Positively Modulated by a WYL-Domain-Containing Accessory Protein. Mol Cell. Apr. 19, 2018;70(2):327-339.e5. doi: 10.1016/j.molcel.2018.02.028. Epub Mar. 15, 2018.
Yan et al., Highly Efficient A•T to G•C Base Editing by Cas9n-Guided tRNA Adenosine Deaminase in Rice. Mol Plant. Apr. 2, 2018;11(4):631-634. doi: 10.1016/j.molp.2018.02.008. Epub Feb. 22, 2018.
Yang et al., Construction of an integration-proficient vector based on the site-specific recombination mechanism of enterococcal temperate phage phiFC1. J Bacteriol. Apr. 2002;184(7):1859-64. doi: 10.1128/jb.184.7.1859-1864.2002.
Yang et al., Genome-wide inactivation of porcine endogenous retroviruses (PERVs). Science. Nov. 27, 2015;350(6264):1101-4. doi: 10.1126/science.aad1191. Epub Oct. 11, 2015.
Yang et al., Increasing targeting scope of adenosine base editors in mouse and rat embryos through fusion of TadA deaminase with Cas9 variants. Protein Cell. Sep. 2018;9(9):814-819. doi: 10.1007/s13238-018-0568-x.
Yang et al., Mutations in SCN9A, encoding a sodium channel alpha subunit, in patients with primary erythermalgia. J Med Genet. Mar. 2004;41(3):171-4. doi: 10.1136/jmg.2003.012153.
Yang et al., One-step generation of mice carrying reporter and conditional alleles by CRISPR/Cas-mediated genome engineering. Cell. Sep. 12, 2013;154(6):1370-9. doi: 10.1016/j.cell.2013.08.022. Epub Aug. 29, 2013.
Yang et al., Permanent genetic memory with >1-byte capacity. Nat Methods. Dec. 2014;11(12):1261-6. doi: 10.1038/nmeth.3147. Epub Oct. 26, 2014.

(56) References Cited

OTHER PUBLICATIONS

Yang et al., Preparation of RNA-directed DNA polymerase from spleens of Balb-c mice infected with Rauscher leukemia virus. Biochem Biophys Res Commun. Apr. 28, 1972;47(2):505-11. doi: 10.1016/0006-291x(72)90743-7.

Yang et al., Small-molecule control of insulin and PDGF receptor signaling and the role of membrane attachment. Curr Biol. Jan. 1, 1998;8(1):11-8. doi: 10.1016/s0960-9822(98)70015-6.

Yang, Development of Human Genome Editing Tools for the Study of Genetic Variations and Gene Therapies. Doctoral Dissertation. Harvard University. 2013. Accessible via nrs.harvard.edu/urn-3:HUL. InstRepos: 11181072. 277 pages.

Yang, Nucleases: diversity of structure, function and mechanism. Q Rev Biophys. Feb. 2011;44(1):1-93. doi: 10.1017/S0033583510000181. Epub Sep. 21, 2010.

Yang, PAML 4: phylogenetic analysis by maximum likelihood. Mol Biol Evol. Aug. 2007;24(8): 1586-91. doi: 10.1093/molbev/msm088. Epub May 4, 2007.

Yang, Phylogenetic Analysis by Maximum Likelihood (PAML). //abacus.gene.ucl.ac.uk/software/paml.html Last accessed Apr. 28, 2021.

Yasui et al., Miscoding Properties of 2'-Deoxyinosine, a Nitric Oxide-Derived DNA Adduct, during Translesion Synthesis Catalyzed by Human DNA Polymerases. J Molec Biol. Apr. 4, 2008;377(4):1015-23.

Yasui, Alternative excision repair pathways. Cold Spring Harb Perspect Biol. Jun. 1, 2013;5(6):a012617. doi: 10.1101/cshperspect. a012617.

Yasukawa et al., Characterization of Moloney murine leukaemia virus/avian myeloblastosis virus chimeric reverse transcriptases. J Biochem. Mar. 2009;145(3):315-24. doi: 10.1093/jb/mvn166. Epub Dec. 6, 2008.

Yeh et al., In vivo base editing of post-mitotic sensory cells. Nat Commun. Jun. 5, 2018;9(1):2184. doi: 10.1038/s41467-018-04580-3.

Yokoe et al., Spatial dynamics of GFP-tagged proteins investigated by local fluorescence enhancement. Nat Biotechnol. Oct. 1996;14(10):1252-6. doi: 10.1038/nbt1096-1252.

Yu et al., Circular permutation: a different way to engineer enzyme structure and function. Trends Biotechnol. Jan. 2011;29(1):18-25. doi: 10.1016/j.tibtech.2010.10.004. Epub Nov. 17, 2010.

Yu et al., Liposome-mediated in vivo E1A gene transfer suppressed dissemination of ovarian cancer cells that overexpress HER-2/neu. Oncogene. Oct. 5, 1995;11(7):1383-8.

Yu et al., Progress towards gene therapy for HIV infection. Gene Ther. Jan. 1994;1(1):13-26.

Yu et al., Small molecules enhance CRISPR genome editing in pluripotent stem cells. Cell Stem Cell. Feb. 5, 2015;16(2):142-7. doi: 10.1016/j.stem.2015.01.003.

Yu et al., Synthesis-dependent microhomology-mediated end joining accounts for multiple types of repair junctions. Nucleic Acids Res. Sep. 2010;38(17):5706-17. doi: 10.1093/nar/gkq379. Epub May 11, 2010.

Zakas et al., Enhancing the pharmaceutical properties of protein drugs by ancestral sequence reconstruction. Nat Biotechnol. Jan. 2017;35(1):35-37. doi: 10.1038/nbt.3677. Epub Sep. 26, 2016.

Zalatan et al., Engineering complex synthetic transcriptional programs with CRISPR RNA scaffolds. Cell. Jan. 15, 2015;160(1-2):339-50. doi: 10.1016/j.cell.2014.11.052. Epub Dec. 18, 2014.

Zetsche et al., Cpf1 is a single RNA-guided endonuclease of a class 2 CRISPR-Cas system. Cell. Oct. 22, 2015;163(3):759-71 and Supplemental Info. doi: 10.1016/j.cell.2015.09.038. Epub Sep. 25, 2015.

Zettler et al., The naturally split Npu DnaE intein exhibits an extraordinarily high rate in the protein trans-splicing reaction. FEBS Lett. Mar. 4, 2009;583(5):909-14. doi: 10.1016/j.febslet.2009.02. 003. Epub Feb. 10, 2009.

Zhang et al., Π-Clamp-mediated cysteine conjugation. Nat Chem. Feb. 2016;8(2):120-8. doi: 10.1038/nchem.2413. Epub Dec. 21, 2015.

Zhang et al., A new strategy for the site-specific modification of proteins in vivo. Biochemistry. Jun. 10, 2003;42(22):6735-46.

Zhang et al., Circular intronic long noncoding RNAs. Mol Cell. Sep. 26, 2013;51(6):792-806. doi: 10.1016/j.molcel.2013.08.017. Epub Sep. 12, 2013

Zhang et al., Copy number variation in human health, disease, and evolution. Annu Rev Genomics Hum Genet. 2009;10:451-81. doi: 10.1146/annurev.genom.9.081307.164217.

Zhang et al., Global analysis of small RNA and mRNA targets of Hfq. Mol Microbiol. Nov. 2003;50(4):1111-24. doi: 10.1046/j.1365-2958.2003.03734.x.

Zhang et al., Myoediting: Toward Prevention of Muscular Dystrophy by Therapeutic Genome Editing. Physiol Rev. Jul. 1, 2018;98(3):1205-1240. doi: 10.1152/physrev.00046.2017.

Zhang et al., Reversible RNA Modification N1-methyladenosine (m1A) in mRNA and tRNA. Genomics Proteomics Bioinformatics. Jun. 2018;16(3):155-161. doi: 10.1016/j.gpb.2018.03.003. Epub Jun. 14, 2018.

Zhang et al., Ribozymes and Riboswitches: Modulation of RNA Function by Small Molecules. Biochemistry. Nov. 2, 2010;49(43):9123-31. doi: 10.1021/bi1012645.

Zhao et al., An ultraprocessive, accurate reverse transcriptase encoded by a metazoan group II intron. RNA. Feb. 2018;24(2):183-195. doi: 10.1261/rna.063479.117. Epub Nov. 6, 2017.

Zhao et al., Crystal structures of a group II intron maturase reveal a missing link in spliceosome evolution. Nat Struct Mol Biol. Jun. 2016;23(6):558-65. doi: 10.1038/nsmb.3224. Epub May 2, 2016.

Zhao et al., Post-transcriptional gene regulation by mRNA modifications. Nat Rev Mol Cell Biol. Jan. 2017;18(1):31-42. doi: 10.1038/nrm. 2016.132. Epub Nov. 3, 2016.

Zheng et al., ALKBH5 is a mammalian RNA demethylase that impacts RNA metabolism and mouse fertility. Mol Cell. Jan. 10, 2013;49(1):18-29. doi: 10.1016/j.molcel.2012.10.015. Epub Nov. 21, 2012.

Zheng et al., Highly efficient base editing in bacteria using a Cas9-cytidine deaminase fusion. Commun Biol. Apr. 19, 2018;1:32. doi: 10.1038/s42003-018-0035-5.

Zheng et al., Structural basis for the complete resistance of the human prion protein mutant G127V to prion disease. Sci Rep. Sep. 4, 2018;8(1):13211. doi: 10.1038/s41598-018-31394-6.

Zhong et al., Rational Design of Aptazyme Riboswitches for Efficient Control of Gene Expression in Mammalian Cells. Elife. Nov. 2, 2016;5:e18858. doi: 10.7554/eLife.18858.

Zhou et al., Dynamic m(6)A mRNA methylation directs translational control of heat shock response. Nature. Oct. 22, 2015;526(7574):591-4. doi: 10.1038/nature15377. Epub Oct. 12, 2015.

Zhou et al., GISSD: Group I Intron Sequence and Structure Database. Nucleic Acids Res. Jan. 2008;36(Database issue):D31-7. doi: 10.1093/nar/gkm766. Epub Oct. 16, 2007.

Zhou et al., Protective V127 prion variant prevents prion disease by interrupting the formation of dimer and fibril from molecular dynamics simulations. Sci Rep. Feb. 24, 2016;6:21804. doi: 10.1038/srep21804.

Zhou et al., Seamless Genetic Conversion of SMN2 to SMN1 via CRISPR/Cpf1 and Single-Stranded Oligodeoxynucleotides in Spinal Muscular Atrophy Patient-Specific Induced Pluripotent Stem Cells. Hum Gene Ther. Nov. 2018;29(11):1252-1263. doi: 10.1089/hum.2017.255. Epub May 9, 2018.

Zielenski, Genotype and phenotype in cystic fibrosis. Respiration. 2000;67(2):117-33. doi: 10.1159/000029497.

Zimmerly et al., An Unexplored Diversity of Reverse Transcriptases in Bacteria. Microbiol Spectr. Apr. 2015;3(2):MDNA3-0058-2014. doi: 10.1128/microbiolspec.MDNA3-0058-2014.

Zimmerly et al., Group II intron mobility occurs by target DNA-primed reverse transcription. Cell. Aug. 25, 1995;82(4):545-54. doi: 10.1016/0092-8674(95)90027-6.

Zolotukhin et al., Production and purification of serotype 1, 2, and 5 recombinant adeno-associated viral vectors. Methods. Oct. 2002;28(2):158-67. doi: 10.1016/s1046-2023(02)00220-7.

(56) References Cited

OTHER PUBLICATIONS

Zufferey et al., Woodchuck hepatitis virus posttranscriptional regulatory element enhances expression of transgenes delivered by retroviral vectors. J Virol. Apr. 1999;73(4):2886-92. doi: 10.1128/JVI.73.4.2886-2892.1999.

Zuker et al., Optimal computer folding of large RNA sequences using thermodynamics and auxiliary information. Nucleic Acids Res. Jan. 10, 1981;9(1):133-48. doi: 10.1093/nar/9.1.133.

Zuo et al., Cytosine base editor generates substantial off-target single-nucleotide variants in mouse embryos. Science. Apr. 19, 2019;364(6437):289-292. doi: 10.1126/science.aav9973. Epub Feb. 28, 2019.

Ai et al., C-terminal Loop Mutations Determine Folding and Secretion Properties of PCSK9. iMedPub J: Biochem Mol Biol J. Nov. 5, 2016;2(3):17. doi: 10.21767/2471-8084.100026. 12 pages.

Basila et al., Minimal 2'-O-methyl phosphorothioate linkage modification pattern of synthetic guide RNAs for increased stability and efficient CRISPR-Cas9 gene editing avoiding cellular toxicity. PLOS One. Nov. 27, 2017;12(11):e0188593. doi: 10.1371/journal.pone.0188593.

Bertsimas et al., Simulated annealing. Statistical Science. Feb. 1993;8(1):10-15. doi: 10.1214/ss/1177011077.

Bibikova et al., Targeted chromosomal cleavage and mutagenesis in Drosophila using zinc-finger nucleases. Genetics. Jul. 2002;161(3):1169-75. doi: 10.1093/genetics/161.3.1169.

Carlier et al., Genome Sequence of Burkholderia cenocepacia H111, a Cystic Fibrosis Airway Isolate. Genome Announc. Apr. 10, 2014;2(2):e00298-14. doi: 10.1128/genomeA.00298-14.

Chen et al., Dynamic imaging of genomic loci in living human cells by an optimized CRISPR/Cas system. Cell. Dec. 19, 2013;155(7):1479-91. doi: 10.1016/j.cell.2013.12.001. Erratum in: Cell. Jan. 16, 2014;156(1-2):373.

Cheng et al., [Cloning,expression and activity identification of human innate immune protein apolipoprotein B mRNA editing enzyme catalytic subunit 3A(APOBEC3A)]. Xi Bao Yu Fen Zi Mian Yi Xue Za Zhi. Chinese Journal of Cellular and Molecular Immunology, Feb. 2017;33(2):179-84. Chinese.

Dickinson et al., A system for the continuous directed evolution of proteases rapidly reveals drug-resistance mutations. Nat Commun. Oct. 30, 2014;5:5352. doi: 10.1038/ncomms6352.

Fang et al., The Menu of Features that Define Primary MicroRNAs and Enable De Novo Design of MicroRNA Genes. Mol Cell. Oct. 1, 2015;60(1):131-45. doi: 10.1016/j.molcel.2015.08.015. Epub Sep. 24, 2015.

Feng et al., Efficient genome editing in plants using a CRISPR/Cas system. Cell Res. Oct. 2013;23(10):1229-32. doi: 10.1038/cr.2013.114. Epub Aug. 20, 2013.

Fu et al., Targeted genome editing in human cells using CRISPR/Cas nucleases and truncated guide RNAs. Methods Enzymol. 2014;546:21-45. doi: 10.1016/B978-0-12-801185-0.00002-7.

Geisberg et al., Global analysis of mRNA isoform half-lives reveals stabilizing and destabilizing elements in yeast. Cell. Feb. 13, 2014;156(4):812-24. doi: 10.1016/j.cell.2013.12.026.

GenBank Submission; NIH/NCBI, Accession No. NC_000001.11. Gregory et al., Jun. 6, 2016. 3 pages.

GenBank Submission; NIH/NCBI, Accession No. NM_206933.2. Khalaileh et al., Sep. 16, 2018. 12 pages.

Grati et al., Localization of PDZD7 to the stereocilia ankle-link associates this scaffolding protein with the Usher syndrome protein network. J Neurosci. Oct. 10, 2012;32(41):14288-93. doi: 10.1523/JNEUROSCI.3071-12.2012.

Green et al., Characterization of the mechanical unfolding of RNA pseudoknots. J Mol Biol. Jan. 11, 2008;375(2):511-28. doi: 10.1016/j.jmb.2007.05.058. Epub May 26, 2007.

Hänsel-Hertsch et al., DNA G-quadruplexes in the human genome: detection, functions and therapeutic potential. Nat Rev Mol Cell Biol. May 2017;18(5):279-284. doi: 10.1038/nrm.2017.3. Epub Feb. 22, 2017.

Hawley-Nelson et al., Transfection of Cultured Eukaryotic Cells Using Cationic Lipid Reagents. Curr Prot Mol Biol. Jan. 2008;9.4.1-9.4.17. doi: 10.102/0471142727.mb0904s81. 17 pages.

Heyer et al., Regulation of homologous recombination in eukaryotes. Annu Rev Genet. 2010;44:113-39. doi: 10.1146/annurev-genet-051710-150955. Author Manuscript. 33 pages.

Houck-Loomis et al., An equilibrium-dependent retroviral mRNA switch regulates translational recoding. Nature. Nov. 27, 2011;480(7378):561-4. doi: 10.1038/nature10657.

Houseley et al., The many pathways of RNA degradation. Cell. Feb. 20, 2009;136(4):763-76. doi: 10.1016/j.cell.2009.01.019.

Ibrahim et al., RNA recognition by 3'-to-5' exonucleases: the substrate perspective. Biochim Biophys Acta. Apr. 2008;1779(4):256-65. doi: 10.1016/j.bbagrm.2007.11.004. Epub Dec. 3, 2007.

Jakimo et al., A Cas9 with Complete PAM Recognition for Adenine Dinucleotides. bioRxiv preprint. Sep. 27, 2018. doi.org/10.1101/429654. 29 pages.

Ku et al., Nucleic Acid Aptamers: An Emerging Tool for Biotechnology and Biomedical Sensing. Sensors (Basel). Jul. 6, 2015;15(7):16281-313. doi: 10.3390/s150716281.

Kuan et al., A systematic evaluation of nucleotide properties for CRISPR sgRNA design. BMC Bioinformatics. Jun. 6, 2017;18(1):297. doi: 10.1186/s12859-017-1697-6.

Kwok et al., G-Quadruplexes: Prediction, Characterization, and Biological Application. Trends Biotechnol. Oct. 2017;35(10):997-1013. doi: 10.1016/j.tibtech.2017.06.012. Epub Jul. 26, 2017.

Liu et al., Usherin is required for maintenance of retinal photoreceptors and normal development of cochlear hair cells. Proc Natl Acad Sci U S A. Mar. 13, 2007;104(11):4413-8. doi: 10.1073/pnas.0610950104. Epub Mar. 5, 2007.

Macfadden et al., Mechanism and structural diversity of exoribonuclease-resistant RNA structures in flaviviral RNAs. Nat Commun. Jan. 9, 2018;9(1):119. doi: 10.1038/s41467-017-02604-y.

Maerker et al., A novel Usher protein network at the periciliary reloading point between molecular transport machineries in vertebrate photoreceptor cells. Hum Mol Genet. Jan. 1, 2008;17(1):71-86. doi: 10.1093/hmg/ddm285. Epub Sep. 28, 2007.

Mahoney et al., The Next Immune-Checkpoint Inhibitors: PD-1/PD-L1 Blockade in Melanoma. Clin Ther. Apr. 1, 2015;37(4):764-82. doi: 10.1016/j.clinthera.2015.02.018. Epub Mar. 29, 2015.

Mali et al., CAS9 transcriptional activators for target specificity screening and paired nickases for cooperative genome engineering. Nat Biotechnol. Sep. 2013;31(9):833-8, Supplemental Info. doi: 10.1038/nbt.2675. Epub Aug. 1, 2013.

Marcovitz et al., Frustration in protein-DNA binding influences conformational switching and target search kinetics. Proc Natl Acad Sci U S A. Nov. 1, 2011;108(44):17957-62. doi: 10.1073/pnas.1109594108. Epub Oct. 14, 2011.

Micozzi et al., Human cytidine deaminase: a biochemical characterization of its naturally occurring variants. Int J Biol Macromol. Feb. 2014;63:64-74. doi: 10.1016/j.ijbiomac.2013.10.029. Epub Oct. 29, 2013. Erratum in: Int J Biol Macromol. Feb. 2014;63:262.

Millevoi et al., G-quadruplexes in RNA biology. Wiley Interdiscip Rev RNA. Jul.-Aug. 2012;3(4):495-507. doi: 10.1002/wrna.1113. Epub Apr. 4, 2012.

Min et al., Deep learning in bioinformatics. Brief Bioinform. Sep. 1, 2017;18(5):851-869. doi: 10.1093/bib/bbw068.

Ousterout et al., Multiplex CRISPR/Cas9-based genome editing for correction of dystrophin mutations that cause Duchenne muscular dystrophy. Nat Commun. Feb. 18, 2015;6:6244. doi: 10.1038/ncomms7244.

Pandey et al., Effect of loops and G-quartets on the stability of RNA G-quadruplexes. J Phys Chem B. Jun. 13, 2013;117(23):6896-905. doi: 10.1021/jp401739m. Epub May 29, 2013. Supplementary Information, 21 pages.

Petit et al., Powerful mutators lurking in the genome. Philos Trans R Soc Lond B Biol Sci. Mar. 12, 2009;364(1517):705-15. doi: 10.1098/rstb.2008.0272.

Piotukh et al., Directed evolution of sortase A mutants with altered substrate selectivity profiles. J Am Chem Soc. Nov. 9, 2011;133(44):17536-9. doi: 10.1021/ja205630g. Epub Oct. 13, 2011.

(56) References Cited

OTHER PUBLICATIONS

Reiners et al., Scaffold protein harmonin (USH1C) provides molecular links between Usher syndrome type 1 and type 2. Hum Mol Genet. Dec. 15, 2005;14(24):3933-43. doi: 10.1093/hmg/ddi417. Epub Nov. 21, 2005.
Robert et al., Virus-Like Particles Derived from HIV-1 for Delivery of Nuclear Proteins: Improvement of Production and Activity by Protein Engineering. Mol Biotechnol. Jan. 2017;59(1):9-23. doi: 10.1007/s12033-016-9987-1.
Saayman et al., The therapeutic application of CRISPR/Cas9 technologies for HIV. Expert Opin Biol Ther. Jun. 2015;15(6):819-30. doi: 10.1517/14712598.2015.1036736. Epub Apr. 12, 2015.
Sorusch et al., Characterization of the ternary Usher syndrome SANS/ush2a/whirlin protein complex. Hum Mol Genet. Mar. 15, 2017;26(6):1157-1172. doi: 10.1093/hmg/ddx027.
Steckelberg et al., A folded viral noncoding RNA blocks host cell exoribonucleases through a conformationally dynamic RNA structure. Proc Natl Acad Sci U S A. Jun. 19, 2018;115(25):6404-6409. doi: 10.1073/pnas. 1802429115. Epub Jun. 4, 2018.
Svitashev et al., Targeted Mutagenesis, Precise Gene Editing, and Site-Specific Gene Insertion in Maize Using Cas9 and Guide RNA. Plant Physiol. Oct. 2015;169(2):931-45. doi: 10.1104/p. 15.00793. Epub Aug. 12, 2015.
Vidal et al., Yeast forward and reverse 'n'-hybrid systems. Nucleic Acids Res. Feb. 15, 1999;27(4):919-29. doi: 10.1093/nar/27.4.919.
Wu et al., MLV based viral-like-particles for delivery of toxic proteins and nuclear transcription factors. Biomaterials. Sep. 2014;35(29):8416-26. doi: 10.1016/j.biomaterials.2014.06.006. Epub Jul. 3, 2014.
Wu et al., Widespread Influence of 3'-End Structures on Mammalian mRNA Processing and Stability. Cell. May 18, 2017;169(5):905-917.e11. doi: 10.1016/j.cell.2017.04.036.
Yi et al., Engineering of TEV protease variants by yeast ER sequestration screening (YESS) of combinatorial libraries. Proc Natl Acad Sci U S A. Apr. 30, 2013;110(18):7229-34. doi: 10.1073/pnas.1215994110. Epub Apr. 15, 2013.
Zhu et al., Novel Thrombotic Function of a Human SNP in STXBP5 Revealed by CRISPR/Cas9 Gene Editing in Mice. Arterioscler Thromb Vasc Biol. Feb. 2017;37(2):264-270. doi: 10.1161/ATVBAHA. 116.308614. Epub Dec. 29, 2016.

\* cited by examiner

EVOLVED CAS9 PROTEINS FOR GENE EDITING

RELATED APPLICATIONS

This application is a national stage filing under 35 U.S.C. § 371 of international PCT application, PCT/US2016/058345, filed Oct. 22, 2016, which claims priority under 35 U.S.C. § 119(e) to U.S. provisional patent applications, U.S. Ser. No. 62/245,828 filed Oct. 23, 2015, U.S. Ser. No. 62/279,346 filed Jan. 15, 2016, U.S. Ser. No. 62/311,763 filed Mar. 22, 2016, U.S. Ser. No. 62/322,178 filed Apr. 13, 2016, U.S. Ser. No. 62/357,352 filed Jun. 30, 2016, U.S. Ser. No. 62/370,700 filed Aug. 3, 2016, U.S. Ser. No. 62/398,490 filed Sep. 22, 2016, U.S. Ser. No. 62/408,686 filed Oct. 14, 2016, and U.S. Ser. No. 62/357,332 filed Jun. 30, 2016; each of which is incorporated herein by reference.

REFERENCE TO A SEQUENCE LISTING SUBMITTED AS A TEXT FILE VIA EFS-WEB

The present application contains a Sequence Listing which has been submitted in ASCII format via EFS-Web and is hereby incorporated by reference in its entirety. Said ASCII copy, created on Jun. 28, 2022, is named H082470224US02-SUBSEQ-EPG and is 3,977,840 bytes in size.

BACKGROUND OF THE INVENTION

Targeted editing of nucleic acid sequences, for example, the targeted cleavage or the targeted introduction of a specific modification into genomic DNA, is a highly promising approach for the study of gene function and also has the potential to provide new therapies for human genetic diseases.[1] An ideal nucleic acid editing technology possesses three characteristics: (1) high efficiency of installing the desired modification; (2) minimal off-target activity; and (3) the ability to be programmed to edit precisely any site in a given nucleic acid, e.g., any site within the human genome.[2] Current genome engineering tools, including engineered zinc finger nucleases (ZFNs),[3] transcription activator like effector nucleases (TALENs),[4] and most recently, the RNA-guided DNA endonuclease Cas9,[5] effect sequence-specific DNA cleavage in a genome. This programmable cleavage can result in mutation of the DNA at the cleavage site via non-homologous end joining (NHEJ) or replacement of the DNA surrounding the cleavage site via homology-directed repair (HDR).[6,7]

One drawback of the current technologies is that both NHEJ and HDR are stochastic processes that typically result in modest gene editing efficiencies as well as unwanted gene alterations that can compete with the desired alteration.[8] Since many genetic diseases in principle can be treated by effecting a specific nucleotide change at a specific location in the genome (for example, a C to T change in a specific codon of a gene associated with a disease),[9] the development of a programmable way to achieve such precise gene editing would represent both a powerful new research tool, as well as a potential new approach to gene editing-based human therapeutics.

Another drawback of current genome engineering tools is that they are limited with respect to the DNA sequences that can be targeted. When using ZNFs or TALENS, a new protein must be generated for each individual target sequence. While Cas9 can be targeted to virtually any target sequence by providing a suitable guide RNA, Cas9 technology is still limited with respect to the sequences that can be targeted by a strict requirement for a protospacer-adjacent motif (PAM), typically of the nucleotide sequence 5'-NGG-3', that must be present immediately adjacent to the 3'-end of the targeted DNA sequence in order for the Cas9 protein to bind and act upon the target sequence. The PAM requirement thus limits the sequences that can be efficiently targeted by Cas9 proteins.

SUMMARY OF THE INVENTION

Significantly, 80-90% of protein mutations responsible for human disease arise from the substitution, deletion, or insertion of only a single nucleotide.[6] Most current strategies for single-base gene correction include engineered nucleases (which rely on the creation of double-strand breaks, DSBs, followed by stochastic, inefficient homology-directed repair, HDR), and DNA-RNA chimeric oligonucleotides.[22] The latter strategy involves the design of a RNA/DNA sequence to base pair with a specific sequence in genomic DNA except at the nucleotide to be edited. The resulting mismatch is recognized by the cell's endogenous repair system and fixed, leading to a change in the sequence of either the chimera or the genome. Both of these strategies suffer from low gene editing efficiencies and unwanted gene alterations, as they are subject to both the stochasticity of HDR and the competition between HDR and non-homologous end-joining, NHEJ.[23-25] HDR efficiencies vary according to the location of the target gene within the genome,[26] the state of the cell cycle,[27] and the type of cell/tissue.[28] The development of a direct, programmable way to install a specific type of base modification at a precise location in genomic DNA with enzyme-like efficiency and no stochasticity therefore represents a powerful new approach to gene editing-based research tools and human therapeutics.

The clustered regularly interspaced short palindromic repeat (CRISPR) system is a recently discovered prokaryotic adaptive immune system[10] that has been modified to enable robust and general genome engineering in a variety of organisms and cell lines.[11] CRISPR-Cas (CRISPR-associated) systems are protein-RNA complexes that use an RNA molecule (sgRNA) as a guide to localize the complex to a target DNA sequence via base-pairing.[12] In the natural systems, a Cas protein then acts as an endonuclease to cleave the targeted DNA sequence.[13] The target DNA sequence must be both complementary to the sgRNA and also contain a "protospacer-adjacent motif" (PAM) at the 3'-end of the complementary region in order for the system to function.[14] The requirement for a PAM sequence limits the use of Cas9 technology, since not all desired targeted sequences include a PAM sequence at the 3'-end and thus cannot efficiently be targeted by wild-type Cas9 proteins.

Provided herein are novel Cas9 variants that exhibit activity on target sequences that do not include the canonical PAM sequence (5'-NGG-3', where N is any nucleotide) at the 3'-end. Such Cas9 variants are not restricted to target sequences that include the canonical PAM sequence at the 3'-end.

Among the known Cas proteins, *Streptococcus pyogenes* Cas9 has been mostly widely used as a tool for genome engineering.[15] This Cas9 protein is a large, multi-domain protein containing two distinct nuclease domains. Point mutations can be introduced into Cas9 to abolish nuclease activity, resulting in a dead Cas9 (dCas9) that still retains its ability to bind DNA in a sgRNA-programmed manner.[16] In principle, such Cas9 variants, when fused to another protein or domain, can target that protein to virtually any DNA sequence simply by co-expression with an appropriate sgRNA. Thus, this disclosure also comtemplates fusion proteins comprising such Cas9 variants and a DNA modifying domain (e.g., a deaminase, a nuclease, a nickase, a recombinase, a methyltransferase, a methylase, an acetylase, an acetyltransferase, a transcriptional activator, or a transcriptional repressor domain), as well as the use of such fusion proteins in correcting mutations in a genome (e.g., the genome of a human subject) that are associated with disease, or generating mutations in a genome (e.g., the human genome) to decrease or prevent expression of a gene.

In some embodiments, any of the Cas9 proteins provided herein may be fused to a protein that has an enzymatic activity. In some embodiments, the enzymatic activity modifies a target DNA. In some embodiments, the enzymatic activity is nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity. In some cases, the enzymatic activity is nuclease activity. In some cases, the nuclease activity introduces a double strand break in the target DNA. In some cases, the enzymatic activity modifies a target polypeptide associated with the target DNA. In some cases, the enzymatic activity is methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity or demyristoylation activity. In some cases, the target polypeptide is a histone and the enzymatic activity is methyltransferase activity, demethylase activity, acetyltransferase activity, deacetylase activity, kinase activity, phosphatase activity, ubiquitin ligase activity or deubiquitinating activity.

In some embodiments, any of the Cas9 proteins provided herein may be fused to a protein that has an enzymatic activity. In some embodiments, the enzymatic activity modifies a polypeptide associated with DNA (e.g. a histone). In some embodiments, the enzymatic activity is methyltransferase activity, demethylase activity, acetyltransferase activity, deacetylase activity, kinase activity, phosphatase activity, ubiquitin ligase activity (i.e., ubiquitination activity), deubiquitinating activity, adenylation activity, deadenylation activity, SUMOylating activity, deSUMOylating activity, ribosylation activity, deribosylation activity, myristoylation activity, demyristoylation activity glycosylation activity (e.g., from O-GlcNAc transferase) or deglycosylation activity. The enzymatic activities listed herein catalyze covalent modifications to proteins. Such modifications are known in the art to alter the stability or activity of the target protein (e.g., phosphorylation due to kinase activity can stimulate or silence protein activity depending on the target protein). Of particular interest as protein targets are histones. Histone proteins are known in the art to bind DNA and form complexes known as nucleosomes. Histones can be modified (e.g., by methylation, acetylation, ubuitination, phosphorylation) to elicit structural changes in the surrounding DNA, thus controlling the accessibility of potentially large portions of DNA to interacting factors such as transcription factors, polymerases and the like. A single histone can be modified in many different ways and in many different combinations (e.g., trimethylation of lysine 27 of histone 3, H3K27, is associated with DNA regions of repressed transcription while trimethylation of lysine 4 of histone 3, H3K4, is associated with DNA regions of active transcription). Thus, a site-directed modifying polypeptide with histone-modifying activity finds use in the site specific control of DNA structure and can be used to alter the histone modification pattern in a selected region of target DNA. Such methods find use in both research and clinical applications.

In some embodiments, the deaminase domain catalyzes the removal of an amine group from a molecule. In further embodiments, cytidine deaminase domains deaminate cytosine to yield uracil. In other embodiments, the nuclease domain has enzymatic activity and may cleave phosphodiester bonds between the nucleotide subunits of nucleic acids. In some embodiments, recombinase domains, which recombine specific sequences of DNA, may be used to manipulate the structure of genomes and to control gene expression. In further embodiments, methylase domains may be utilized to methylate their respective substrates, while acetylase domains may be used to acetylate their respective substrates. In other embodiments, acetyltransferase domains may be used to transfer an acetyl group. Examples of acetyltransferase molecules include, but are not limited to, histone acetyltransferases (e.g., CBP histone acetyltransferase), choline acetyltransferase, chloramphenicol acetytransferase, serotonic N-acetyltransferase, NatA acetyltransferase, and NatB acetyltransferase. The disclosure also contemplates transcriptional activator and transcriptional repressor domains. Transcriptional activator domains are regions of a transcription factor which may activate transcription from a promoter through an interaction or multiple interactions with a DNA binding domain, general transcription factors, and RNA polymerase. Transcriptional repressor domains are regions of a transcription factor which may repress transcription from a protomer through an interaction or multiple interactions with a DNA binding domain, general transcription factors, and RNA polymerase.

The potential of the Cas9 system for genome engineering is immense. Its unique ability to bring proteins to specific sites in a genome programmed by the sgRNA can be developed into a variety of site-specific genome engineering tools beyond nucleases, including transcriptional activators, transcriptional repressors, histone-modifying proteins, integrases, deaminases, and recombinases.[11] Some of these potential applications have recently been implemented through dCas9 fusions with transcriptional activators to afford RNA-guided transcriptional activators,[17,18] transcriptional repressors,[16,19,20] and chromatin modification enzymes.[21] Simple co-expression of these fusions with a variety of sgRNAs results in specific expression of the target genes. These seminal studies have paved the way for the design and construction of readily programmable sequence-specific effectors for the precise manipulation of genomes.

Some aspects of this disclosure provide strategies, systems, proteins, nucleic acids, compositions, cells, reagents, methods, and kits that are useful for the targeted binding, editing, and/or cleaving of nucleic acids, including editing a single site within a subject's genome, e.g., a human subject's genome. In some embodiments, recombinant Cas9 proteins are provided that comprise at least one, at least two, at least three, at least four, at least five, at least six, at least seven, at least eight, at least nine, or at least ten mutations as compared to a naturally occurring Cas9 protein, and that exhibit activity on target sequences that do not include the canonical PAM (5'-NGG-3', where N is any nucleotide) at the 3'-end. Examples of such Cas9 protein mutations are given in Tables 3, 5, 8, and 9. In some embodiments, fusion proteins of Cas9 and nucleic acid editing enzymes or enzymatic domains, e.g., deaminase domains, are provided. In some embodiments, methods for targeted nucleic acid binding, editing, and/or cleaving are provided. In some embodiments, reagents and kits for the generation of targeted nucleic acid binding, editing, and/or cleaving proteins, e.g., fusion proteins of Cas9 variants and nucleic acid editing enzymes or domains, are provided.

Some aspects of this disclosure provide recombinant Cas9 proteins comprising an amino acid sequence that is at least 80%, at least 85%, at least 90%, at least 92%, at least 95%, at least 96%, at least 97%, at least 98%, at least 99%, or at least 99.5% identical to the amino acid sequence of Cas9 as provided by any of the sequences set forth in SEQ ID NOs: 9-262, wherein the amino acid sequence of the Cas9 protein comprises at least one, at least two, at least three, at least four, at least five, at least six, or at least seven mutations in an amino acid residue selected from the group consisting of amino acid residues 122, 137, 182, 262, 294, 409, 480, 543, 660, 694, 1219, and 1329 of S. pyogenes Cas9 having the amino acid sequence provided in SEQ ID NO: 9, or in a corresponding amino acid residue in any of the amino acid sequences provided in SEQ ID NOs: 10-262. In some embodiments, the recombinant Cas9 protein comprises a RuvC and an HNH domain. In some embodiments, the amino acid sequence of the recombinant Cas9 protein is not identical to the amino acid sequence of a naturally occurring Cas9 protein. In some embodiments, the amino acid sequence of the Cas9 protein comprises at least one, at least two, at least three, at least four, at least five, at least six, or at least seven mutations selected from the group consisting of X262T, X294R, X409I, X480K, X543D, X694I, and X1219V of the amino acid sequence provided in SEQ ID NO: 9, or a corresponding mutation in any of the amino acid sequences provided in SEQ ID NOs: 10-262, wherein X represents any amino acid. In some embodiments, the amino acid sequence of the Cas9 protein comprises at least one, at least two, at least three, at least four, at least five, at least six, or at least seven mutations selected from the group consisting of A262T, K294R, S409I, E480K, E543D, M694I, and E1219V of the amino acid sequence provided in SEQ ID NO: 9, or a corresponding mutation in any of the amino acid sequences provided in SEQ ID NOs: 10-262.

Other aspects of this disclosure provide recombinant Cas9 proteins comprising an amino acid sequence that is at least 80%, at least 85%, at least 90%, at least 92%, at least 95%, at least 96%, at least 97%, at least 98%, at least 99%, or at least 99.5% identical to the amino acid sequence of Cas9 as provided by any of the sequences set forth in SEQ ID NOs: 10-262, wherein the amino acid sequence of the Cas9 protein comprises at least one, at least two, at least three, at least four, at least five, at least six, or at least seven mutations in an amino acid residue selected from the group consisting of amino acid residues 262, 267, 294, 405, 409, 480, 543, 694, 1219, 1224, 1256, and 1362 of the amino acid sequence provided in SEQ ID NO: 9, or in a corresponding amino acid residue in any of the amino acid sequences provided in SEQ ID NOs: 10-262; and wherein the amino acid sequence of the recombinant Cas9 protein is not identical to the amino acid sequence of a naturally occurring Cas9 protein. In some embodiments, the Cas9 protein comprises a RuvC and an HNH domain. In some embodiments, the amino acid sequence of the Cas9 protein comprises at least one, at least two, at least three, at least four, at least five, at least six, or at least seven mutations selected from the group consisting of X262T, X267G, X294R, X405I, X409I, X480K, X543D, X694I, X1219V, X1224K, and X1256K of the amino acid sequence provided in SEQ ID NO: 9, or a corresponding mutation in any of the amino acid sequences provided in SEQ ID NOs: 10-262, wherein X represents any amino acid. In some embodiments, the amino acid sequence of the Cas9 protein comprises at least one, at least two, at least three, at least four, at least five, at least six, or at least seven mutations selected from the group consisting of A262T, S267G, K294R, F405I, S409I, E480K, E543D, M694I, E1219V, N1224K, and Q1256K of the amino acid sequence provided in SEQ ID NO: 9, or a corresponding mutation in any of the amino acid sequences provided in in SEQ ID NOs: 10-262.

It should be appreciated that any of the amino acid mutations described herein, (e.g., A262T) from a first amino acid residue (e.g., A) to a second amino acid residue (e.g., T) may also include mutations from the first amino acid residue to an amino acid residue that is similar to (e.g., conserved) the second amino acid residue. For example, a mutation of an alanine to a threonine (e.g., a A262T mutation) may also be a mutation from an alanine to an amino acid that is similar in size and chemical properties to a threonine, for example, serine. Additional similar amino acid pairs include, but are not limited to, the following: phenylalanine and tyrosine; asparagine and glutamine; methionine and cysteine; aspartic acid and glutamic acid; and arginine and lysine. The skilled artisan would recognize that such conservative amino acid substitutions will likely have minor effects on protein structure and are likely to be well tolerated without compromising function. In some embodiments, any of the amino acid mutations provided herein from one amino acid to a threonine may be an amino acid mutation to a serine. In some embodiments, any of the amino acid mutations provided herein from one amino acid to an arginine may be an amino acid mutation to a lysine. In some embodiments, any of the amino acid mutations provided herein from one amino acid to an isoleucine may be an amino acid mutation to an alanine, valine, methionine, or leucine. In some embodiments, any of the amino acid mutations provided herein from one amino acid to a lysine may be an amino acid mutation to an arginine. In some embodiments, any of the amino acid mutations provided herein from one amino acid to an aspartic acid may be an amino acid mutation to a glutamic acid or asparagine. In some embodiments, any of the amino acid mutations provided herein from one amino acid to a valine may be an amino acid mutation to an alanine, isoleucine, methionine, or leucine. In some embodiments, any of the amino acid mutations provided herein from one amino acid to a glycine may be an amino acid mutation to an alanine. It should be appreciated, however, that additional conserved amino acid residues would be recognized by the skilled artisan and any of the amino acid mutations to other conserved amino acid residues are also within the scope of this disclosure.

In some embodiments, the Cas9 protein is a Cas9 domain of a fusion protein. In some embodiments, the amino acid sequence of the Cas9 protein comprises an X1219V mutation of the amino acid sequence provided in SEQ ID NO: 9, or a corresponding mutation in any of the amino acid sequences provided in SEQ ID NOs: 10-262, wherein X represents any amino acid. In some embodiments, the mutation is X1219A, X1219I, X1219M, or X1219L.

In some embodiments, the amino acid sequence of the Cas9 protein comprises an E1219V mutation of the amino acid sequence provided in SEQ ID NO: 9, or a corresponding mutation in any of the amino acid sequences provided in SEQ ID NOs: 10-262. In some embodiments, the mutation is E1219A, E1219I, E1219M or E1219L.

In some embodiments, the amino acid sequence of the Cas9 protein comprises an X480K mutation of the amino acid sequence provided in SEQ ID NO: 9, or a corresponding mutation in any of the amino acid sequences provided in SEQ ID NOs: 10-262, wherein X represents any amino acid. In some embodiments, the mutation is X480R.

In some embodiments, the amino acid sequence of the Cas9 protein comprises an E480K mutation of the amino acid sequence provided in SEQ ID NO: 9, or a corresponding mutation in any of the amino acid sequences provided in SEQ ID NOs: 10-262. In some embodiments, the mutation is E480R.

In some embodiments, the amino acid sequence of the Cas9 protein comprises an X543D mutation of the amino acid sequence provided in SEQ ID NO: 9, or a corresponding mutation in any of the amino acid sequences provided in SEQ ID NOs: 10-262, wherein X represents any amino acid. In some embodiments, the mutation is X543N.

In some embodiments, the amino acid sequence of the Cas9 protein comprises an E543D mutation of the amino acid sequence provided in SEQ ID NO: 9, or a corresponding mutation in any of the amino acid sequences provided in SEQ ID NOs: 10-262. In some embodiments, the mutation is E543N.

In some embodiments, the amino acid sequence of the Cas9 protein comprises the mutations X480K, X543D, and X1219V of the amino acid sequence provided in SEQ ID NO: 9, or a corresponding mutation in any of the amino acid sequences provided in SEQ ID NOs: 10-262, wherein X represents any amino acid.

In some embodiments, the amino acid sequence of the Cas9 protein comprises the mutations X262T, X409I, X480K, X543D, X694I, and X1219V of the amino acid sequence provided in SEQ ID NO: 9, or a corresponding mutation in any of the amino acid sequences provided in SEQ ID NOs: 10-262, wherein X represents any amino acid.

In some embodiments, the amino acid sequence of the Cas9 protein comprises the mutations X294R, X480K, X543D, X1219V, X1256K, and X1362P of the amino acid sequence provided in SEQ ID NO: 9, or a corresponding mutation in any of the amino acid sequences provided in SEQ ID NOs: 10-262, wherein X represents any amino acid.

In some embodiments, the amino acid sequence of the Cas9 protein comprises the mutations X294R, X480K, X543D, X1219V, and X1256K of the amino acid sequence provided in SEQ ID NO: 9, or a corresponding mutation in any of the amino acid sequences provided in SEQ ID NOs: 10-262, wherein X represents any amino acid.

In some embodiments, the amino acid sequence of the Cas9 protein comprises the mutations X267G, X294R, X480K, X543D, X1219V, X1224K, and X1256K of the amino acid sequence provided in SEQ ID NO: 9, or a corresponding mutation in any of the amino acid sequences provided in SEQ ID NOs: 10-262, wherein X represents any amino acid.

In some embodiments, the amino acid sequence of the Cas9 protein comprises the mutations X262T, X405I, X409I, X480K, X543D, X694I, and X1219V of the amino acid sequence provided in SEQ ID NO: 9, or a corresponding mutation in any of the amino acid sequences provided in SEQ ID NOs: 10-262, wherein X represents any amino acid.

In some embodiments, the amino acid sequence of the Cas9 protein comprises the mutations E480K, E543D, and E1219V of the amino acid sequence provided in SEQ ID NO: 9, or a corresponding mutation in any of the amino acid sequences provided in SEQ ID NOs: 10-262.

In some embodiments, the amino acid sequence of the Cas9 protein comprises the mutations A262T, S409I, E480K, E543D, M694I, and E1219V of the amino acid sequence provided in SEQ ID NO: 9, or a corresponding mutation in any of the amino acid sequences provided in SEQ ID NOs: 10-262.

In some embodiments, the amino acid sequence of the Cas9 protein comprises the mutations K294R, E480K, E543D, E1219V, Q1256K, and L1362P of the amino acid sequence provided in SEQ ID NO: 9, or a corresponding mutation in any of the amino acid sequences provided in SEQ ID NOs: 10-262.

In some embodiments, the amino acid sequence of the Cas9 protein comprises the mutations K294R, E480K, E543D, E1219V, and Q1256K of the amino acid sequence provided in SEQ ID NO: 9, or a corresponding mutation in any of the amino acid sequences provided in SEQ ID NOs: 10-262.

In some embodiments, the amino acid sequence of the Cas9 protein comprises the mutations S267G, K294R, E480K, E543D, E1219V, N1224K, and Q1256K of the amino acid sequence provided in SEQ ID NO: 9, or a corresponding mutation in any of the amino acid sequences provided in SEQ ID NOs: 10-262.

In some embodiments, the amino acid sequence of the Cas9 protein comprises the mutations A262T, F405I, S409I, E480K, E543D, M694I, and E1219V of the amino acid sequence provided in SEQ ID NO: 9, or a corresponding mutation in any of the amino acid sequences provided in SEQ ID NOs: 10-262.

The HNH nuclease domain of Cas9 functions to cleave the DNA strand complementary to the guide RNA (gRNA). Its active site consists of a $\beta\beta\alpha$-metal fold, and its histidine 840 activates a water molecule to attack the scissile phosphate, which is more electrophilic due to coordination with a magnesium ion, resulting in cleavage of the the 3'-5' phosphate bond. In some embodiments, the amino acid sequence of the HNH domain is at least 80%, at least 85%, at least 90%, at least 92%, at least 95%, at least 96%, at least 97%, at least 98%, at least 99%, or at least 99.5% identical to the amino acid sequence of the HNH domain of any of SEQ ID NOs: 9-262. In some embodiments, the amino acid sequence of the HNH domain is identical to the amino acid sequence of the HNH domain of any of SEQ ID NOs: 9-262.

The RuvC domain of Cas9 cleaves the non-target DNA strand. It is encoded by sequentially disparate sites which interact in the tertiary structure to form the RuvC cleavage domain and consists of an RNase H fold structure. In some embodiments, the amino acid sequence of the RuvC domain is at least 80%, at least 85%, at least 90%, at least 92%, at least 95%, at least 96%, at least 97%, at least 98%, at least 99%, or at least 99.5% identical to the amino acid sequence of the RuvC domain of any of SEQ ID NOs: 9-262. In some embodiments, the amino acid sequence of the RuvC domain is identical to the amino acid sequence of the RuvC domain of any of SEQ ID NOs: 9-262.

In some embodiments, the Cas9 protein comprises one or more mutations that affects (e.g., inhibits) the ability of Cas9 to cleave one or both strands of a DNA duplex. In some embodiments, the Cas9 protein comprises a D10A and/or a H840A mutation of the amino acid sequence provided in SEQ ID NO: 9, or a corresponding mutation in any of the amino acid sequences provided in SEQ ID NOs: 10-262. In some embodiments, the Cas9 protein comprises a D10X$_1$ and/or a H840X$_2$ mutation of the amino acid sequence provided in SEQ ID NO: 9, or a corresponding mutation in any of the amino acid sequences provided in SEQ ID NOs:

10-262, wherein $X_1$ is any amino acid except for D, and $X_2$ is any amino acid except for H. In some embodiments, the Cas9 protein comprises an D10A mutation of the amino acid sequence provided in SEQ ID NO: 9, or a corresponding mutation in any of the amino acid sequences provided in SEQ ID NOs: 10-262. In some embodiments, the Cas9 protein comprises an H at amino acid residue 840 of the amino acid sequence provided in SEQ ID NO: 9, or a corresponding residue in any of the amino acid sequences provided in SEQ ID NOs: 10-262. In some embodiments, the Cas9 protein comprises an H840A mutation of the amino acid sequence provided in SEQ ID NO: 9, or a corresponding mutation in any of the amino acid sequences provided in SEQ ID NOs: 10-262. In some embodiments, the Cas9 protein comprises a D at amino acid residue 10 of the amino acid sequence provided in SEQ ID NO: 9, or a corresponding residue in any of the amino acid sequences provided in SEQ ID NOs: 10-262.

In some embodiments, the Cas9 protein of the present disclosure exhibits activity, for example, increased binding, on a target sequence that does not include the canonical PAM sequence (5'-NGG-3') at its 3'-end as compared to *Streptococcus pyogenes* Cas9 as provided by SEQ ID NO: 9.

Some aspects of this disclosure provide recombinant Cas9 proteins comprising an amino acid sequence that is at least 90% identical to the amino acid sequence of *Streptococcus pyogenes* Cas9 as provided by SEQ ID NO: 9 wherein the amino acid sequence of the Cas9 protein comprises at least one, at least two, at least three, at least four, at least five, at least six, or at least seven mutations selected from the group consisting of amino acid residues 262, 267, 294, 405, 409, 480, 543, 694, 1219, 1224, 1256, and 1362 of the amino acid sequence provided in SEQ ID NO: 9, wherein the amino acid sequence of the recombinant Cas9 protein is not identical to the amino acid sequence of a naturally occurring Cas9 protein, and wherein the recombinant Cas9 protein exhibits increased activity on a target sequence that does not comprise the canonical PAM sequence (5'-NGG-3') at its 3' end as compared to *Streptococcus pyogenes* Cas9 as provided in SEQ ID NO: 9. In some embodiments, the *Streptococcus pyogenes* Cas9 comprises a RuvC and an HNH domain. In other embodiments, the Cas9 protein comprises at least one, at least two, at least three, at least four, at least five, at least six, or at least seven mutations selected from the group consisting of amino acid residues 122, 137, 182, 262, 294, 409, 480, 543, 660, 694, 1219, and 1329 of the amino acid sequence provided in SEQ ID NO: 9

As one example, the Cas9 protein may exhibit increased binding to the target sequence, may exhibit increased nuclease activity at the target sequence, or may exhibit an increase in other activities, depending on whether the Cas 9 protein is fused to an additional domain, such as an enzyme that has enzymatic activity. In some embodiments, the enzymatic activity modifies a target DNA. In some embodiments, the enzymatic activity is nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity. In some cases, the enzymatic activity is nuclease activity. In some cases, the nuclease activity introduces a double strand break in the target DNA. In some cases, the enzymatic activity modifies a target polypeptide associated with the target DNA. In some cases, the enzymatic activity is methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity or demyristoylation activity. In some cases, the target polypeptide is a histone and the enzymatic activity is methyltransferase activity, demethylase activity, acetyltransferase activity, deacetylase activity, kinase activity, phosphatase activity, ubiquitin ligase activity or deubiquitinating activity.

In some embodiments, any of the Cas9 protein is fused to a protein that has an enzymatic activity. In some embodiments, the enzymatic activity modifies a polypeptide associated with DNA (e.g. a histone). In some embodiments, the enzymatic activity is methyltransferase activity, demethylase activity, acetyltransferase activity, deacetylase activity, kinase activity, phosphatase activity, ubiquitin ligase activity (i.e., ubiquitination activity), deubiquitinating activity, adenylation activity, deadenylation activity, SUMOylating activity, deSUMOylating activity, ribosylation activity, deribosylation activity, myristoylation activity, demyristoylation activity glycosylation activity (e.g., from O-GlcNAc transferase) or deglycosylation activity. The enzymatic activities listed herein catalyze covalent modifications to proteins. Such modifications are known in the art to alter the stability or activity of the target protein (e.g., phosphorylation due to kinase activity can stimulate or silence protein activity depending on the target protein). Of particular interest as protein targets are histones. Histone proteins are known in the art to bind DNA and form complexes known as nucleosomes. Histones can be modified (e.g., by methylation, acetylation, ubuitination, phosphorylation) to elicit structural changes in the surrounding DNA, thus controlling the accessibility of potentially large portions of DNA to interacting factors such as transcription factors, polymerases and the like. A single histone can be modified in many different ways and in many different combinations (e.g., trimethylation of lysine 27 of histone 3, H3K27, is associated with DNA regions of repressed transcription while trimethylation of lysine 4 of histone 3, H3K4, is associated with DNA regions of active transcription). Thus, a site-directed modifying polypeptide with histone-modifying activity finds use in the site specific control of DNA structure and can be used to alter the histone modification pattern in a selected region of target DNA. Such methods find use in both research and clinical applications.

In some embodiments, the Cas9 protein exhibits activity on a target sequence having a 3' end that is not directly adjacent to, or does not have the canonical PAM sequence (5'-NGG-3'), that is at least 2-fold, at least 3-fold, at least 5-fold, at least 10-fold, at least 50-fold, at least 100-fold, at least 500-fold, at least 1,000-fold, at least 5,000-fold, at least 10,000-fold, at least 50,000-fold, at least 100,000-fold, at least 500,000-fold, or at least 1,000,000-fold increased as compared to the activity of *Streptococcus pyogenes* Cas9 as provided by SEQ ID NO: 9 on the same target sequence.

In some embodiments, the 3'-end of the target sequence is directly adjacent to an AGC, GAG, TTT, GTG, CAA CAC, GAT, TAA, ACG, CGA, or CGT sequence.

In some embodiments, the Cas9 protein activity is measured by a nuclease assay or a nucleic acid binding assay, which are known in the art and would be apparent to the skilled artisan. As provided herein, the Cas9 protein may be fused to one or more domains that confer an activity to the protein, such as a nucleic acid editing activity (e.g., deaminase activity or transcriptional activation activity), which may be measured (e.g., by a deaminase assay or transcriptional activation assay). In some embodiments, the Cas9 protein is fused to a deaminase domain and its activity may be measured using a deaminase assay. In some embodiments, the Cas9 protein is fused to a transcriptional activation domain and its activity may be measured using a transcriptional activation assay, for example, reporter activation assay where the reporter, e.g., GFP or luciferase, among others, is expressed in response to Cas9 binding to a target sequence.

In some embodiments, the amino acid sequence of the Cas9 protein comprises any of the mutations provided herein. For example, in some embodiments, the amino acid sequence of the Cas9 protein comprises at least one, at least two, at least three, at least four, at least five, at least six, or at least seven mutations selected from the group consisting of X262T, X267G, X294R, X405I, X409I, X480K, X543D, X694I, X1219V, X1224K, X1256K, and X1362P of the amino acid sequence provided in SEQ ID NO: 9, or a corresponding mutation in any of the amino acid sequences provided in SEQ ID NOs: 10-262, wherein X represents any amino acid. In other embodiments, the mutations may be A262T, S267G, K294R, F405I, S409I, E480K, E543D, M694I, E1219V, N1224K, Q1256K, and L1362P of the amino acid sequence provided in SEQ ID NO: 9, or a corresponding mutation in any of the amino acid sequences provided in SEQ ID NOs: 10-262.

In some embodiments, the amino acid sequence of the Cas9 protein comprises any of the mutations provided herein. For example, in some embodiments, the amino acid sequence of the Cas9 protein comprises at least one, at least two, at least three, at least four, at least five, at least six, or at least seven mutations selected from the group consisting of X262T, X294R, X409I, X480K, X543D, X694I, and X1219V of the amino acid sequence provided in SEQ ID NO: 9, or a corresponding mutation in any of the amino acid sequences provided in SEQ ID NOs: 10-262, wherein X represents any amino acid. In other embodiments, the mutations may be A262T, K294R, S409I, E480K, E543D, M694I, or E1219V of the amino acid sequence provided in SEQ ID NO: 9, or a corresponding mutation in any of the amino acid sequences provided in SEQ ID NOs: 10-262.

In some embodiments, the amino acid sequence of the Cas9 protein comprises an X1219V mutation or an E1219V mutation of the amino acid sequence provided in SEQ ID NO: 9, or a corresponding mutation in any of the amino acid sequences provided in SEQ ID NOs: 10-262, wherein X represents any amino acid.

In some embodiments, the amino acid sequence of the Cas9 protein comprises an X480K mutation or an E480K mutation of the amino acid sequence provided in SEQ ID NO: 9, or a corresponding mutation in any of the amino acid sequences provided in SEQ ID NOs: 10-262, wherein X represents any amino acid.

In some embodiments, the amino acid sequence of the Cas9 protein comprises an X543D mutation or a E543D mutation of the amino acid sequence provided in SEQ ID NO: 9, or a corresponding mutation in any of the amino acid sequences provided in SEQ ID NOs: 10-262, wherein X represents any amino acid.

In some embodiments, the amino acid sequence of the Cas9 comprises the mutations X480K, X543D, and X1219V; or the mutations E480K, E543D, and E1219V of the amino acid sequence provided in SEQ ID NO: 9, or a corresponding mutation in any of the amino acid sequences provided in SEQ ID NOs: 10-262, wherein X represents any amino acid.

In some embodiments, the amino acid sequence of the Cas9 comprises the mutations X262T, X409I, X480K, X543D, X694I, and X1219V; or the mutations A262T, S409I, E480K, E543D, M694I, and E1219V of the amino acid sequence provided in SEQ ID NO: 9, or a corresponding mutation in any of the amino acid sequences provided in SEQ ID NOs: 10-262, wherein X represents any amino acid.

In some embodiments, the amino acid sequence of the Cas9 protein comprises the mutations X294R, X480K, X543D, X1219V, X1256K, and X1362P; or the mutations K294R, E480K, E543D, E1219V, Q1256K, and L1362P of the amino acid sequence provided in SEQ ID NO: 9, or a corresponding mutation in any of the amino acid sequences provided in SEQ ID NOs: 10-262, wherein X represents any amino acid.

In some embodiments, the amino acid sequence of the Cas9 protein comprises the mutations X294R, X480K, X543D, X1219V, and X1256K, or mutations K294R, E480K, E543D, E1219V, and Q1256K of the amino acid sequence provided in SEQ ID NO: 9, or a corresponding mutation in any of the amino acid sequences provided in SEQ ID NOs: 10-262, wherein X represents any amino acid.

In some embodiments, the amino acid sequence of the Cas9 protein comprises the mutations X267G, X294R, X480K, X543D, X1219V, X1224K, and X1256K; or the mutations S267G, K294R, E480K, E543DE1219V, N1224K, and Q1256K of the amino acid sequence provided in SEQ ID NO: 9, or a corresponding mutation in any of the amino acid sequences provided in SEQ ID NOs: 10-262, wherein X represents any amino acid.

In some embodiments, the amino acid sequence of the Cas9 protein comprises the mutations X262T, X405I, X409I, X480K, X543D, X694I, and X1219V; or the mutations A262T, F405I, S409I, E480K, E543D, M694I, and E1219V of the amino acid sequence provided in SEQ ID NO: 9, or a corresponding mutation in any of the amino acid sequences provided in SEQ ID NOs: 10-262, wherein X represents any amino acid.

In some embodiments, the amino acid sequence of the HNH domain is at least 80%, at least 85%, at least 90%, at least 92%, at least 95%, at least 96%, at least 97%, at least 98%, at least 99%, or at least 99.5% identical to the amino acid sequence of the HNH domain of any of SEQ ID NOs: 9-262. In some embodiments, the amino acid sequence of the HNH domain is identical to the amino acid sequence of any of the HNH domains of SEQ ID NOs: 9-262.

In some embodiments, the amino acid sequence of the RuvC domain is at least 80%, at least 85%, at least 90%, at least 92%, at least 95%, at least 96%, at least 97%, at least 98%, at least 99%, or at least 99.5% identical to the amino acid sequence of the RuvC domain of any of SEQ ID NOs: 9-262. In some embodiments, the amino acid sequence of the RuvC domain is identical to the amino acid sequence of any of the RuvC domains of SEQ ID NOs: 9-262.

In some embodiments, the Cas9 protein comprises at D10A and/or a H840A mutation in the amino acid sequence provided in SEQ ID NO: 9, or a corresponding mutation in any of the amino acid sequences provided in SEQ ID NOs: 10-262. In some embodiments, the Cas9 protein comprises a D10$X_1$ and/or a H840$X_2$ mutation of the amino acid sequence provided in SEQ ID NO: 9, or a corresponding mutation in any of the amino acid sequences provided in SEQ ID NOs: 10-262, wherein X1 is any amino acid except for D, and wherein $X_2$ is any amino acid except for H. In some embodiments, the Cas9 protein comprises an D10A mutation of the amino acid sequence provided in SEQ ID NO: 9, or a corresponding mutation in any of the amino acid sequences provided in SEQ ID NOs: 10-262. In some embodiments, the Cas9 protein comprises an H at amino acid residue 840 of the amino acid sequence provided in SEQ ID NO: 9, or a corresponding residue in any of the amino acid sequences provided in SEQ ID NOs: 10-262. In some embodiments, the Cas9 protein comprises an H840A mutation of the amino acid sequence provided in SEQ ID NO: 9, or a corresponding mutation in any of the amino acid sequences provided in SEQ ID NOs: 10-262. In some embodiments, the Cas9 protein comprises an D at amino acid residue 10 of the amino acid sequence provided in SEQ ID NO: 9, or a corresponding residue in any of the amino acid sequences provided in SEQ ID NOs: 10-262.

Some aspects of this disclosure provide fusion proteins comprising a Cas9 protein as provided herein that is fused to a second protein, thus forming a fusion protein. In some embodiments, the second protein is fused to the N-terminus of the Cas9 protein. In some embodiments, the second protein is fused to the C-terminus of the Cas9 protein. In some embodiments, the Cas9 domain and the effector domain are fused via a linker. The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may included functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some embodiments, the linker comprises a chemical group or molecule linking two molecules or moieties, e.g., two domains of a fusion protein, such as, for example, a nuclease-inactive Cas9 domain and a effector domain (e.g., a deaminase domain). In some embodiments, the linker comprises one or more amino acid residues. For example, the linker may comprise at least 1, 2, 3, 4, 5, 6, 7, 8, 9, 10, 11, 12, 13, 14, 15, 16, 17, 18, 19, 20, 21, 25, 30, 35, 40, 45, 50, or more amino acid residues. In some embodiments, the linker is 3, 9, 16, or 21 amino acids in length. In some embodiments, the linker comprises a $(GGGGS)_n$ (SEQ ID NO: 5), a $(G)_n$ (SEQ ID NO: 5087), an $(EAAAK)_n$ (SEQ ID NO: 6), a $(GGS)_n$ (SEQ ID NO: 5088), an SGSETPGTS-ESATPES (SEQ ID NO: 7) (also referred to as XTEN), or an $(XP)_n$ (SEQ ID NO: 5089) motif, or a combination of any of these, wherein n is independently an integer between 1 and 30. In some embodiments, wherein the linker comprises a $(GGS)_3$ (SEQ ID NO: 5088) motif or a SGSETPGTS-ESATPES (SEQ ID NO: 7) (XTEN) motif.

Some aspects of this disclosure provide fusion proteins comprising a Cas9 protein as provided herein that is fused to a second protein, thus forming a fusion protein. In some embodiments, the second protein is fused to the N-terminus of the Cas9 protein. In some embodiments, the second protein is fused to the C-terminus of the Cas9 protein. In some embodiments, the Cas9 domain and the effector domain are fused via a nuclear localization sequence (NLS), for example a NLS comprising the amino acid sequence PKKKRKV (SEQ ID NO: 299), MDSLLMNRRKFLY-QFKNVRWAKGRRETYLC (SEQ ID NO: 300), or SPKKKRKVEAS (SEQ ID NO: 284). In some embodiments, a NLS may be combined with any of the linkers listed above.

In some embodiments, the effector domain comprises an enzymatic domain. In some embodiments, the effector domain comprises a nuclease, a nickase, a recombinase, a deaminase, a methyltransferase, a methylase, an acetylase, an acetyltransferase, a transcriptional activator, or a transcriptional repressor domain, which may have nuclease activity, nickase activity, recombinase activity, deaminase activity, methyltransferase activity, methylase activity, acetylase activity, acetyltransferase activity transcriptional activation activity or transcriptional repression activity, respectively. In some embodiments, the effector domain is a effector domain. In some embodiments, the effector domain is a deaminase domain. In some embodiments, the deaminase is a cytosine deaminase or a cytidine deaminase. In some embodiments, the deaminase is an apolipoprotein B mRNA-editing complex (APOBEC) family deaminase. In some embodiments, the deaminase is an APOBEC1 deaminase. In some embodiments, the deaminase is an APOBEC2 deaminase. In some embodiments, the deaminase is an APOBEC3 deaminase. In some embodiments, the deaminase is an APOBEC3A deaminase. In some embodiments, the deaminase is an APOBEC3D deaminase. In some embodiments, the deaminase is an APOBEC3E deaminase. In some embodiments, the deaminase is an APOBEC3F deaminase. In some embodiments, the deaminase is an APOBEC3G deaminase. In some embodiments, the deaminase is an APOBEC3H deaminase. In some embodiments, the deaminase is an APOBEC4 deaminase. In some embodiments, the deaminase is an activation-induced deaminase (AID). In some embodiments, the effector domain is at least 80%, at least 85%, at least 90%, at least 92%, at least 95%, at least 96%, at least 97%, at least 98%, at least 99%, or at least 99.5% identical to the deaminase domain of any one of SEQ ID NOs: 263-281. In some embodiments, the deaminase is a cytidine deaminase. In some embodiments, the deaminase is an apolipoprotein B mRNA-editing complex (APOBEC) family deaminase. In some embodiments, the deaminase is an APOBEC1 family deaminase. In some embodiments, the deaminase is an activation-induced cytidine deaminase (AID). In some embodiments, the deaminase is an ACF1/ASE deaminase. In some embodiments, the deaminase is an adenosine deaminase. In some embodiments, the deaminase is an ADAT family deaminase.

Some aspects of this disclosure provide fusion proteins comprising a Cas9 protein fused to a effector domain, e.g., a deaminase, and a uracil glycosylase inhibitor (UGI). Some aspects of this disclosure are based on the recognition that such fusion proteins may exhibit an increased nucleic acid editing efficiency as compared to fusion proteins not comprising an UGI domain. Domains such as the deaminase domains and UGI domains have been described and are within the scope of this disclosure. For example domains such as deaminase domains and UGI domains have been described in Provisional Application Nos.: 62/245,828, filed Oct. 23, 2015, 62/279,346 filed Jan. 15, 2016, 62/311,763 filed Mar. 22, 2016, 62/322,178 filed Apr. 13, 2016, 62/357,352 filed Jun. 30, 2016, 62/370,700 filed Aug. 3, 2016, 62/398,490 filed Sep. 22, 2016, and 62/408,686 filed Oct. 14, 2016; the entire contents of each is incorporated by reference herein. It should be appreciated that the deaminase domains and UGI domains described in the foregoing references are within the scope of this disclosure and may be fused with any of the Cas9 proteins provided herein.

In some embodiments, the effector domain of the fusion protein is a nuclease domain. In some embodiments, the nuclease domain is a FokI DNA cleavage domain. In some embodiments, the fusion protein dimerizes. In certain embodiments, the dimer of the fusion protein is active. For example, two Fok1 DNA cleavage domains may dimerize to cleave a nucleic acid.

In some embodiments, the Cas9 protein is fused to a second Cas9 protein. In some embodiments, the second Cas9 protein is the Cas9 protein of any one of claims 1-345. In some embodiments, the second Cas9 protein is fused to the N-terminus of the fusion protein. In some embodiments, the second Cas9 protein is fused to the C-terminus of the fusion protein. In some embodiments, the Cas9 protein and the second Cas9 protein are fused via a second linker. In some embodiments, the second linker comprises a $(GGGGS)_n$ (SEQ ID NO: 5), a $(G)_n$ (SEQ ID NO: 5087), an $(EAAAK)_n$ (SEQ ID NO: 6), a $(GGS)_n$ (SEQ ID NO: 5088), an SGSETPGTSESATPES (SEQ ID NO: 7), or an $(XP)_n$ (SEQ ID NO: 5089) motif, or a combination of any of these, wherein n is independently an integer between 1 and 30. In some embodiments, the second linker comprises a $(GGS)_3$ (SEQ ID NO: 5088) motif.

Some aspects of this disclosure provide complexes comprising a Cas9 protein, or a Cas9 fusion protein as provided herein, and a guide RNA bound to the Cas9 protein, or the Cas9 fusion protein.

In some embodiments, the target sequence is a DNA sequence. In some embodiments, the target sequence is a sequence in the genome of a mammal. In some embodiments, the target sequence is a sequence in the genome of a human. In some embodiments, the 3'-end of the target sequence is not immediately adjacent to the canonical PAM sequence (5'-NGG-3').

Some aspects of this disclosure provide methods of using the Cas9 proteins, fusion proteins, or complexes provided herein. For example, some aspects of this disclosure provide methods comprising contacting a DNA molecule (a) with a Cas9 protein or a fusion protein as provided herein and a guide RNA, wherein the guide RNA is about 15-100 nucleotides long and comprises a sequence of at least 10 contiguous nucleotides that is complementary to a target sequence; or (b) with a Cas9 protein, a Cas9 fusion protein, or a Cas9 protein or fusion protein complex with a gRNA as provided herein. In some embodiments, the 3'-end of the target sequence is not immediately adjacent to the canonical PAM sequence (5'-NGG-3'). In some embodiments, the 3'-end of the target sequence is immediately adjacent to an AGC, GAG, TTT, GTG, or CAA sequence. In some embodiments, the target DNA sequence comprises a sequence associated with a disease or disorder. In some embodiments, the target DNA sequence comprises a point mutation associated with a disease or disorder. In some embodiments, the activity of the Cas9 protein, the Cas9 fusion protein, or the complex results in correction of the point mutation. In some embodiments, the step of contacting is performed in vivo in a subject.

Some aspects of this disclosure provide kits comprising a nucleic acid construct, comprising (a) a nucleotide sequence encoding a Cas9 protein or a Cas9 fusion protein as provided herein; and (b) a heterologous promoter that drives expression of the sequence of (a). In some embodiments, the kit further comprises an expression construct encoding a guide RNA backbone, wherein the construct comprises a cloning site positioned to allow the cloning of a nucleic acid sequence identical or complementary to a target sequence into the guide RNA backbone.

Some aspects of this disclosure provide polynucleotides encoding any of the Cas9 proteins, Cas9 fusion proteins, or guide RNA bound to the Cas9 protein or Cas9 fusion protein provided herein. Some aspects of this disclosure provide vectors comprising such polynucleotides. In some embodiments, the vector comprises a heterologous promoter driving expression of the polynucleotide.

Some aspects of this disclosure provide cells comprising any of the Cas9 proteins, fusion proteins, nucleic acid molecules, and/or a vectors as provided herein.

The summary above is meant to illustrate, in a non-limiting manner, some of the embodiments, advantages, features, and uses of the technology disclosed herein. Other embodiments, advantages, features, and uses of the technology disclosed herein will be apparent from the Detailed Description, the Drawings, the Examples, and the Claims.

BRIEF DESCRIPTION OF THE DRAWINGS

FIG. 4A is a graph representing Cas9 binding activity as a function of % cells above the background fluorescence. FIG. 4B is a graph showing Cas9 binding activity as a function of mean fluorescence. Cas9 proteins used in these experiments were dCas9 proteins fused to a VPR transcriptional activator.

FIG. 5A is a graph representing Cas9 binding activity as a function of % cells above background fluorescence. FIG. 5B is a graph showing Cas9 binding activity as a function of mean fluorescence. Cas9 proteins used in these experiments were dCas9 proteins fused to VPR.

FIG. 9A is a graph representing dCas9-VPR binding activity on the NNNNN PAM library as a function of the % cells above background fluorescence. FIG. 9B is a graph representing dCas9-VPR binding activity on the NNNNN PAM library as a function of mean fluorescence.

DEFINITIONS

Figure 1:
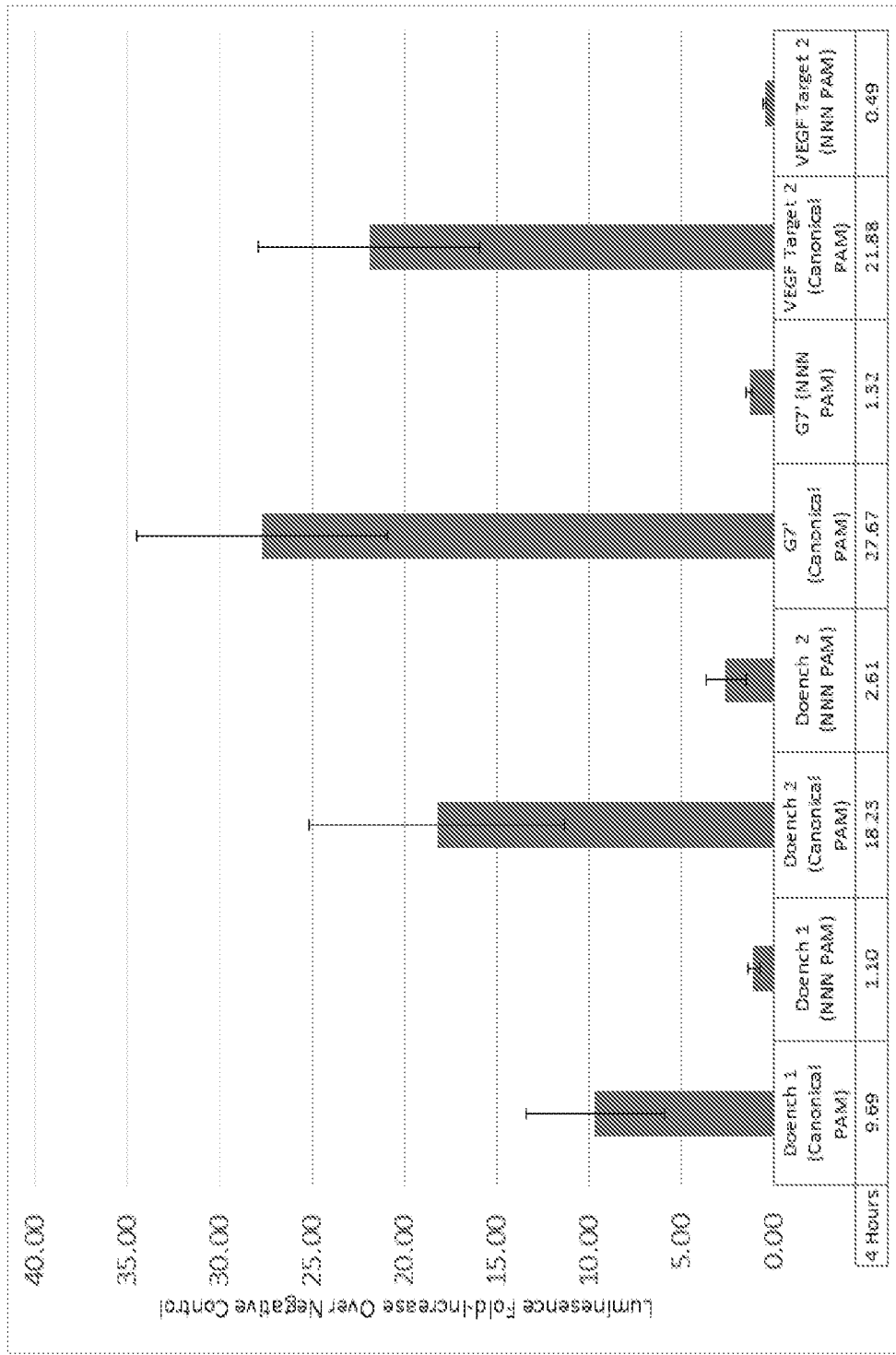
FIG. 1 shows the activity of wild-type *Streptococcus pyogenes* Cas9 on canonical PAM libraries and non-canonical PAM libraries.

As used herein and in the claims, the singular forms "a," "an," and "the" include the singular and the plural reference unless the context clearly indicates otherwise. Thus, for example, a reference to "an agent" includes a single agent and a plurality of such agents.

The term "Cas9" or "Cas9 nuclease" refers to an RNA-guided nuclease comprising a Cas9 protein, or a fragment thereof (e.g., a protein comprising an active or inactive DNA cleavage domain of Cas9, and/or the gRNA binding domain of Cas9). A Cas9 nuclease is also referred to sometimes as a casn1 nuclease or a CRISPR (clustered regularly interspaced short palindromic repeat)-associated nuclease. CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gNRA") can be engineered so as to incorporate aspects of both the crRNA and tracrRNA into a single RNA species. See, e.g., Jinek M., Chylinski K., Fonfara I., Hauer M., Doudna J. A., Charpentier E. Science 337:816-821 (2012), the entire contents of which are hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. Science 337:816-821(2012), the entire contents of each of which are incorporated herein by reference). Cas9 orthologs have been described in various species, including, but not limited to, S. pyogenes and S. thermophilus. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) *RNA Biology* 10:5, 726-737; the entire contents of which are incorporated herein by reference. In some embodiments, a Cas9 nuclease has an inactive (e.g., an inactivated) DNA cleavage domain.

A nuclease-inactivated Cas9 protein may interchangeably be referred to as a "dCas9" protein (for nuclease-"dead" Cas9). Methods for generating a Cas9 having an inactive DNA cleavage domain are known (See, e.g., Jinek et al., Science. 337:816-821(2012); Qi et al., "Repurposing CRISPR as an RNA-Guided Platform for Sequence-Specific Control of Gene Expression" (2013) *Cell.* 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of S. pyogenes Cas9 (Jinek et al., Science. 337:816-821(2012); Qi et al., Cell. 28; 152(5):1173-83 (2013).

In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9. For example a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% to wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% to the corresponding fragment of wild type Cas9. In some embodiments, wild type Cas9 corresponds to Cas9 from Streptococcus pyogenes (NCBI Reference Sequence: NC_017053.1, SEQ ID NO:1 (nucleotide); SEQ ID NO:2 (amino acid)).

(SEQ ID NO: 1)
ATGGATAAGAAATACTCAATAGGCTTAGATATCGGCACAAATAGCGTCG

GATGGGCGGTGATCACTGATGATTATAAGGTTCCGTCTAAAAAGTTCAA

GGTTCTGGGAAATACAGACCGCCACAGTATCAAAAAAAATCTTATAGGG

GCTCTTTTATTTGGCAGTGGAGAGACAGCGGAAGCGACTCGTCTCAAAC

GGACAGCTCGTAGAAGGTATACACGTCGGAAGAATCGTATTTGTTATCT

ACAGGAGATTTTTTCAAATGAGATGGCGAAAGTAGATGATAGTTTCTTT

CATCGACTTGAAGAGTCTTTTTTGGTGGAAGAAGACAAGAAGCATGAAC

GTCATCCTATTTTTGGAAATATAGTAGATGAAGTTGCTTATCATGAGAA

ATATCCAACTATCTATCATCTGCGAAAAAAATTGGCAGATTCTACTGAT

AAAGCGGATTTGCGCTTAATCTATTTGGCCTTAGCGCATATGATTAAGT

TTCGTGGTCATTTTTTGATTGAGGGAGATTTAAATCCTGATAATAGTGA

TGTGGACAAACTATTTATCCAGTTGGTACAAATCTACAATCAATTATTT

GAAGAAAACCCTATTAACGCAAGTAGAGTAGATGCTAAAGCGATTCTTT

CTGCACGATTGAGTAAATCAAGACGATTAGAAAATCTCATTGCTCAGCT

CCCCGGTGAGAAGAGAAATGGCTTGTTTGGGAATCTCATTGCTTTGTCA

TTGGGATTGACCCCTAATTTTAAATCAAATTTTGATTTGGCAGAAGATG

CTAAATTACAGCTTTCAAAAGATACTTACGATGATGATTTAGATAATTT

ATTGGCGCAAATTGGAGATCAATATGCTGATTTGTTTTTGGCAGCTAAG

AATTTATCAGATGCTATTTTACTTTCAGATATCCTAAGAGTAAATAGTG

AAATAACTAAGGCTCCCCTATCAGCTTCAATGATTAAGCGCTACGATGA

ACATCATCAAGACTTGACTCTTTTAAAAGCTTTAGTTCGACAACAACTT

CCAGAAAAGTATAAAGAAATCTTTTTTGATCAATCAAAAAACGGATATG

CAGGTTATATTGATGGGGGAGCTAGCCAAGAAGAATTTTATAAATTTAT

CAAACCAATTTTAGAAAAAATGGATGGTACTGAGGAATTATTGGTGAAA

CTAAATCGTGAAGATTTGCTGCGCAAGCAACGGACCTTTGACAACGGCT

CTATTCCCCATCAAATTCACTTGGGTGAGCTGCATGCTATTTTGAGAAG

ACAAGAAGACTTTTATCCATTTTTAAAAGACAATCGTGAGAAGATTGAA

AAAATCTTGACTTTTCGAATTCCTTATTATGTTGGTCCATTGGCGCGTG

GCAATAGTCGTTTTGCATGGATGACTCGGAAGTCTGAAGAAACAATTAC

CCCATGGAATTTTGAAGAAGTTGTCGATAAAGGTGCTTCAGCTCAATCA

TTTATTGAACGCATGACAAACTTTGATAAAAATCTTCCAAATGAAAAAG

TACTACCAAAACATAGTTTGCTTTATGAGTATTTTACGGTTTATAACGA

ATTGACAAAGGTCAAATATGTTACTGAGGGAATGCGAAAACCAGCATTT

CTTTCAGGTGAACAGAAGAAAGCCATTGTTGATTTACTCTTCAAAACAA

ATCGAAAAGTAACCGTTAAGCAATTAAAAGAAGATTATTTCAAAAAAAT

AGAATGTTTTGATAGTGTTGAAATTTCAGGAGTTGAAGATAGATTTAAT

GCTTCATTAGGCGCCTACCATGATTTGCTAAAATTATTAAAGATAAAG

ATTTTTTGGATAATGAAGAAAATGAAGATATCTTAGAGGATATTGTTTT

AACATTGACCTTATTTGAAGATAGGGGGATGATTGAGGAAAGACTTAAA

ACATATGCTCACCTCTTTGATGATAAGGTGATGAAACAGCTTAAACGTC

GCCGTTATACTGGTTGGGGACGTTTGTCTCGAAAATTGATTAATGGTAT

TAGGGATAAGCAATCTGGCAAAACAATATTAGATTTTTTGAAATCAGAT

GGTTTTGCCAATCGCAATTTTATGCAGCTGATCCATGATGATAGTTTGA

CATTTAAAGAAGATATTCAAAAAGCACAGGTGTCTGGACAAGGCCATAG

TTTACATGAACAGATTGCTAACTTAGCTGGCAGTCCTGCTATTAAAAAA

GGTATTTTACAGACTGTAAAAATTGTTGATGAACTGGTCAAAGTAATGG

GGCATAAGCCAGAAAATATCGTTATTGAAATGGCACGTGAAAATCAGAC

AACTCAAAAGGGCCAGAAAAATTCGCGAGAGCGTATGAAACGAATCGAA

GAAGGTATCAAAGAATTAGGAAGTCAGATTCTTAAAGAGCATCCTGTTG

AAAATACTCAATTGCAAAATGAAAAGCTCTATCTCTATTATCTACAAAA

TGGAAGAGACATGTATGTGGACCAAGAATTAGATATTAATCGTTTAAGT

GATTATGATGTCGATCACATTGTTCCACAAAGTTTCATTAAAGACGATT

CAATAGACAATAAGGTACTAACGCGTTCTGATAAAAATCGTGGTAAATC

GGATAACGTTCCAAGTGAAGAAGTAGTCAAAAAGATGAAAAACTATTGG

AGACAACTTCTAAACGCCAAGTTAATCACTCAACGTAAGTTTGATAATT

TAACGAAAGCTGAACGTGGAGGTTTGAGTGAACTTGATAAAGCTGGTTT

TATCAAACGCCAATTGGTTGAAACTCGCCAAATCACTAAGCATGTGGCA

CAAATTTTGGATAGTCGCATGAATACTAAATACGATGAAAATGATAAAC

TTATTCGAGAGGTTAAAGTGATTACCTTAAAATCTAAATTAGTTTCTGA

CTTCCGAAAAGATTTCCAATTCTATAAAGTACGTGAGATTAACAATTAC

CATCATGCCCATGATGCGTATCTAAATGCCGTCGTTGGAACTGCTTTGA

TTAAGAAATATCCAAAACTTGAATCGGAGTTTGTCTATGGTGATTATAA

AGTTTATGATGTTCGTAAAATGATTGCTAAGTCTGAGCAAGAAATAGGC

```
AAAGCAACCGCAAAATATTTCTTTTACTCTAATATCATGAACTTCTTCA

AAACAGAAATTACACTTGCAAATGGAGAGATTCGCAAACGCCCTCTAAT

CGAAACTAATGGGGAAACTGGAGAAATTGTCTGGGATAAAGGGCGAGAT

TTTGCCACAGTGCGCAAAGTATTGTCCATGCCCCAAGTCAATATTGTCA

AGAAAACAGAAGTACAGACAGGCGGATTCTCCAAGGAGTCAATTTTACC

AAAAAGAAATTCGGACAAGCTTATTGCTCGTAAAAAAGACTGGGATCCA

AAAAAATATGGTGGTTTTGATAGTCCAACGGTAGCTTATTCAGTCCTAG

TGGTTGCTAAGGTGGAAAAAGGGAAATCGAAGAAGTTAAAATCCGTTAA

AGAGTTACTAGGGATCACAATTATGGAAAGAAGTTCCTTTGAAAAAAAT

CCGATTGACTTTTTAGAAGCTAAAGGATATAAGGAAGTTAAAAAAGACT

TAATCATTAAACTACCTAAATATAGTCTTTTTGAGTTAGAAAACGGTCG

TAAACGGATGCTGGCTAGTGCCGGAGAATTACAAAAAGGAAATGAGCTG

GCTCTGCCAAGCAAATATGTGAATTTTTTATATTTAGCTAGTCATTATG

AAAAGTTGAAGGGTAGTCCAGAAGATAACGAACAAAAACAATTGTTTGT

GGAGCAGCATAAGCATTATTTAGATGAGATTATTGAGCAAATCAGTGAA

TTTTCTAAGCGTGTTATTTTAGCAGATGCCAATTTAGATAAAGTTCTTA

GTGCATATAACAAACATAGAGACAAACCAATACGTGAACAAGCAGAAAA

TATTATTCATTTATTTACGTTGACGAATCTTGGAGCTCCCGCTGCTTTT

AAATATTTTGATACAACAATTGATCGTAAACGATATACGTCTACAAAAG

AAGTTTTAGATGCCACTCTTATCCATCAATCCATCACTGGTCTTTATGA

AACACGCATTGATTTGAGTCAGCTAGGAGGTGACTGA (SEQ ID NO: 2)
MDKKYSIGLDIGTNSVGWAVITDDYKVPSKKFKVLGNTDRHSIKKNLIG
ALLFGSETAEATRLKRTARRRYTRRKNRICYLQEIFSNEMAKVDDSFF
HRLEESFLVEEDKKHERHPIFGNIVDEVAYHEKYPTIYHLRKKLADSTD
KADLRLIYLALAHMIKFRGHFLIEGDLNPDNSDVDKLFIQLVQIYNQLF
EENPINASRVDAKAILSARLSKSRRLENLIAQLPGEKRNGLFGNLIALS
LGLTPNFKSNFDLAEDAKLQLSKDTYDDDLDNLLAQIGDQYADLFLAAK
NLSDAILLSDILRVNSEITKAPLSASMIKRYDEHHQDLTLLKALVRQQL
PEKYKEIFFDQSKNGYAGYIDGGASQEEFYKFIKPILEKMDGTEELLVK
LNREDLLRKQRTFDNGSIPHQIHLGELHAILRRQEDFYPFLKDNREKIE
KILTFRIPYYVGPLARGNSRFAWMTRKSEETITPWNFEEVVDKGASAQS
FIERMTNFDKNLPNEKVLPKHSLLYEYFTVYNELTKVKYVTEGMRKPAF
LSGEQKKAIVDLLFKTNRKVTVKQLKEDYFKKIECFDSVEISGVEDRFN
ASLGAYHDLLKIIKDKDFLDNEENEDILEDIVLTLTLFEDRGMIEERLK
TYAHLFDDKVMKQLKRRRYTGWGRLSRKLINGIRDKQSGKTILDFLKSD
GFANRNFMQLIHDDSLTFKEDIQKAQVSGQGHSLHEQIANLAGSPAIKK
GILQTVKIVDELVKVMGHKPENIVIEMARENQTTQKGQKNSRERMKRIE
EGIKELGSQILKEHPVENTQLQNEKLYLYYLQNGRDMYVDQELDINRLS
DYDVDHIVPQSFIKDDSIDNKVLTRSDKNRGKSDNVPSEEVVKKMKNYW
RQLLNAKLITQRKFDNLTKAERGGLSELDKAGFIKRQLVETRQITKHVA
QILDSRMNTKYDENDKLIREVKVITLKSKLVSDERKDFQFYKVREINNY
HHAHDAYLNAVVGTALIKKYPKLESEFVYGDYKVYDVRKMIAKSEQEIG
KATAKYFFYSNIMNFEKTEITLANGEIRKRPLIETNGETGEIVWDKGRD
FATVRKVLSMPQVNIVKKTEVQTGGFSKESILPKRNSDKLIARKKDWDP
KKYGGFDSPTVAYSVLVVAKVEKGKSKKLKSVKELLGITIMERSSFEKN
PIDFLEAKGYKEVKKDLIIKLPKYSLFELENGRKRMLASAGELQKGNEL
ALPSKYVNFLYLASHYEKLKGSPEDNEQKQLFVEQHKHYLDEIIEQISE
FSKRVILADANLDKVLSAYNKHRDKPIREQAENIIHLFTLTNLGAPAAF
KYFDTTIDRKRYTSTKEVLDATLIHQSITGLYETRIDLSQLGGD (single underline: HNH domain; double underline:
RuvC domain)
```

In some embodiments, wild type Cas9 corresponds to, or comprises SEQ ID NO:3 (nucleotide) and/or SEQ ID NO: 4 (amino acid):

```
                                    (SEQ ID NO: 3)
ATGGATAAAAAGTATTCTATTGGTTTAGACATCGGCACTAATTCCGTTG

GATGGGCTGTCATAACCGATGAATACAAAGTACCTTCAAAGAAATTTAA

GGTGTTGGGGAACACAGACCGTCATTCGATTAAAAAGAATCTTATCGGT

GCCCTCCTATTCGATAGTGGCGAAACGGCAGAGGCGACTCGCCTGAAAC

GAACCGCTCGGAGAAGGTATACACGTCGCAAGAACCGAATATGTTACTT

ACAAGAAATTTTTAGCAATGAGATGGCCAAAGTTGACGATTCTTTCTTT

CACCGTTTGGAAGAGTCCTTCCTTGTCGAAGAGGACAAGAAACATGAAC

GGCACCCCATCTTTGGAAACATAGTAGATGAGGTGGCATATCATGAAAA

GTACCCAACGATTTATCACCTCAGAAAAAAGCTAGTTGACTCAACTGAT

AAAGCGGACCTGAGGTTAATCTACTTGGCTCTTGCCCATATGATAAAGT

TCCGTGGGCACTTTCTCATTGAGGGTGATCTAAATCCGGACAACTCGGA

TGTCGACAAACTGTTCATCCAGTTAGTACAAACCTATAATCAGTTGTTT

GAAGAGAACCCTATAAATGCAAGTGGCGTGGATGCGAAGGCTATTCTTA

GCGCCCGCCTCTCTAAATCCCGACGGCTAGAAAACCTGATCGCACAATT

ACCCGGAGAGAAGAAAATGGGTTGTTCGGTAACCTTATAGCGCTCTCA

CTAGGCCTGACACCAAATTTTAAGTCGAACTTCGACTTAGCTGAAGATG

CCAAATTGCAGCTTAGTAAGGACACGTACGATGACGATCTCGACAATCT

ACTGGCACAAATTGGAGATCAGTATGCGGACTTATTTTTGGCTGCCAAA

AACCTTAGCGATGCAATCCTCCTATCTGACATACTGAGAGTTAATACTG

AGATTACCAAGGCGCCGTTATCCGCTTCAATGATCAAAAGGTACGATGA

ACATCACCAAGACTTGACACTTCTCAAGGCCCTAGTCCGTCAGCAACTG

CCTGAGAAATATAAGGAAATATTCTTTGATCAGTCGAAAAACGGGTACG

CAGGTTATATTGACGGCGGAGCGAGTCAAGAGGAATTCTACAAGTTTAT

CAAACCCATATTAGAGAAGATGGATGGGACGGAAGAGTTGCTTGTAAAA

CTCAATCGCGAAGATCTACTGCGAAAGCAGCGGACTTTCGACAACGGTA

GCATTCCACATCAAATCCACTTAGGCGAATTGCATGCTATACTTAGAAG
```

```
GCAGGAGGATTTTTATCCGTTCCTCAAAGACAATCGTGAAAAGATTGAG

AAAATCCTAACCTTTCGCATACCTTACTATGTGGGACCCCTGGCCCGAG

GGAACTCTCGGTTCGCATGGATGACAAGAAAGTCCGAAGAAACGATTAC

TCCATGGAATTTTGAGGAAGTTGTCGATAAAGGTGCGTCAGCTCAATCG

TTCATCGAGAGGATGACCAACTTTGACAAGAATTTACCGAACGAAAAAG

TATTGCCTAAGCACAGTTTACTTTACGAGTATTTCACAGTGTACAATGA

ACTCACGAAAGTTAAGTATGTCACTGAGGGCATGCGTAAACCCGCCTTT

CTAAGCGGAGAACAGAAGAAAGCAATAGTAGATCTGTTATTCAAGACCA

ACCGCAAAGTGACAGTTAAGCAATTGAAAGAGGACTACTTTAAGAAAAT

TGAATGCTTCGATTCTGTCGAGATCTCCGGGGTAGAAGATCGATTTAAT

GCGTCACTTGGTACGTATCATGACCTCCTAAAGATAATTAAAGATAAGG

ACTTCCTGGATAACGAAGAGAATGAAGATATCTTAGAAGATATAGTGTT

GACTCTTACCCTCTTTGAAGATCGGGAAATGATTGAGGAAAGACTAAAA

ACATACGCTCACCTGTTCGACGATAAGGTTATGAAACAGTTAAGAGGC

GTCGCTATACGGGCTGGGGACGATTGTCGCGGAAACTTATCAACGGGAT

AAGAGACAAGCAAAGTGGTAAAACTATTCTCGATTTTCTAAAGAGCGAC

GGCTTCGCCAATAGGAACTTTATGCAGCTGATCCATGATGACTCTTTAA

CCTTCAAAGAGGATATACAAAAGGCACAGGTTTCCGGACAAGGGGACTC

ATTGCACGAACATATTGCGAATCTTGCTGGTTCGCCAGCCATCAAAAAG

GGCATACTCCAGACAGTCAAAGTAGTGGATGAGCTAGTTAAGGTCATGG

GACGTCACAAACCGGAAAACATTGTAATCGAGATGGCACGCGAAAATCA

AACGACTCAGAAGGGGCAAAAAAACAGTCGAGAGCGGATGAAGAGAATA

GAAGAGGGTATTAAAGAACTGGGCAGCCAGATCTTAAAGGAGCATCCTG

TGGAAAATACCCAATTGCAGAACGAGAAACTTTACCTCTATTACCTACA

AAATGGAAGGGACATGTATGTTGATCAGGAACTGGACATAAACCGTTTA

TCTGATTACGACGTCGATCACATTGTACCCCAATCCTTTTTGAAGGACG

ATTCAATCGACAATAAAGTGCTTACACGCTCGGATAAGAACCGAGGGAA

AAGTGACAATGTTCCAAGCGAGGAAGTCGTAAAGAAAATGAAGAACTAT

TGGCGGCAGCTCCTAAATGCGAAACTGATAACGCAAAGAAAGTTCGATA

ACTTAACTAAAGCTGAGAGGGGTGGCTTGTCTGAACTTGACAAGGCCGG

ATTTATTAAACGTCAGCTCGTGGAAACCCGCCAAATCACAAAGCATGTT

GCACAGATACTAGATTCCCGAATGAATACGAAATACGACGAGAACGATA

AGCTGATTCGGGAAGTCAAAGTAATCACTTTAAAGTCAAAATTGGTGTC

GGACTTCAGAAAGGATTTTCAATTCTATAAAGTTAGGGAGATAAATAAC

TACCACCATGCGCACGACGCTTATCTTAATGCCGTCGTAGGGACCGCAC

TCATTAAGAAATACCCGAAGCTAGAAAGTGAGTTTGTGTATGGTGATTA

CAAAGTTTATGACGTCCGTAAGATGATCGCGAAAAGCGAACAGGAGATA

GGCAAGGCTACAGCCAAATACTTCTTTTATTCTAACATTATGAATTTCT

TTAAGACGGAAATCACTCTGGCAAACGGAGAGATACGCAAACGACCTTT

AATTGAAACCAATGGGGAGACAGGTGAATCGTATGGATAAGGGCCGG

GACTTCGCGACGGTGAGAAAAGTTTTGTCCATGCCCCAAGTCAACATAG

TAAAGAAAACTGAGGTGCAGACCGGAGGGTTTTCAAAGGAATCGATTCT

TCCAAAAAGGAATAGTGATAAGCTCATCGCTCGTAAAAAGGACTGGGAC

CCGAAAAAGTACGGTGGCTTCGATAGCCCTACAGTTGCCTATTCTGTCC

TAGTAGTGGCAAAAGTTGAGAAGGGAAAATCCAAGAAACTGAAGTCAGT

CAAAGAATTATTGGGGATAACGATTATGGAGCGCTCGTCTTTTGAAAAG

AACCCCATCGACTTCCTTGAGGCGAAAGGTTACAAGGAAGTAAAAAAGG

ATCTCATAATTAAACTACCAAAGTATAGTCTGTTTGAGTTAGAAAATGG

CCGAAAACGGATGTTGGCTAGCGCCGAGAGCTTCAAAAGGGGAACGAA

CTCGCACTACCGTCTAAATACGTGAATTTCCTGTATTTAGCGTCCCATT

ACGAGAAGTTGAAAGGTTCACCTGAAGATAACGAACAGAAGCAACTTTT

TGTTGAGCAGCACAAACATTATCTCGACGAAATCATAGAGCAAATTTCG

GAATTCAGTAAGAGAGTCATCCTAGCTGATGCCAATCTGGACAAAGTAT

TAAGCGCATACAACAAGCACAGGGATAAACCCATACGTGAGCAGGCGGA

AAATATTATCCATTTGTTTACTCTTACCAACCTCGGCGCTCCAGCCGCA

TTCAAGTATTTTGACACAACGATAGATCGCAAACGATACACTTCTACCA

AGGAGGTGCTAGACGCGACACTGATTCACCAATCCATCACGGGATTATA

TGAAACTCGGATAGATTTGTCACAGCTTGGGGGTGACGGATCCCCCAAG

AAGAAGAGGAAAGTCTCGAGCGACTACAAAGACCATGACGGTGATTATA

AAGATCATGACATCGATTACAAGGATGACGATGACAAGGCTGCAGGA (SEQ ID NO: 4)
MDKKYSIGLAIGTNSVGWAVITDEYKVPSKKFKVLGNTDRHSIKKNLIG

ALLFDSGETAEATRLKRTARRRYTRRKNRICYLQEIFSNEMAKVDDSFF

HRLEESFLVEEDKKHERHPIFGNIVDEVAYHEKYPTIYHLRKKLVDSTD

KADLRLIYLALAHMIKFRGHFLIEGDLNPDNSDVDKLFIQLVQTYNQLF

EENPINASGVDAKAILSARLSKSRRLENLIAQLPGEKKNGLFGNLIALS

LGLTPNFKSNFDLAEDAKLQLSKDTYDDDLDNLLAQIGDQYADLFLAAK

NLSDAILLSDILRVNTEITKAPLSASMIKRYDEHHQDLTLLKALVRQQL

PEKYKEIFFDQSKNGYAGYIDGGASQEEFYKFIKPILEKMDGTEELLVK

LNREDLLRKQRTFDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFN

ASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSD

GFANRNFMQLIHDDSLTFKEDIQKAQVSGQGDSLHEHIANLAGSPAIKK

GILQTVKVVDELVKVMGRHKPENIVIEMARENQTTQKGQKNSRERMKRI

EEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNY

WRQLLNAKLITQRKFDNLTKAERGGLSELDKAGFIKRQLVETRQITKHV

AQILDSRMNTKYDENDKLIREVKVITLKSKLVSDFRKDFQFYKVREINN

YHHAHDAYLNAVVGTALIKKYPKLESEFVYGDYKVYDVRKMIAKSEQEI
```

GKATAKYFFYSNIMNFFKTEITLANGEIRKRPLIETNGETGEIVWDKGR

DFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEK

NPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAA

FKYFDTTIDRKRYTSTKEVLDATLIHQSITGLYETRIDLSQLGGD (single underline: HNH domain; double underline: RuvC domain)

In some embodiments, wild type Cas9 corresponds to Cas9 from *Streptococcus pyogenes* (NCBI Reference Sequence: NC_002737.2, SEQ ID NO: 282 (nucleotide); and Uniport Reference Sequence: Q99ZW2, SEQ ID NO: 9 (amino acid).

(SEQ ID NO: 282)
ATGGATAAGAAATACTCAATAGGCTTAGATATCGGCACAAATAGCGTCG

GATGGGCGGTGATCACTGATGAATATAAGGTTCCGTCTAAAAAGTTCAA

GGTTCTGGGAAATACAGACCGCCACAGTATCAAAAAAATCTTATAGGG

GCTCTTTTATTTGACAGTGGAGAGACAGCGGAAGCGACTCGTCTCAAAC

GGACAGCTCGTAGAAGGTATACACGTCGGAAGAATCGTATTTGTTATCT

ACAGGAGATTTTTTCAAATGAGATGGCGAAAGTAGATGATAGTTTCTTT

CATCGACTTGAAGAGTCTTTTTTGGTGGAAGAAGACAAGAAGCATGAAC

GTCATCCTATTTTTGGAAATATAGTAGATGAAGTTGCTTATCATGAGAA

ATATCCAACTATCTATCATCTGCGAAAAAAATTGGTAGATTCTACTGAT

AAAGCGGATTTGCGCTTAATCTATTTGGCCTTAGCGCATATGATTAAGT

TTCGTGGTCATTTTTTGATTGAGGGAGATTTAAATCCTGATAATAGTGA

TGTGGACAAACTATTTATCCAGTTGGTACAAACCTACAATCAATTATTT

GAAGAAAACCCTATTAACGCAAGTGGAGTAGATGCTAAAGCGATTCTTT

CTGCACGATTGAGTAAATCAAGACGATTAGAAAATCTCATTGCTCAGCT

CCCCGGTGAGAAGAAAAATGGCTTATTTGGGAATCTCATTGCTTTGTCA

TTGGGTTTGACCCCTAATTTTAAATCAAATTTTGATTTGGCAGAAGATG

CTAAATTACAGCTTTCAAAAGATACTTACGATGATGATTTAGATAATTT

ATTGGCGCAAATTGGAGATCAATATGCTGATTTGTTTTTGGCAGCTAAG

AATTTATCAGATGCTATTTTACTTTCAGATATCCTAAGAGTAAATACTG

AAATAACTAAGGCTCCCCTATCAGCTTCAATGATTAAACGCTACGATGA

ACATCATCAAGACTTGACTCTTTTAAAAGCTTTAGTTCGACAACAACTT

CCAGAAAAGTATAAAGAAATCTTTTTTGATCAATCAAAAAACGGATATG

CAGGTTATATTGATGGGGGAGCTAGCCAAGAAGAATTTTATAAATTTAT

CAAACCAATTTTAGAAAAAATGGATGGTACTGAGGAATTATTGGTGAAA

CTAAATCGTGAAGATTTGCTGCGCAAGCAACGGACCTTTGACAACGGCT

CTATTCCCCATCAAATTCACTTGGGTGAGCTGCATGCTATTTTGAGAAG

ACAAGAAGACTTTTATCCATTTTTAAAAGACAATCGTGAGAAGATTGAA

AAAATCTTGACTTTTCGAATTCCTTATTATGTTGGTCCATTGGCGCGTG

GCAATAGTCGTTTTGCATGGATGACTCGGAAGTCTGAAGAAACAATTAC

CCCATGGAATTTTGAAGAAGTTGTCGATAAAGGTGCTTCAGCTCAATCA

TTTATTGAACGCATGACAAACTTTGATAAAAATCTTCCAAATGAAAAAG

TACTACCAAAACATAGTTTGCTTTATGAGTATTTTACGGTTTATAACGA

ATTGACAAAGGTCAAATATGTTACTGAAGGAATGCGAAAACCAGCATTT

CTTTCAGGTGAACAGAAGAAAGCCATTGTTGATTTACTCTTCAAAACAA

ATCGAAAAGTAACCGTTAAGCAATTAAAAGAAGATTATTTCAAAAAAAT

AGAATGTTTTGATAGTGTTGAAATTTCAGGAGTTGAAGATAGATTTAAT

GCTTCATTAGGTACCTACCATGATTTGCTAAAAATTATTAAAGATAAAG

ATTTTTTGGATAATGAAGAAAATGAAGATATCTTAGAGGATATTGTTTT

AACATTGACCTTATTTGAAGATAGGGAGATGATTGAGGAAGACTTAAA

ACATATGCTCACCTCTTTGATGATAAGGTGATGAAACAGCTTAAACGTC

GCCGTTATACTGGTTGGGGACGTTTGTCTCGAAAATTGATTAATGGTAT

TAGGGATAAGCAATCTGGCAAAACAATATTAGATTTTTTGAAATCAGAT

GGTTTTGCCAATCGCAATTTTATGCAGCTGATCCATGATGATAGTTTGA

CATTTAAAGAAGACATTCAAAAAGCACAAGTGTCTGGACAAGGCGATAG

TTTACATGAACATATTGCAAATTTAGCTGGTAGCCCTGCTATTAAAAAA

GGTATTTTACAGACTGTAAAAGTTGTTGATGAATTGGTCAAAGTAATGG

GGCGGCATAAGCCAGAAAATATCGTTATTGAAATGGCACGTGAAAATCA

GACAACTCAAAAGGGCCAGAAAAATTCGCGAGAGCGTATGAAACGAATC

GAAGAAGGTATCAAAGAATTAGGAAGTCAGATTCTTAAAGAGCATCCTG

TTGAAAATACTCAATTGCAAAATGAAAAGCTCTATCTCTATTATCTCCA

AAATGGAAGAGACATGTATGTGGACCAAGAATTAGATATTAATCGTTTA

AGTGATTATGATGTCGATCACATTGTTCCACAAAGTTTCCTTAAAGACG

ATTCAATAGACAATAAGGTCTTAACGCGTTCTGATAAAAATCGTGGTAA

ATCGGATAACGTTCCAAGTGAAGAAGTAGTCAAAAAGATGAAAAACTAT

TGGAGACAACTTCTAAACGCCAAGTTAATCACTCAACGTAAGTTTGATA

ATTTAACGAAAGCTGAACGTGGAGGTTTGAGTGAACTTGATAAAGCTGG

TTTTATCAAACGCCAATTGGTTGAAACTCGCCAAATCACTAAGCATGTG

GCACAAATTTTGGATAGTCGCATGAATACTAAATACGATGAAAATGATA

AACTTATTCGAGAGGTTAAAGTGATTACCTTAAAATCTAAATTAGTTTC

TGACTTCCGAAAAGATTTCCAATTCTATAAAGTACGTGAGATTAACAAT

TACCATCATGCCCATGATGCGTATCTAAATGCCGTCGTTGGAACTGCTT

TGATTAAGAAATATCCAAAACTTGAATCGGAGTTTGTCTATGGTGATTA

TAAAGTTTATGATGTTCGTAAAATGATTGCTAAGTCTGAGCAAGAAATA

GGCAAAGCAACCGCAAAATATTTCTTTTACTCTAATATCATGAACTTCT

TCAAAACAGAAATTACACTTGCAAATGGAGAGATTCGCAAACGCCCTCT

AATCGAAACTAATGGGGAAACTGGAGAAATTGTCTGGGATAAAGGGCGA

GATTTTGCCACAGTGCGCAAAGTATTGTCCATGCCCCAAGTCAATATTG

```
TCAAGAAAACAGAAGTACAGACAGGCGGATTCTCCAAGGAGTCAATTTT
ACCAAAAAGAAATTCGGACAAGCTTATTGCTCGTAAAAAAGACTGGGAT
CCAAAAAAATATGGTGGTTTTGATAGTCCAACGGTAGCTTATTCAGTCC
TAGTGGTTGCTAAGGTGGAAAAAGGGAAATCGAAGAAGTTAAAATCCGT
TAAAGAGTTACTAGGGATCACAATTATGGAAAGAAGTTCCTTTGAAAAA
AATCCGATTGACTTTTTAGAAGCTAAAGGATATAAGGAAGTTAAAAAAG
ACTTAATCATTAAACTACCTAAATATAGTCTTTTTGAGTTAGAAAACGG
TCGTAAACGGATGCTGGCTAGTGCCGGAGAATTACAAAAAGGAAATGAG
CTGGCTCTGCCAAGCAAATATGTGAATTTTTTATATTTAGCTAGTCATT
ATGAAAAGTTGAAGGGTAGTCCAGAAGATAACGAACAAAAACAATTGTT
TGTGGAGCAGCATAAGCATTATTTAGATGAGATTATTGAGCAAATCAGT
GAATTTTCTAAGCGTGTTATTTTAGCAGATGCCAATTTAGATAAAGTTC
TTAGTGCATATAACAAACATAGAGACAAACCAATACGTGAACAAGCAGA
AAATATTATTCATTTATTTACGTTGACGAATCTTGGAGCTCCCGCTGCT
TTTAAATATTTTGATACAACAATTGATCGTAAACGATATACGTCTACAA
AAGAAGTTTTAGATGCCACTCTTATCCATCAATCCATCACTGGTCTTTA
TGAAACACGCATTGATTTGAGTCAGCTAGGAGGTGACTGA
```

(SEQ ID NO: 9)
MDKKYSIGLDIGTNSVGWAVITDEYKVPSKKFKVLGNTDRHSIKKNLIG
ALLFDSGETAEATRLKRTARRRYTRRKNRICYLQEIFSNEMAKVDDSFF
HRLEESFLVEEDKKHERHPIFGNIVDEVAYHEKYPTIYHLRKKLVDSTD
KADLRLIYLALAHMIKFRGHFLIEGDLNPDNSDVDKLFIQLVQTYNQLF
EENPINASGVDAKAILSARLSKSRRLENLIAQLPGEKKNGLFGNLIALS
LGLTPNFKSNFDLAEDAKLQLSKDTYDDDLDNLLAQIGDQYADLFLAAK
NLSDAILLSDILRVNTEITKAPLSASMIKRYDEHHQDLTLLKALVRQQL
PEKYKEIFFDQSKNGYAGYIDGGASQEEFYKFIKPILEKMDGTEELLVK
LNREDLLRKQRTFDNGSIPHQIHLGELHAILRRQEDFYPFLKDNREKIE
KILTFRIPYYVGPLARGNSRFAWMTRKSEETITPWNFEEVVDKGASAQS
FIERMTNFDKNLPNEKVLPKHSLLYEYFTVYNELTKVKYVTEGMRKPAF
LSGEQKKAIVDLLFKTNRKVTVKQLKEDYFKKIECFDSVEISGVEDRFN

ASLGTYHDLLKIIKDKDFLDNEENEDILEDIVLTLTLFEDREMIEERLK
TYAHLFDDKVMKQLKRRRYTGWGRLSRKLINGIRDKQSGKTILDFLKSD
GFANRNFMQLIHDDSLTFKEDIQKAQVSGQG<u>DSLHEHIANLAGSPAIKK</u>
<u>GILQTVKVVDELVKVMGRHKPENIVIEMA</u>RENQTTQKGQKNSRERMKRI
EEGIKELGSQILKEHPVENTQLQNEKLYLYYLQNGRDMYVDQELDINRL
SDYDVDHIVPQSFLKDDSIDNKVLTRSDKNRGKSDNVPSEEVVKKMKNY
WRQLLNAKLITQRKFDNLTKAERG<u>GLSELDKAGFIKRQLVETRQITKHV</u>
<u>AQILDSRMNTKYDENDKLIREVKVITLKSKLVSDERKDFQFYKVREINN</u>
<u>YHHAHDAYLNAVVGTALIKKYPKLESEFVYGDYKVYDVRKMIAKSEQEI</u>
<u>GKATAKYFFYSNIMNFFKTEITLANGEIRKRPLIEINGETGEIVWDKGR</u>
<u>DFATVRKVLSMPQVNIVKKTEVQT</u>GGFSKESILPKRNSDKLIARKKDWD
PKKYGGFDSPTVAYSVLVVAKVEKGKSKKLKSVKELLGITIMERSSFEK
NPIDFLEAKGYKEVKKDLIIKLPKYSLFELENGRKRMLASAGELQKGNE
LALPSKYVNFLYLASHYEKLKGSPEDNEQKQLFVEQHKHYLDEIIEQIS
EFSKRVILADANLDKVLSAYNKHRDKPIREQAENIIHLFTLTNLGAPAA
FKYFDTTIDRKRYTSTKEVLDATLIHQSITGLYETRIDLSQLGGD (single underline: HNH domain; double underline: RuvC domain)

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisl* (NCBI Ref: NC_018721.1); *Streptococcus thermophilus* (NCBI Ref: YP_820832.1); *Listeria innocua* (NCBI Ref: NP_472073.1); *Campylobacter jejuni* (NCBI Ref: YP_002344900.1); or *Neisseria. meningitidis* (NCBI Ref: YP_002342100.1) or to a Cas9 from any of the organisms listed in Example 3.

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and/or H840A mutation.

dCas9 (D10A and H840A):

(SEQ ID NO: 8)
MDKK**YSIGLA\*IGTNSVGWAVITDEYKVPSKKFKVLGNTDRHSIKKNLIGALLFDSGET**AEATRLKRTARRRYTR
RKNRICYLQEIFSNEMAKVDDSFFHRLEESFLVEEDKKHERHPIFGNI*VDEVAYHEKYPTIYH*LRKKLVDSTD
KADLRLIYLALAHMIKFRGHFLIEGDLNPDNSDVD*KLFIQLVQTYNQLFEENPINASGVDAKAILSARLSKSRR
LENLIAQLPGEKKNGLFGNLIALSLGLTPNFKSNFDLAEDA*KLQLSKDTYDDDLDNLLAQIGDQYADLFLAAK*
NLSDAILLSDILRVNTEITKAPLSASMIKRYDEHHQDLTLLKALVRQQLPEKYKEIFFDQSKNGYAGYIDGGASQ
EEFYKFIKPILEKMDGTEELLVKLNREDLLRKQRTFDNGS*IPHQIHLGELHAILRRQEDFYPFLKDNREKIEKI
LTFRIPYYVGPLARGNSRFAWMTRKSEETITPWNFEE*VVDKGASAQSFIERMTNFDKNLPNEKVLPKHSLLYEY
FTVYNELTKVKYVTEGMRKPAFLSGE*QKKAIVDLLFKTNRKVTVKQLKEDYFKKIECFDSVEISGVEDRFNASL

```
                                         -continued
GTYHDLLKIIKDKDFLDNEENEDILEDIVLTLTLFEDREMIEERLKTYAHLFDDKVMKQLKRRRYTGWG*RLSRK

LINGIRDKQSGKTILDFLKSDGFANRNFMQLIHDDSLTFKEDIQKAQVSGQGDSLHEHIANLAGSPAIKKGILQT

VKVVDELVKVMGRHKPENIVIEMARENQTTQKGQKNSRERMKRIEEGIKELGSQILKEHPVENTQLQNEKLYLYY

LQNGRDMYVDQELDINRLSDYDVDAIVPQSFLKDDSIDNKVLTRSDKNRGKSDNVPSEEVVKKMKNYWRQLLNAK

LITQRKFDNLTKAERGGLSELDKAGFIKRQLVETRQITKHVAQILDSRMNTKYDENDKLIREVKVITLKSKLVSD

FRKDFQFYKVREINNYHHAHDAYLNAVVGTALIKKYPKLESEFVYGDYKVYDVRKMIAKSEQEIGKATAYFFYS

NIMNFFKTEITLANGEIRKRPLIETNGETGEIVWDKGRDFATVRKVLSMPQVNIVKKTEVQTGGFSKESILPKRN

SDKLIARKKDWDPKKYGGFDSPTVAYSVLVVAKVEKGKSKKLKSVKELLGITIMERSSFEKNPIDFLEAKGYKEV

KKDLIIKLPKYSLFELENGRKRMLASAGELQKGNELALPSKYVNFLYLASHYEKLKGSPEDNEQKQLFVEQHKHY

LDEIIEQISEFSKRVILADANLDKVLSAYNKHRDKPIREQAENIIHLFTLINLGAPAAFKYFDTTIDRKRYTSTK

EVLDATLIHQSITGLYETRIDLSQLGGD
(single underline: HNH domain; double underline: RuvC domain)
```

In some embodiments, Cas9 corresponds to, or comprises in part or in whole, a Cas9 amino acid sequence having one or more mutations that alter Cas9's nuclease activity. In some embodiments, Cas9 may be a Cas9 nickase, which is a version of Cas9 that generates a single-stranded DNA break at a specific location based on a co-expressed gRNA-defined target sequence, rather than a double-strand DNA break. For example, in some embodiments, a Cas9 domain comprises D10A mutation (e.g., SEQ ID NO: 301) and/or an H840A mutation (e.g., SEQ ID NO: 302). Exemplary Cas9 nickases are shown below. However, it should be appreciated that additional Cas9 nickases that generate a single-stranded DNA break of a DNA duplex would be apparent to the skilled artisan and are within the scope of this disclosure.

```
Cas9 D10A nickase:
                                    (SEQ ID NO: 301)
MDKKYSIGLAIGINSVGWAVITDEYKVPSKKEKVLGNTDRHSIKKNLIG

ALLFDSGETAEATRLKRTARRRYTRRKNRICYLQEIFSNEMAKVDDSFF

HRLEESFLVEEDKKHERHPIFGNIVDEVAYHEKYPTIYHLRKKLVDSTD

KADLRLIYLALAHMIKFRGHFLIEGDLNPDNSDVDKLFIQLVQTYNQLF

EENPINASGVDAKAILSARLSKSRRLENLIAQLPGEKKNGLFGNLIALS

LGLTPNFKSNFDLAEDAKLQLSKDTYDDDLDNLLAQIGDQYADLFLAAK

NLSDAILLSDILRVNTEITKAPLSASMIKRYDEHHQDLTLLKALVRQQL

PEKYKEIFFDQSKNGYAGYIDGGASQEEFYKFIKPILEKMDGTEELLVK

LNREDLLRKQRTFDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFN

ASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSD

GFANRNFMQLIHDDSLTFKEDIQKAQVSGQGDSLHEHIANLAGSPAIKK

GILQTVKVVDELVKVMGRHKPENIVIEMARENQTTQKGQKNSRERMKRI
```

```
                                    -continued
EEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNY

WRQLLNAKLITQRKFDNLTKAERGGLSELDKAGFIKRQLVETRQITKHV

AQILDSRMNTKYDENDKLIREVKVITLKSKLVSDFRKDFQFYKVREINN

YHHAHDAYLNAVVGTALIKKYPKLESEFVYGDYKVYDVRKMIAKSEQEI

GKATAKYFFYSNIMNFFKTEITLANGEIRKRPLIETNGETGEIVWDKGR

DFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEK

NPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAA

FKYFDTTIDRKRYTSTKEVLDATLIHQSITGLYETRIDLSQLGGD (single underline: HNH domain; double underline:
RuvC domain)

Cas9 H840Anickase:
                                    (SEQ ID NO: 302)
MDKKYSIGLDIGINSVGWAVITDEYKVPSKKEKVLGNTDRHSIKKNLIG

ALLFDSGETAEATRLKRTARRRYTRRKNRICYLQEIFSNEMAKVDDSFF

HRLEESFLVEEDKKHERHPIFGNIVDEVAYHEKYPTIYHLRKKLVDSTD

KADLRLIYLALAHMIKFRGHFLIEGDLNPDNSDVDKLFIQLVQTYNQLF

EENPINASGVDAKAILSARLSKSRRLENLIAQLPGEKKNGLFGNLIALS

LGLTPNFKSNEDLAEDAKLQLSKDTYDDDLDNLLAQIGDQYADLFLAAK

NLSDAILLSDILRVNTEITKAPLSASMIKRYDEHHQDLTLLKALVRQQL

PEKYKEIFFDQSKNGYAGYIDGGASQEEFYKFIKPILEKMDGTEELLVK

LNREDLLRKQRTFDNGSIPHQIHLGELHAILRRQEDFYPPLKDNREKIE

KILTFRIPYYVGPLARGNSRFAWMTRKSEETITPWNFEEVVDKGASAQS

FIERMTNEDKNLPNEKVLPKHSLLYEYFTVYNELTKVKYVTEGMRKPAE
```

-continued

LSGEQKKAIVDLLFKTNRKVTVKQLKEDYFKKIECFDSVEISGVEDRFN

ASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSD

GFANRNFMQLIHDDSLTFKEDIQKAQVSGQG<u>DSLHEHIANLAGSPAIKK</u>

<u>GILQTVKVVDELVKVMGRHKPENIVIEMAR</u>ENQTTQKGQKNSRERMKRI

EEGIKELGSQILKEHPVENTQLQNEKLYLYYLQNGRDMYVDQELDINRL

SDYDVDAIVPQSFLKDDSIDNKVLTRSDKNRGKSDNVPSEEVVKKMKNY

WRQLLNAKLITQRKFDNLTKAERG<u>GLSELDKAGFIKRQLVETRQITKHV</u>

<u>AQILDSRMNTKYDENDKLIREVKVITLKSKLVSDERKDFQFYKVREINN</u>

<u>YHHAHDAYLNAVVGTALIKKYPKLESEFVYGDYKVYDVRKMIAKSEQEI</u>

<u>GKATAKYFFYSNIMNFFKTEITLANGEIRKRPLIEINGETGEIVWDKGR</u>

<u>DFATVRKVLSMPQVNIVKKTEVQTGGFSKESILPKRNSDKLIARKKDWD</u>

PKKYGGFDSPTVAYSVLVVAKVEKGKSKKLKSVKELLGITIMERSSFEK

NPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAA

FKYFDTTIDRKRYTSTKEVLDATLIHQSITGLYETRIDLSQLGGD (single underline: HNH domain; double underline: RuvC domain)

In other embodiments, dCas9 variants having mutations other than D10A and H840A are provided, which, e.g., result in nuclease-inactivated Cas9 (dCas9). Such mutations, by way of example, include other amino acid substitutions at D10 and H820, or other substitutions within the nuclease domains of Cas9 (e.g., substitutions in the HNH nuclease subdomain and/or the RuvC1 subdomain). In some embodiments, variants or homologues of dCas9 (e.g., variants of SEQ ID NO: 9) are provided which are at least about 70% identical, at least about 80% identical, at least about 90% identical, at least about 95% identical, at least about 98% identical, at least about 99% identical, at least about 99.5% identical, or at least about 99.9% identical to SEQ ID NO: 9. In some embodiments, variants of dCas9 (e.g., variants of SEQ ID NO: 9) are provided having amino acid sequences which are shorter, or longer than SEQ ID NO: 9, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids, or more.

In some embodiments, Cas9 fusion proteins as provided herein comprise the full-length amino acid sequence of a Cas9 protein, e.g., one of the sequences provided above. In other embodiments, however, fusion proteins as provided herein do not comprise a full-length Cas9 sequence, but only a fragment thereof. For example, in some embodiments, a Cas9 fusion protein provided herein comprises a Cas9 fragment, wherein the fragment binds crRNA and tracrRNA or a sgRNA, but does not comprise a functional nuclease domain, e.g., it comprises only a truncated version of a nuclease domain or no nuclease domain at all. Exemplary amino acid sequences of suitable Cas9 domains and Cas9 fragments are provided herein, and additional suitable sequences of Cas9 domains and Cas9 fragments will be apparent to those of skill in the art. In some embodiments, a Cas9 fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9 protein. In some embodiments, a Cas9 fragment comprises at least at least 100 amino acids in length. In some embodiments, the Cas9 fragment is at least 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550, or at least 1600 amino acids of a corresponding wild type Cas9 protein. In some embodiments, the Cas9 fragment comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues of a corresponding wild type Cas9 protein.

Cas9. In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisl* (NCBI Ref: NC_018721.1); *Streptococcus thermophilus* (NCBI Ref: YP_820832.1); *Listeria innocua* (NCBI Ref: NP_472073.1); *Campylobacter jejuni* (NCBI Ref: YP_002344900.1); or *Neisseria. meningitidis* (NCBI Ref: YP_002342100.1).

The term "deaminase" or "deaminase domain," as used herein, refers to a protein or enzyme that catalyzes a deamination reaction. In some embodiments, the deaminase or deaminase domain is a cytidine deaminase, catalyzing the hydrolytic deamination of cytidine or deoxycytidine to uridine or deoxyuridine, respectively. In some embodiments, the deaminase or deaminase domain is a cytosine deaminase, catalyzing the hydrolytic deamination of cytosine to uracil. In some embodiments, the deaminase or deaminase domain is a naturally-occurring deaminase from an organism, such as a human, chimpanzee, gorilla, monkey, cow, dog, rat, or mouse. In some embodiments, the deaminase or deaminase domain is a variant of a naturally-occurring deaminase from an organism, that does not occur in nature. For example, in some embodiments, the deaminase or deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase from an organism.

The term "effective amount," as used herein, refers to an amount of a biologically active agent that is sufficient to elicit a desired biological response. For example, in some embodiments, an effective amount of a nuclease may refer to the amount of the nuclease that is sufficient to induce cleavage of a target site specifically bound and cleaved by the nuclease. In some embodiments, an effective amount of a fusion protein provided herein, e.g., of a fusion protein comprising a nuclease-inactive Cas9 domain and a effector domain (e.g., a deaminase domain) may refer to the amount of the fusion protein that is sufficient to induce editing of a target site specifically bound and edited by the fusion protein. As will be appreciated by the skilled artisan, the effective amount of an agent, e.g., a fusion protein, a nuclease, a deaminase, a recombinase, a hybrid protein, a protein dimer, a complex of a protein (or protein dimer) and a polynucleotide, or a polynucleotide, may vary depending on various factors such as, for example, on the desired biological response, e.g., on the specific allele, genome, or target site to be edited; on the cell or tissue being targeted; and on the agent being used.

The term "immediately adjacent" as used in the context of two nucleic acid sequences refers to two sequences that directly abut each other as part of the same nucleic acid molecule and are not separated by one or more nucleotides. Accordingly, sequences are immediately adjacent, when the nucleotide at the 3'-end of one of the sequences is directly connected to nucleotide at the 5'-end of the other sequence via a phosphodiester bond.

The term "linker," as used herein, refers to a chemical group or a molecule linking two molecules or moieties, e.g., two domains of a fusion protein, such as, for example, a nuclease-inactive Cas9 domain and a effector domain (e.g., a deaminase domain). In some embodiments, a linker joins a gRNA binding domain of an RNA-programmable nuclease, including a Cas9 nuclease domain, and the catalytic domain of a nucleic-acid editing protein. In some embodiments, a linker joins a dCas9 and a nucleic-acid editing protein. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated.

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning: A Laboratory Manual* ($4^{th}$ ed., Cold Spring Harbor Laboratory Press, Cold Spring Harbor, N.Y. (2012)).

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, 0(6)-methylguanine, and 2-thiocytidine); chemically modified bases; biologically modified bases (e.g., methylated bases); intercalated bases; modified sugars (e.g., 2'-fluororibose, ribose, 2'-deoxyribose, arabinose, and hexose); and/or modified phosphate groups (e.g., phosphorothioates and 5'-N-phosphoramidite linkages). In some embodiments, an RNA is an RNA associated with the Cas9 system. For example, the RNA may be a CRISPR RNA (crRNA), a trans-encoded small RNA (tracrRNA), a single guide RNA (sgRNA), or a guide RNA (gRNA).

The term "proliferative disease," as used herein, refers to any disease in which cell or tissue homeostasis is disturbed in that a cell or cell population exhibits an abnormally elevated proliferation rate. Proliferative diseases include hyperproliferative diseases, such as pre-neoplastic hyperplastic conditions and neoplastic diseases. Neoplastic diseases are characterized by an abnormal proliferation of cells and include both benign and malignant neoplasias. Malignant neoplasia is also referred to as cancer.

The terms "protein," "peptide," and "polypeptide" are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide may refer to an individual protein or a collection of proteins. One or more of the amino acids in a protein, peptide, or polypeptide may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein, peptide, or polypeptide may also be a single molecule or may be a multi-molecular complex. A protein, peptide, or polypeptide may be just a fragment of a naturally occurring protein or peptide. A protein, peptide, or polypeptide may be naturally occurring, recombinant, or synthetic, or any combination thereof. The term "fusion protein" as used herein refers to a hybrid polypeptide which comprises protein domains from at least two different proteins. One protein may be located at the amino-terminal (N-terminal) portion of the fusion protein or at the carboxy-terminal (C-terminal) protein thus forming an "amino-terminal fusion protein" or a "carboxy-terminal fusion protein," respectively. A protein may comprise different domains, for example, a nucleic acid binding domain (e.g., the gRNA binding domain of Cas9 that directs the binding of the protein to a target site) and a nucleic acid cleavage domain or a catalytic domain of a nucleic-acid editing protein. In some embodiments, a protein comprises a proteinaceous part, e.g., an amino acid sequence constituting a nucleic acid binding domain, and an organic compound, e.g., a compound that can act as a nucleic acid cleavage agent. In some embodiments, a protein is in a complex with, or is in association with, a nucleic acid, e.g., RNA. Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known, and include those described by Green and Sambrook, *Molecular Cloning: A Laboratory Manual* (4$^{th}$ ed., Cold Spring Harbor Laboratory Press, Cold Spring Harbor, N.Y. (2012)), the entire contents of which are incorporated herein by reference.

The term "RNA-programmable nuclease," and "RNA-guided nuclease" are used interchangeably herein and refer to a nuclease that forms a complex with (e.g., binds or associates with) one or more RNA that is not a target for cleavage. In some embodiments, an RNA-programmable nuclease, when in a complex with an RNA, may be referred to as a nuclease:RNA complex. Typically, the bound RNA(s) is referred to as a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target); and (2) a domain that binds a Cas9 protein. In some embodiments, domain (2) corresponds to a sequence known as a tracrRNA, and comprises a stem-loop structure. For example, in some embodiments, domain (2) is identical or homologous to a tracrRNA as provided in Jinek et al., *Science* 337:816-821(2012), the entire contents of which is incorporated herein by reference. Other examples of gRNAs (e.g., those including domain 2) can be found in U.S. Provisional Patent Application, U.S. Ser. No. 61/874,682, filed Sep. 6, 2013, entitled "Switchable Cas9 Nucleases and Uses Thereof," and U.S. Provisional Patent Application, U.S. Ser. No. 61/874,746, filed Sep. 6, 2013, entitled "Delivery System For Functional Nucleases," the entire contents of each are hereby incorporated by reference in their entirety. In some embodiments, a gRNA comprises two or more of domains (1) and (2), and may be referred to as an "extended gRNA." For example, an extended gRNA will, e.g., bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex. In some embodiments, the RNA-programmable nuclease is the (CRISPR-associated system) Cas9 endonuclease, for example Cas9 (Csn1) from *Streptococcus pyogenes* (see, e.g., "Complete genome sequence of an M1 strain of *Streptococcus pyogenes*." Ferretti J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663 (2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., *Nature* 471:602-607 (2011); and "A programmable dual-RNA-guided DNA endonuclease in adaptive bacterial immunity." Jinek M., Chylinski K., Fonfara I., Hauer M., Doudna J. A., Charpentier E. *Science* 337:816-821 (2012), the entire contents of each of which are incorporated herein by reference.

Because RNA-programmable nucleases (e.g., Cas9) use RNA:DNA hybridization to target DNA cleavage sites, these proteins are able to be targeted, in principle, to any sequence specified by the guide RNA. Methods of using RNA-programmable nucleases, such as Cas9, for site-specific cleavage (e.g., to modify a genome) are known in the art (see e.g., Cong, L. et al. Multiplex genome engineering using CRISPR/Cas systems. *Science* 339, 819-823 (2013); Mali, P. et al. RNA-guided human genome engineering via Cas9. *Science* 339, 823-826 (2013); Hwang, W. Y. et al. Efficient genome editing in zebrafish using a CRISPR-Cas system. *Nature biotechnology* 31, 227-229 (2013); Jinek, M. et al. RNA-programmed genome editing in human cells. *eLife* 2, e00471 (2013); Dicarlo, J. E. et al. Genome engineering in *Saccharomyces cerevisiae* using CRISPR-Cas systems. *Nucleic acids research* (2013); Jiang, W. et al. RNA-guided editing of bacterial genomes using CRISPR-Cas systems. *Nature biotechnology* 31, 233-239 (2013); the entire contents of each of which are incorporated herein by reference).

The term "subject," as used herein, refers to an individual organism, for example, an individual mammal. In some embodiments, the subject is a human. In some embodiments, the subject is a non-human mammal. In some embodiments, the subject is a non-human primate. In some embodiments, the subject is a rodent. In some embodiments, the subject is a sheep, a goat, a cattle, a cat, or a dog. In some embodiments, the subject is a vertebrate, an amphibian, a reptile, a fish, an insect, a fly, or a nematode. In some embodiments, the subject is a research animal. In some embodiments, the subject is genetically engineered, e.g., a genetically engineered non-human subject. The subject may be of either sex, of any age, and at any stage of development.

The term "target site" refers to a sequence within a nucleic acid molecule that is deaminated by a deaminase or a fusion protein comprising a deaminase (e.g., a dCas9-deaminase fusion protein provided herein).

The terms "treatment," "treat," and "treating," refer to a clinical intervention aimed to reverse, alleviate, delay the onset of, or inhibit the progress of a disease or disorder, or one or more symptoms thereof, as described herein. As used herein, the terms "treatment," "treat," and "treating" refer to a clinical intervention aimed to reverse, alleviate, delay the onset of, or inhibit the progress of a disease or disorder, or one or more symptoms thereof, as described herein. In some embodiments, treatment may be administered after one or more symptoms have developed and/or after a disease has been diagnosed. In other embodiments, treatment may be administered in the absence of symptoms, e.g., to prevent or delay onset of a symptom or inhibit onset or progression of a disease. For example, treatment may be administered to a susceptible individual prior to the onset of symptoms (e.g., in light of a history of symptoms and/or in light of genetic or other susceptibility factors). Treatment may also be continued after symptoms have resolved, for example, to prevent or delay their recurrence.

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

The term "nucleic acid editing enzyme" as used herein refers to proteins that are able to modify a nucleic acids or one or more nucleotide bases of a nucleic acid. For example, in some embodiments, a nucleic acid editing enzyme is a deaminase, which can catalyze C to T or G to A changes. Other suitable nucleic acid editing enzyme that may be used in accordance with this disclosure include, without limitation, a nuclease, nickase, recombinase, deaminase, methyltransferase, methylase, acetylase, or acetyltransferase.

DETAILED DESCRIPTION OF CERTAIN EMBODIMENTS OF THE INVENTION

Some aspects of this disclosure provide recombinant Cas9 proteins that efficiently target DNA sequences that do not comprise the canonical PAM sequence (5'-NGG-3', where N is any nucleotide, for example A, T, G, or C) at their 3'-ends. In some embodiments, the Cas9 proteins provided herein comprise one or more mutations identified in directed evolution experiments using a target sequence library comprising randomized PAM sequences. The recombinant non-PAM restricted Cas9 proteins provided herein are useful for targeting DNA sequences that do not comprise the canonical PAM sequence at their 3'-end and thus greatly extend the usefulness of Cas9 technology for gene editing.

Some aspects of this disclosure provide fusion proteins that comprise a Cas9 protein and an effector domain, for example, a DNA-editing domain, such as, e.g., a deaminase domain. The deamination of a nucleobase by a deaminase can lead to a point mutation at the specific residue, which is referred to herein as nucleic acid editing. Fusion proteins comprising a Cas9 protein or variant thereof and a DNA-editing domain can thus be used for the targeted editing of nucleic acid sequences. Such fusion proteins are useful for targeted editing of DNA in vitro, e.g., for the generation of mutant cells or animals; for the introduction of targeted mutations, e.g., for the correction of genetic defects in cells ex vivo, e.g., in cells obtained from a subject that are subsequently re-introduced into the same or another subject; and for the introduction of targeted mutations, e.g., the correction of genetic defects or the introduction of deactivating mutations in disease-associated genes in a subject in vivo. Typically, the Cas9 protein of the fusion proteins described herein does not have any nuclease activity but instead is a Cas9 fragment or a dCas9 protein. Methods for the use of Cas9 fusion proteins as described herein are also provided.

Non-limiting, exemplary nuclease-inactive Cas9 proteins are provided herein. One exemplary suitable nuclease-inactive Cas9 protein is the D10A/H840A Cas9 protein mutant:

MDKKYSIGLAIGTNSVGWAVITDEYKVPSKKEKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLIP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVIVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDAIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDERKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIEINGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD (SEQ ID NO: 262;

see, e.g., Qi et al., Repurposing CRISPR as an RNA-guided platform for sequence-specific control of gene expression. *Cell.* 2013; 152(5):1173-83, the entire contents of which are incorporated herein by reference).

Additional suitable nuclease-inactive Cas9 proteins will be apparent to those of skill in the art based on this disclosure. Such additional exemplary suitable nuclease-inactive Cas9 proteins include, but are not limited to, D10A, D839A, H840A, N863A, D10A/D839A, D10A/H840A, D10A/N863A, D839A/H840A, D839A/N863A, D10A/D839A/H840A, and D10A/D839A/H840A/N863A mutant proteins (See, e.g., Prashant et al., CAS9 transcriptional activators for target specificity screening and paired nickases for cooperative genome engineering. *Nature Biotechnology.* 2013; 31(9): 833-838, the entire contents of which are incorporated herein by reference).

Recombinant Cas9 Proteins

Some aspects of this disclosure provide recombinant Cas9 proteins comprising an amino acid sequence that is at least 80%, at least 85%, at least 90%, at least 92%, at least 95%, at least 96%, at least 97%, at least 98%, at least 99%, or at least 99.5% identical to the amino acid sequence of Cas9 as provided by any of the sequences provided in SEQ ID NOs: 10-262, wherein the Cas9 protein comprises a RuvC and an HNH domain, wherein the amino acid sequence of the Cas9 protein comprises at least one, at least two, at least three, at least four, at least five, at least six, or at least seven mutations at an amino acid residue selected from the group consisting of amino acid residues 122, 137, 182, 262, 294, 409, 480, 543, 660, 694, 1219, and 1329 of the amino acid sequence provided in SEQ ID NO: 9, or in a corresponding amino acid residue in any of the amino acid sequences provided in SEQ ID NOs: 10-262, and wherein the amino acid sequence of the recombinant Cas9 protein is not identical to the amino acid sequence of a naturally occurring Cas9 protein.

In some embodiments, the amino acid sequence of the Cas9 protein comprises at least one, at least two, at least three, at least four, at least five, at least six, or at least seven mutations selected from the group consisting of X262T, X294R, X409I, X480K, X543D, X694I, and X1219V of the amino acid sequence provided in SEQ ID NO: 9, or a corresponding mutation in any of the amino acid sequences provided in SEQ ID NOs: 10-262, wherein X represents any amino acid at the corresponding position.

In some embodiments, the amino acid sequence of the Cas9 protein comprises at least one, at least two, at least three, at least four, at least five, at least six, or at least seven mutations selected from the group consisting of A262T, K294R, S409I, E480K, E543D, M694I, or E1219V of the amino acid sequence provided in SEQ ID NO: 9, or a corresponding mutation in any of the amino acid sequences provided in SEQ ID NOs: 10-262. In some embodiments, the amino acid sequence of the Cas9 protein comprises an X1219V mutation of the amino acid sequence provided in SEQ ID NO: 9, or a corresponding mutation in any of the amino acid sequences provided in SEQ ID NOs: 10-262. In some embodiments, the amino acid sequence of the Cas9 protein comprises an E1219V mutation of the amino acid sequence provided in SEQ ID NO: 9, or a corresponding mutation in any of the amino acid sequences provided in SEQ ID NOs: 10-262.

In some embodiments, the amino acid sequence of the HNH domain is at least 80%, at least 85%, at least 90%, at least 92%, at least 95%, at least 96%, at least 97%, at least 98%, at least 99%, or at least 99.5% identical to the amino acid sequence of the HNH domain of SEQ ID NO: 9. In some embodiments, the amino acid sequence of the RuvC domain is at least 80%, at least 85%, at least 90%, at least 92%, at least 95%, at least 96%, at least 97%, at least 98%, at least 99%, or at least 99.5% identical to the amino acid sequence of the RuvC domain of any of SEQ ID NOs: 10-262. In some embodiments, the amino acid sequence of the RuvC domain is at least 80%, at least 85%, at least 90%, at least 92%, at least 95%, at least 96%, at least 97%, at least 98%, at least 99%, or at least 99.5% identical to the amino acid sequence of the RuvC domain of SEQ ID NO: 9. In some embodiments, the Cas9 protein comprises a D10A and/or a H840A mutation of the amino acid sequence provided in SEQ ID NO: 9, or a corresponding mutation in any of the amino acid sequences provided in SEQ ID NOs: 10-262.

Recombinant Cas9 Proteins with Activity on Non-Canonical PAMs

Some aspects of this disclosure provide recombinant Cas9 proteins comprising an amino acid sequence that is at least 90% identical to the amino acid sequence of *Streptococcus pyogenes* Cas9 as provided by SEQ ID NO: 9, comprising the RuvC and HNH domains of SEQ ID NO: 9, wherein the amino acid sequence of the Cas9 protein comprises at least one, at least two, at least three, at least four, at least five, at least six, or at least seven mutations in an amino acid residue selected from the group consisting of amino acid residues 122, 137, 182, 262, 294, 409, 480, 543, 660, 694, 1219, and 1329 of the amino acid sequence provided in SEQ ID NO: 9, wherein the amino acid sequence of the recombinant Cas9 protein is not identical to the amino acid sequence of a naturally occurring Cas9 protein, and wherein the recombinant Cas9 protein exhibits activity (e.g., increased activity) on a target sequence that does not comprise the canonical PAM (5'-NGG-3') at its 3'-end as compared to *Streptococcus pyogenes* Cas9 as provided by SEQ ID NO: 9.

In some embodiments, the Cas9 protein exhibits activity on a target sequence having a 3'-end that is not directly adjacent to the canonical PAM sequence (5'-NGG-3') that is at least 2-fold, at least 3-fold, at least 5-fold, at least 10-fold, at least 50-fold, at least 100-fold, at least 500-fold, at least 1,000-fold, at least 5,000-fold, at least 10,000-fold, at least 50,000-fold, at least 100,000-fold, at least 500,000-fold, or at least 1,000,000-fold increased as compared to the activity of *Streptococcus pyogenes* Cas9 as provided by SEQ ID NO: 9 on the same target sequence. In some embodiments, the 3'-end of the target sequence is directly adjacent to an AGC, GAG, TTT, GTG, or CAA sequence. In some embodiments, the Cas9 protein activity is measured by a nuclease assay, a deamination assay, or a transcriptional activation assay. In some embodiments, the transcriptional activation assay is a reporter activation assay, such as a GFP activation assay. Exemplary methods for measuring binding activity (e.g., of Cas9) using transcriptional activation assays are known in the art and would be apparent to the skilled artisan. For example, methods for measuring Cas9 activity using the tripartite activator VPR have been described in Chavez A., et al., "Highly efficient Cas9-mediated transcriptional programming." *Nature Methods* 12, 326-328 (2015); the entire contents of which are incorporated by reference herein.

In some embodiments, the amino acid sequence of the Cas9 protein comprises at least one, at least two, at least three, at least four, at least five, at least six, or at least seven mutations selected from the group consisting of X262T, X294R, X409I, X480K, X543D, X694I, and X1219V of the amino acid sequence provided in SEQ ID NO: 9, or a corresponding mutation in any of the amino acid sequences provided in SEQ ID NOs: 10-262, wherein X represents any amino acid at the corresponding position.

In some embodiments, the amino acid sequence of the Cas9 protein comprises at least one, at least two, at least three, at least four, at least five, at least six, or at least seven mutations selected from the group consisting of A262T, K294R, S409I, E480K, E543D, M694I, or E1219V of the amino acid sequence provided in SEQ ID NO: 9, or a corresponding mutation in any of the amino acid sequences provided in SEQ ID NOs: 10-262. In some embodiments, the amino acid sequence of the Cas9 protein comprises an X1219V mutation of the amino acid sequence provided in SEQ ID NO: 9, or a corresponding mutation in any of the amino acid sequences provided in SEQ ID NOs: 10-262. In some embodiments, the amino acid sequence of the Cas9 comprises an X1219V mutation of the amino acid sequence provided in SEQ ID NO: 9, or a corresponding mutation in any of the amino acid sequences provided in SEQ ID NOs: 10-262.

In some embodiments, the amino acid sequence of the HNH domain is at least 80%, at least 85%, at least 90%, at least 92%, at least 95%, at least 96%, at least 97%, at least 98%, at least 99%, or at least 99.5% identical to the amino acid sequence of the HNH domain of any of SEQ ID NOs: 2, 4, or 9. In some embodiments, the amino acid sequence of the RuvC domain is at least 80%, at least 85%, at least 90%, at least 92%, at least 95%, at least 96%, at least 97%, at least 98%, at least 99%, or at least 99.5% identical to the amino acid sequence of the RuvC domain of any of SEQ ID NOs: 10-262. In some embodiments, the Cas9 protein comprises a D10A and/or a H840A mutation of the amino acid sequence provided in SEQ ID NO: 9, or a corresponding mutation in any of the amino acid sequences provided in SEQ ID NOs: 10-262.

Some aspects of this disclosure provide recombinant Cas9 proteins comprising an amino acid sequence that is at least 90% identical to the amino acid sequence of *Streptococcus pyogenes* Cas9 as provided by SEQ ID NO: 9, comprising the RuvC and HNH domains of SEQ ID NO: 9, wherein the amino acid sequence of the Cas9 protein comprises at least one, at least two, at least three, at least four, at least five, at least six, or at least seven mutations in an amino acid residue selected from the group consisting of amino acid residues 122, 137, 182, 262, 294, 409, 480, 543, 660, 694, 1219, and 1329 of the amino acid sequence provided in SEQ ID NO: 9, wherein the amino acid sequence of the recombinant Cas9 protein is not identical to the amino acid sequence of a naturally occurring Cas9 protein, and wherein the recombinant Cas9 protein exhibits an increased activity on a target sequence that does not comprise the canonical PAM (5'-NGG-3') at its 3'-end as compared to *Streptococcus pyogenes* Cas9 as provided by SEQ ID NO: 9. In some embodiments, the amino acid sequence of the RuvC domain is at least 80%, at least 85%, at least 90%, at least 92%, at least 95%, at least 96%, at least 97%, at least 98%, at least 99%, or at least 99.5% identical to the amino acid sequence of the RuvC domain of any of SEQ ID NOs: 2, 4, or 9. In some embodiments, the Cas9 protein comprises a D10A and a H840A mutation of the amino acid sequence provided in SEQ ID NO: 9, or a corresponding mutation in any of the amino acid sequences provided in SEQ ID NOs: 10-262.

Some aspects of this disclosure provide recombinant Cas9 proteins comprising an amino acid sequence that is at least 90% identical to the amino acid sequence of *Streptococcus pyogenes* Cas9 as provided by SEQ ID NO: 9, comprising the RuvC and HNH domains of SEQ ID NO: 9, wherein the amino acid sequence of the Cas9 protein comprises at least one, at least two, at least three, at least four, at least five, at least six, or at least seven mutations in an amino acid residue selected from the group consisting of amino acid residues 122, 137, 182, 262, 294, 409, 480, 543, 660, 694, 1219, and 1329 of the amino acid sequence provided in SEQ ID NO: 9, wherein the amino acid sequence of the recombinant Cas9 protein is not identical to the amino acid sequence of a naturally occurring Cas9 protein, and wherein the recombinant Cas9 protein exhibits an increased activity on a target sequence that does not comprise the canonical PAM (5'-NGG-3') at its 3'-end as compared to *Streptococcus pyogenes* Cas9 as provided by SEQ ID NO: 9. In some embodiments, the amino acid sequence of the RuvC domain is at least 80%, at least 85%, at least 90%, at least 92%, at least 95%, at least 96%, at least 97%, at least 98%, at least 99%, or at least 99.5% identical to the amino acid sequence of the RuvC domain of any of SEQ ID NOs: 2, 4, or 9. In some embodiments, the Cas9 protein comprises a D10A mutation of the amino acid sequence provided in SEQ ID NO: 9, or a corresponding mutation in any of the amino acid sequences provided in SEQ ID NOs: 10-262. In some embodiments, the Cas9 further comprises a histidine residue at position 840 as provided in SEQ ID NO: 9, or a corresponding histidine residue in any of the amino acid sequences provided in SEQ ID NOs: 10-262. Without wishing to be bound by any particular theory, the presence of the catalytic residue H840 allows Cas9 to cleave the non-targeted strand, i.e., the strand bound by the sgRNA. In some embodiments, a Cas9 having an amino acid residue other than histidine at position 840 of the amino acid sequence provided in SEQ ID NO: 9, or a corresponding amino acid sequence provided in SEQ ID NOs: 10-262 may be changed or reverted such that amino acid residue 840 of the amino acid sequence provided in SEQ ID NO: 9, or a corresponding amino acid sequence provided in SEQ ID NOs: 10-262 is histidine.

Some aspects of this disclosure provide recombinant Cas9 proteins comprising an amino acid sequence that is at least 90% identical to the amino acid sequence of *Streptococcus pyogenes* Cas9 as provided by SEQ ID NO: 9, comprising the RuvC and HNH domains of SEQ ID NO: 9; wherein the amino acid sequence of the Cas9 protein comprises at least one, at least two, at least three, at least four, at least five, at least six, or at least seven mutations in an amino acid residue selected from the group consisting of amino acid residues 262, 267, 294, 405, 409, 480, 543, 694, 1219, 1224, and 1256 of the amino acid sequence provided in SEQ ID NO: 9; wherein the amino acid sequence of the recombinant Cas9 protein is not identical to the amino acid sequence of a naturally occurring Cas9 protein; and wherein the recombinant Cas9 protein exhibits activity (e.g., increased activity) on a target sequence that does not comprise the canonical PAM (5'-NGG-3') at its 3'-end as compared to *Streptococcus pyogenes* Cas9 as provided by SEQ ID NO: 9.

In some embodiments, the Cas9 protein exhibits an activity on a target sequence having a 3'-end that is not directly adjacent to the canonical PAM sequence (5'-NGG-3') that is at least 2-fold, at least 3-fold, at least 5-fold, at least 10-fold, at least 50-fold, at least 100-fold, at least 500-fold, at least 1,000-fold, at least 5,000-fold, at least 10,000-fold, at least 50,000-fold, at least 100,000-fold, at least 500,000-fold, or at least 1,000,000-fold increased as compared to the activity of *Streptococcus pyogenes* Cas9 as provided by SEQ ID NO: 9 on the same target sequence. In some embodiments, the 3'-end of the target sequence is directly adjacent to an AAA, AAC, AAG, AAT, CAA, CAC, CAG, CAT, GAA, GAC, GAG, GAT, TAA, TAC, TAG, TAT, ACA, ACC, ACG, ACT, CCA, CCC, CCG, CCT, GCA, GCC, GCG, GCT, TCA, TCC, TCG, TCT, AGA, AGC, AGT, CGA, CGC, CGT, GGA, GGC, GGT, TGA, TGC, TGT, ATA, ATC, ATG, ATT, CTA, CTC, CTG, CTT, GTA, GTC, GTG, GTT, TTA, TTC, TTG, or TTT PAM sequence.

In some embodiments, the amino acid sequence of the Cas9 protein comprises at least one, at least two, at least three, at least four, at least five, at least six, or at least seven mutations selected from the group consisting of X262T, X267G, X294R, X405I, X409I, X480K, X543D, X694I, X1219V, X1224K, X1256K, and X1362P of the amino acid sequence provided in SEQ ID NO: 9, or a corresponding mutation in any of the amino acid sequences provided in SEQ ID NOs: 10-262, wherein X represents any amino acid at the corresponding position.

In some embodiments, the amino acid sequence of the Cas9 protein comprises at least one, at least two, at least three, at least four, at least five, at least six, or at least seven mutations selected from the group consisting of A262T, S267G, K294R, F405I, S409I, E480K, E543D, M694I, E1219V, N1224K, Q1256K, and L1362P of the amino acid sequence provided in SEQ ID NO: 9, or a corresponding mutation in any of the amino acid sequences provided in SEQ ID NOs: 10-262. In some embodiments, the amino acid sequence of the Cas9 protein comprises an X1219V mutation of the amino acid sequence provided in SEQ ID NO: 9, or a corresponding mutation in any of the amino acid sequences provided in SEQ ID NOs: 10-262. In some embodiments, the amino acid sequence of the Cas9 protein comprises an E1219V mutation of the amino acid sequence provided in SEQ ID NO: 9, or a corresponding mutation in any of the amino acid sequences provided in SEQ ID NOs: 10-262.

In some embodiments, the amino acid sequence of the Cas9 protein comprises an X480K mutation of the amino acid sequence provided in SEQ ID NO: 9, or a corresponding mutation in any of the amino acid sequences provided in SEQ ID NOs: 10-262. In some embodiments, the amino acid sequence of the Cas9 protein comprises an E480K mutation of the amino acid sequence provided in SEQ ID NO: 9, or a corresponding mutation in any of the amino acid sequences provided in SEQ ID NOs: 10-262.

In some embodiments, the amino acid sequence of the Cas9 protein comprises an X543D mutation of the amino acid sequence provided in SEQ ID NO: 9, or a corresponding mutation in any of the amino acid sequences provided in SEQ ID NOs: 10-262. In some embodiments, the amino acid sequence of the Cas9 protein comprises an E543D mutation of the amino acid sequence provided in SEQ ID NO: 9, or a corresponding mutation in any of the amino acid sequences provided in SEQ ID NOs: 10-262.

In some embodiments, the amino acid sequence of the Cas9 protein comprises the combination of mutations selected from the group consisting of (X480K, X543D, and X1219V); (X262T, X409I, X480K, X543D, X694I, and X1219V); (X294R, X480K, X543D, X1219V, X1256K, and X1362P); (X294R, X480K, X543D, X1219V, and X1256K); (X267G, X294R, X480K, X543D, X1219V, X1224K, and X1256K); and (X262T, X405I, X409I, X480K, X543D, X694I, and X1219V) of the amino acid sequence provided in SEQ ID NO: 9, or a corresponding mutation in any of the amino acid sequences provided in SEQ ID NOs: 10-262. In some embodiments, the amino acid sequence of the Cas9 protein comprises the combination of mutations selected from the group consisting of (E480K, E543D, and E1219V); (A262T, S409I, E480K, E543D, M694I, and E1219V); (K294R, E480K, E543D, E1219V, Q1256K, and L1362P); (K294R, E480K, E543D, E1219V, and Q1256K); (S267G, K294R, E480K, E543DE1219V, N1224K, and Q1256K); and (A262T, F405I, S409I, E480K, E543D, M694I, and E1219V) of the amino acid sequence provided in SEQ ID NO: 9, or a corresponding mutation in any of the amino acid sequences provided in SEQ ID NOs: 10-262.

In some embodiments, the amino acid sequence of the HNH domain is at least 80%, at least 85%, at least 90%, at least 92%, at least 95%, at least 96%, at least 97%, at least 98%, at least 99%, or at least 99.5% identical to the amino acid sequence of the HNH domain of any of SEQ ID NOs: 2, 4, or 9. In some embodiments, the amino acid sequence of the RuvC domain is at least 80%, at least 85%, at least 90%, at least 92%, at least 95%, at least 96%, at least 97%, at least 98%, at least 99%, or at least 99.5% identical to the amino acid sequence of the RuvC domain of any of SEQ ID NOs: 2, 4, or 9. In some embodiments, the Cas9 protein comprises a D10A and/or a H840A mutation of the amino acid sequence provided in SEQ ID NO: 9, or a corresponding mutation in any of the amino acid sequences provided in SEQ ID NOs: 10-262. In some embodiments, the Cas9 protein comprises a D10A and an H840A mutation of the amino acid sequence provided in SEQ ID NO: 9, or a corresponding mutation in any of the amino acid sequences provided in SEQ ID NOs: 10-262. In some embodiments, the Cas9 protein comprises a D10A mutation of the amino acid sequence provided in SEQ ID NO: 9, or a corresponding mutation in any of the amino acid sequences provided in SEQ ID NOs: 10-262. In some embodiments, the Cas9 protein comprises an H840A mutation of the amino acid sequence provided in SEQ ID NO: 9, or a corresponding mutation in any of the amino acid sequences provided in SEQ ID NOs: 10-262.

Some aspects of this disclosure provide recombinant Cas9 proteins comprising an amino acid sequence that is at least 90% identical to the amino acid sequence of *Streptococcus pyogenes* Cas9 as provided by SEQ ID NO: 9, comprising the RuvC and HNH domains of SEQ ID NO: 9, wherein the amino acid sequence of the Cas9 protein comprises at least one, at least two, at least three, at least four, at least five, at least six, or at least seven mutations in an amino acid residue selected from the group consisting of amino acid residues 262, 267, 294, 405, 409, 480, 543, 694, 1219, 1224, 1256, and 1362 of the amino acid sequence provided in SEQ ID NO: 9, wherein the amino acid sequence of the recombinant Cas9 protein is not identical to the amino acid sequence of a naturally occurring Cas9 protein, and wherein the recombinant Cas9 protein exhibits increased activity on a target sequence that does not include the canonical PAM (5'-NGG-3') at its 3'-end as compared to *Streptococcus pyogenes* Cas9 as provided by SEQ ID NO: 9. In some embodiments, the Cas9 protein comprises a D10A and a H840A mutation of the amino acid sequence provided in SEQ ID NO: 9, or a corresponding mutation in any of the amino acid sequences provided in SEQ ID NOs: 10-262.

Some aspects of this disclosure provide recombinant Cas9 proteins comprising an amino acid sequence that is at least 90% identical to the amino acid sequence of *Streptococcus pyogenes* Cas9 as provided by SEQ ID NO: 9, comprising the RuvC and HNH domains of SEQ ID NO: 9, wherein the amino acid sequence of the Cas9 protein comprises at least one, at least two, at least three, at least four, at least five, at least six, or at least seven mutations at an amino acid residue selected from the group consisting of amino acid residues 262, 267, 294, 405, 409, 480, 543, 694, 1219, 1224, 1256, and 1362 of the amino acid sequence provided in SEQ ID NO: 9, wherein the amino acid sequence of the recombinant Cas9 protein is not identical to the amino acid sequence of a naturally occurring Cas9 protein, and wherein the recombinant Cas9 protein exhibits increased activity on a target sequence that does not comprise the canonical PAM (5'-NGG-3') at its 3'-end as compared to *Streptococcus pyogenes* Cas9 as provided by SEQ ID NO: 9. In some embodiments, the amino acid sequence of the RuvC domain is at least 80%, at least 85%, at least 90%, at least 92%, at least 95%, at least 96%, at least 97%, at least 98%, at least 99%, or at least 99.5% identical to the amino acid sequence of the RuvC domain of any of SEQ ID NOs: 2, 4, or 9. In some embodiments, the Cas9 protein comprises a D10A mutation of the amino acid sequence provided in SEQ ID NO: 9, or a corresponding mutation in any of the amino acid sequences provided in SEQ ID NOs: 10-262. In some embodiments, the Cas9 further comprises a histidine residue at position 840 as provided in SEQ ID NO: 9, or a corresponding histidine residue in any of the amino acid sequences provided in SEQ ID NOs: 10-262. Without wishing to be bound by any particular theory, the presence of the catalytic residue H840 allows Cas9 to cleave the non-targeted strand, i.e., the strand bound by the sgRNA. In some embodiments, a Cas9 having an amino acid residue other than histidine at position 840 of the amino acid sequence provided in SEQ ID NO: 9, or a corresponding amino acid sequence provided in SEQ ID NOs: 10-262 may be changed or reverted such that amino acid residue 840 of the amino acid sequence provided in SEQ ID NO: 9, or a corresponding amino acid sequence provided in SEQ ID NOs: 10-262 is histidine.

Cas9 Fusion Proteins

Some aspects of this disclosure provide fusion proteins comprising a Cas9 protein as provided herein that is fused to a second protein, or a "fusion partner", such as an effector domain, thus forming a fusion protein. In some embodiments, the effector domain is fused to the N-terminus of the Cas9 protein. In some embodiments, the effector domain is fused to the C-terminus of the Cas9 protein. In some embodiments, the Cas9 protein and the effector domain are fused to each other via a linker. Suitable strategies for generating fusion proteins according to aspects of this disclosure using linkers or without the use of linkers will also be apparent to those of skill in the art in view of the instant disclosure and the knowledge in the art. For example, Gilbert et al., CRISPR-mediated modular RNA-guided regulation of transcription in eukaryotes. *Cell.* 2013; 154 (2):442-51, showed that C-terminal fusions of Cas9 with VP64 using 2 NLS's as a linker (SPKKKRKVEAS, SEQ ID NO: 284), can be employed for transcriptional activation. Mali et al., CAS9 transcriptional activators for target specificity screening and paired nickases for cooperative genome engineering. *Nat Biotechnol.* 2013; 31(9):833-8, reported that C-terminal fusions with VP64 without linker can be employed for transcriptional activation. And Maeder et al., CRISPR RNA-guided activation of endogenous human genes. *Nat Methods.* 2013; 10: 977-979, reported that C-terminal fusions with VP64 using a Gly$_4$Ser (SEQ ID NO: 5) linker can be used as transcriptional activators. Recently, dCas9-FokI nuclease fusions have successfully been generated and exhibit improved enzymatic specificity as compared to the parental Cas9 enzyme (In Guilinger J P, Thompson D B, Liu D R. Fusion of catalytically inactive Cas9 to FokI nuclease improves the specificity of genome modification. *Nat. Biotechnol.* 2014; 32(6): 577-82, and in Tsai S Q, Wyvekens N, Khayter C, Foden J A, Thapar V, Reyon D, Goodwin M J, Aryee M J, Joung J K. Dimeric CRISPR RNA-guided FokI nucleases for highly specific genome editing. *Nat Biotechnol.* 2014; 32(6):569-76. PMID: 24770325 a SGSETPGTSESATPES (SEQ ID NO: 7) or a GGGGS. (SEQ ID NO: 5) linker was used in FokI-dCas9 fusion proteins, respectively). In some embodiments, the linker comprises a (GGGGS)$_n$ (SEQ ID NO: 5), a (G)$_n$ (SEQ ID NO: 5087), an (EAAAK)$_n$ (SEQ ID NO: 6), a (GGS)$_n$ (SEQ ID NO: 5088), an SGSETPGTSESATPES (SEQ ID NO: 7), or an (XP)$_n$ (SEQ ID NO: 5089) motif, or a combination of any of these, wherein n is independently an integer between 1 and 30. In some embodiments, the effector domain comprises an enzymatic domain. Suitable effector domains include, without limitation a nuclease, nickase, recombinase, deaminase, methyltransferase, methylase, acetylase, acetyltransferase, transcriptional activator, and transcriptional repressor.

The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may included functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some embodiments, the effector domain comprises a effector enzyme. Suitable effector enzymes that may be used in accordance with this disclosure include nucleases, nickases, recombinases, and deaminases. However additional effector enzymes would be apparent to the skilled artisan and are within the scope of this disclosure. In other embodiments, the effector domain comprises a domain that modulates transcriptional activity. Such transcriptional modulating domains may be, without limitation, a transcriptional activator or transcriptional repressor domain.

In some embodiments, the effector domain is a effector domain. In some embodiments, the effector domain is a deaminase domain. In some embodiments, the deaminase is a cytosine deaminase or a cytidine deaminase. In some embodiments, the deaminase is an apolipoprotein B mRNA-editing complex (APOBEC) family deaminase. In some embodiments, the deaminase is an APOBEC1 deaminase. In some embodiments, the deaminase is an APOBEC2 deaminase. In some embodiments, the deaminase is an APOBEC3 deaminase. In some embodiments, the deaminase is an APOBEC3A deaminase. In some embodiments, the deaminase is an APOBEC3D deaminase. In some embodiments, the deaminase is an APOBEC3E deaminase. In some embodiments, the deaminase is an APOBEC3F deaminase. In some embodiments, the deaminase is an APOBEC3G deaminase. In some embodiments, the deaminase is an APOBEC3H deaminase. In some embodiments, the deaminase is an APOBEC4 deaminase. In some embodiments, the deaminase is an activation-induced deaminase (AID).

In some embodiments, the effector domain is at least 80%, at least 85%, at least 90%, at least 92%, at least 95%, at least 96%, at least 97%, at least 98%, at least 99%, or at least 99.5% identical to the deaminase domain of any one of SEQ ID NOs: 263-281.

In some embodiments, the effector domain is a nuclease domain. In some embodiments, the nuclease domain is a FokI DNA cleavage domain. In some embodiments, this disclosure provides dimers of the fusion proteins provided herein, e.g., dimers of fusion proteins may include a trimerizing nuclease domain.

In some embodiments, the Cas9 protein comprises an amino acid sequence that is at least 80%, at least 85%, at least 90%, at least 92%, at least 95%, at least 96%, at least 97%, at least 98%, at least 99%, or at least 99.5% identical to the amino acid sequence of Cas9 as provided by any of the sequences provided in SEQ ID NOs: 10-262, wherein the Cas9 protein comprises a RuvC and an HNH domain, wherein the amino acid sequence of the Cas9 protein comprises at least one, at least two, at least three, at least four, at least five, at least six, or at least seven mutations in an amino acid residue selected from the group consisting of amino acid residues 122, 137, 182, 262, 294, 409, 480, 543, 660, 694, 1219, and 1329 of the amino acid sequence provided in SEQ ID NO: 9, or in a corresponding amino acid residue in any of the amino acid sequences provided in SEQ ID NOs: 10-262, and wherein the amino acid sequence of the recombinant Cas9 protein is not identical to the amino acid sequence of a naturally occurring Cas9 protein. In some embodiments, the Cas9 protein comprises an amino acid sequence that is at least 90% identical to the amino acid sequence of Streptococcus pyogenes Cas9 as provided by SEQ ID NO: 9, comprising the RuvC and HNH domains of SEQ ID NO: 9, wherein the amino acid sequence of the Cas9 protein comprises at least one, at least two, at least three, at least four, at least five, at least six, or at least seven mutations in an amino acid residue selected from the group consisting of amino acid residues 122, 137, 182, 262, 294, 409, 480, 543, 660, 694, 1219, and 1329 of the amino acid sequence provided in SEQ ID NO: 9, wherein the amino acid sequence of the recombinant Cas9 protein is not identical to the amino acid sequence of a naturally occurring Cas9 protein, and wherein the recombinant Cas9 protein exhibits activity on a target sequence that does not comprise the canonical PAM (5'-NGG-3') at its 3'-end as compared to Streptococcus pyogenes Cas9 as provided by SEQ ID NO: 9.

In some embodiments, the Cas9 protein comprises an amino acid sequence that is at least 80%, at least 85%, at least 90%, at least 92%, at least 95%, at least 96%, at least 97%, at least 98%, at least 99%, or at least 99.5% identical to the amino acid sequence of Cas9 as provided by any of the sequences provided in SEQ ID NOs: 10-262, wherein the Cas9 protein comprises a RuvC and an HNH domain, wherein the amino acid sequence of the Cas9 protein comprises at least one, at least two, at least three, at least four, at least five, at least six, or at least seven mutations in an amino acid residue selected from the group consisting of amino acid residues 262, 267, 294, 405, 409, 480, 543, 694, 1219, 1224, 1256, and 1362 of the amino acid sequence provided in SEQ ID NO: 9, or in a corresponding amino acid residue in any of the amino acid sequences provided in SEQ ID NOs: 10-262, and wherein the amino acid sequence of the recombinant Cas9 protein is not identical to the amino acid sequence of a naturally occurring Cas9 protein. In some embodiments, the Cas9 protein comprises an amino acid sequence that is at least 90% identical to the amino acid sequence of Streptococcus pyogenes Cas9 as provided by SEQ ID NO: 9, comprising the RuvC and HNH domains of SEQ ID NO: 9, wherein the amino acid sequence of the Cas9 protein comprises at least one, at least two, at least three, at least four, at least five, at least six, or at least seven mutations in an amino acid residue selected from the group consisting of amino acid residues 262, 267, 294, 405, 409, 480, 543, 694, 1219, 1224, and 1256 of the amino acid sequence provided in SEQ ID NO: 9; wherein the amino acid sequence of the recombinant Cas9 protein is not identical to the amino acid sequence of a naturally occurring Cas9 protein; and wherein the recombinant Cas9 protein exhibits increased activity on a target sequence that does not include the canonical PAM (5'-NGG-3') at its 3'-end, as compared to Streptococcus pyogenes Cas9 as provided by SEQ ID NO: 9.

Some aspects of this disclosure provide fusion proteins comprising (i) a nuclease-inactive Cas9 protein; and (ii) a effector domain. In some embodiments, the effector domain is a DNA-editing domain. In some embodiments, the effector domain possesses deaminase activity. In some embodiments, the effector domain comprises or is a deaminase domain. In some embodiments, the deaminase is a cytidine deaminase. In some embodiments, the deaminase is an apolipoprotein B mRNA-editing complex (APOBEC) family deaminase. In some embodiments, the deaminase is an APOBEC1 family deaminase. In some embodiments, the deaminase is an activation-induced cytidine deaminase (AID). Some nucleic-acid editing domains as well as Cas9 fusion proteins including such domains are described in detail herein. Additional suitable effector domains will be apparent to the skilled artisan based on this disclosure. In some embodiments, the nucleic-acid editing domain is a FokI nuclease domain.

The instant disclosure provides Cas9:effector domain fusion proteins of various configurations. In some embodiments, the effector domain is fused to the N-terminus of the Cas9 protein. In some embodiments, the effector domain is fused to the C-terminus of the Cas9 protein. In some embodiments, the Cas9 protein and the effector domain are fused via a linker. In some embodiments, the linker comprises (GGGGS)$_n$ (SEQ ID NO: 5), (G)$_n$ (SEQ ID NO: 5087), (EAAAK)$_n$ (SEQ ID NO: 6), (GGS)$_n$ (SEQ ID NO: 5088), or SGSETPGTSESATPES (SEQ ID NO: 7) motif (see, e.g., Guilinger J P, Thompson D B, Liu D R. Fusion of catalytically inactive Cas9 to FokI nuclease improves the specificity of genome modification. Nat. Biotechnol. 2014; 32(6): 577-82; the entire contents are incorporated herein by reference), or an (XP)$_n$ (SEQ ID NO: 5089) motif, or a combination of any of these, wherein n is independently an integer between 1 and 30. In some embodiments, n is independently 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30, or, if more than one linker or more than one linker motif is present, any combination thereof. Additional suitable linker motifs and linker configurations will be apparent to those of skill in the art. In some embodiments, suitable linker motifs and configurations include those described in Chen et al., Fusion protein linkers: property, design and functionality. Adv Drug Deliv Rev. 2013; 65(10):1357-69, the entire contents of which are incorporated herein by reference. Additional suitable linker sequences will be apparent to those of skill in the art based on the instant disclosure and knowledge in the art.

Figure 11:
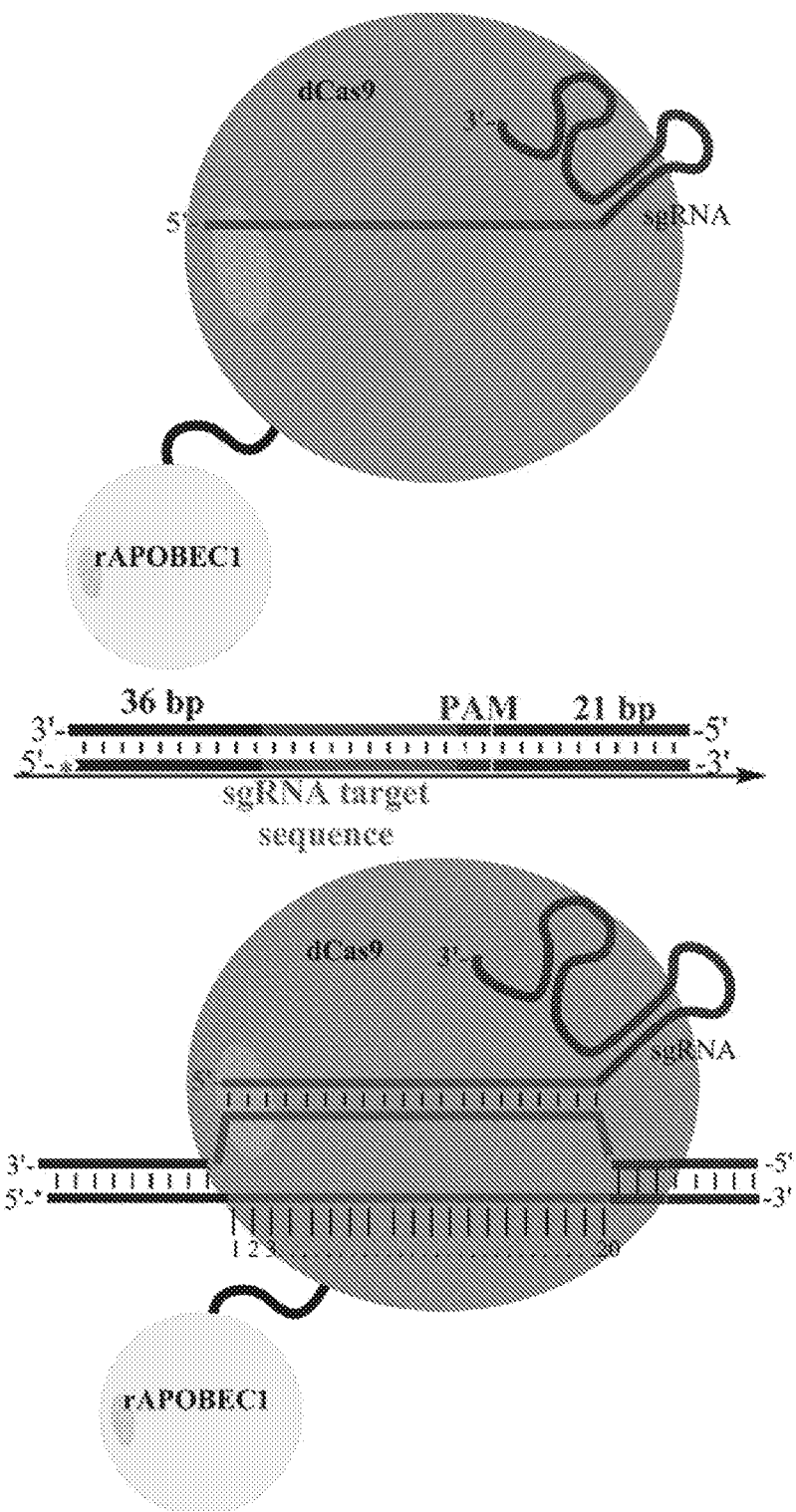
FIG. 11 illustrates double-stranded DNA substrate bound by Cas9:DNA editing enzyme:sgRNA complexes. The DNA editing enzyme may be, without limitation, a nuclease, nickase, recombinase, deaminase, methyltransferase, methylase, acetylase, or acetyltransferase.

In some embodiments, the general architecture of exemplary Cas9 fusion proteins provided herein comprises the structure:

[NH$_2$]-[effector domain]-[Cas9]-[COOH] or
[NH$_2$]-[Cas9]-[effector domain]-[COOH], wherein NH$_2$ is the N-terminus of the fusion protein, and COOH is the C-terminus of the fusion protein. FIG. 11 provides a schematic representation of a Cas9 protein fused to an effector domain (e.g., rAPOBEC1) in complex with sgRNA and bound to the target nucleic acid sequence.

In some embodiments, any of the fusion proteins provided herein may comprise one or more nuclear localization sequence (NLS). As used herein, a nuclear localization sequence refers to an amino acid sequence that promotes importation of a protein, for example any of the fusion proteins provided herein having an NLS, into the cell nucleus (e.g., via nuclear transport). Typically, an NLS comprises one or more short amino acid sequences of positively charged lysines or arginines exposed on the protein surface. Nuclear localization sequences are known in the art and would be apparent to the skilled artisan. For example nuclear localization sequences have been described in Kalderon D., et al., "A short amino acid sequence able to specify nuclear location". *Cell* (1984) 39 (3 Pt 2): 499-509; Dingwall C., et al., "The nucleoplasmin nuclear location sequence is larger and more complex than that of SV-40 large T antigen". *J Cell Biol.* (1988) 107 (3): 841-9; Makkerh J. P., et al., "Comparative mutagenesis of nuclear localization signals reveals the importance of neutral and acidic amino acids". *Curr Biol.* (1996) 6 (8): 1025-7; and Ray M., et al., "Quantitative tracking of protein trafficking to the nucleus using cytosolic protein delivery by nanoparticle-stabilized nanocapsules". *Bioconjug. Chem.* (2015) 26 (6): 1004-7; the entire contents of each are incorporated by reference herein. Additional nuclear localization sequences are described, for example, in Plank et al., PCT/EP2000/011690, the entire contents are incorporated by reference herein. In some embodiments, a NLS comprises the amino acid sequence PKKKRKV (SEQ ID NO: 299) or MDSLLMNRRKFLYQFKNVRWAKGRRETYLC (SEQ ID NO: 300).

Exemplary features that may be present are localization sequences, such as nuclear localization sequences, cytoplasmic localization sequences, export sequences, such as nuclear export sequences, or other localization sequences, as well as sequence tags that are useful for solubilization, purification, or detection of the fusion proteins. Suitable localization signal sequences and sequences of protein tags are provided herein, and include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art and are within the scope of this disclosure.

Any of the nuclear localization sequences provided herein may be fused to the fusion protein in any suitable localization. For example, to promote translocation of the fusion protein into a cell nucleus without compromising function of the fusion protein. In some embodiments, the NLS is fused N-terminal to the Cas9 protein of the fusion protein. In some embodiments, the NLS is fused C-terminal to the Cas9 protein of the fusion protein. In some embodiments, the NLS is fused N-terminal to the effector domain of the fusion protein. In some embodiments, the NLS is fused C-terminal to the effector domain of the fusion protein.

In some embodiments, the effector domain is a deaminase. For example, in some embodiments, the general architecture of exemplary Cas9 fusion proteins with a deaminase domain comprises the structure:

[NH$_2$]-[NLS]-[Cas9]-[deaminase]-[COOH],
[NH$_2$]-[NLS]-[deaminase]-[Cas9]-[COOH],
[NH$_2$]-[Cas9]-[NLS]-[deaminase]-[COOH],
[NH$_2$]-[deaminase]-[NLS]-[Cas9]-[COOH],
[NH$_2$]-[deaminase]-[Cas9]-[NLS]-[COOH], or
[NH$_2$]-[Cas9]-[deaminase]-[NLS]-[COOH], wherein NLS is a nuclear localization signal, NH$_2$ is the N-terminus of the fusion protein, and COOH is the C-terminus of the fusion protein. In some embodiments, a linker is inserted between the Cas9 protein and the deaminase domain. In some embodiments, any of the "]-[" may be one or more linkers. In some embodiments, the NLS is located C-terminal of the deaminase and/or the Cas9 domain. In some embodiments, the NLS is located between the deaminase and the Cas9 domain. Additional features, such as sequence tags, may also be present.

One exemplary suitable type of effector domain includes cytosine deaminases, for example, of the APOBEC family. The apolipoprotein B mRNA-editing complex (APOBEC) family of cytosine deaminase enzymes encompasses eleven proteins that serve to initiate mutagenesis in a controlled and beneficial manner.[29] One family member, activation-induced cytidine deaminase (AID), is responsible for the maturation of antibodies by converting cytosines in ssDNA to uracils in a transcription-dependent, strand-biased fashion.[30] The apolipoprotein B editing complex 3 (APOBEC3) enzyme provides protection to human cells against a certain HIV-1 strain via the deamination of cytosines in reverse-transcribed viral ssDNA.[31] These proteins all require a Zn$^{2+}$-coordinating motif (His-X-Glu-X$_{23-26}$-Pro-Cys-X$_{2-4}$-Cys; SEQ ID NO: 283) and bound water molecule for catalytic activity. The Glu residue acts to activate the water molecule to a zinc hydroxide for nucleophilic attack in the deamination reaction. Each family member preferentially deaminates at its own particular "hotspot," ranging from WRC (W is A or T, R is A or G) for hAID, to TTC for hAPOBEC3F.[32] A recent crystal structure of the catalytic domain of APOBEC3G revealed a secondary structure comprised of a five-stranded β-sheet core flanked by six α-helices, which is believed to be conserved across the entire family.[33] The active center loops have been shown to be responsible for both ssDNA binding and in determining "hotspot" identity.[34] Overexpression of these enzymes has been linked to genomic instability and cancer, thus highlighting the importance of sequence-specific targeting.

Some aspects of this disclosure provide a systematic series of fusions between Cas9 and deaminase domains, e.g., cytosine deaminase enzymes such as APOBEC enzymes, or adenosine deaminase enzymes such as ADAT enzymes, that has been generated in order to direct the enzymatic activities of these deaminases to a specific site in genomic DNA. The advantages of using Cas9 as the recognition agent are two-fold: (1) the sequence specificity of Cas9 can be easily altered by simply changing the sgRNA sequence; and (2) Cas9 binds to its target sequence by denaturing the dsDNA, resulting in a stretch of DNA that is single-stranded and therefore a viable substrate for the deaminase. It will be understood that other catalytic domains, or catalytic domains from other deaminases, can also be used to generate fusion proteins with Cas9, and that the disclosure is not limited in this regard.

Some aspects of this disclosure are based on the recognition that cas9:deaminase fusion proteins can efficiently deaminate nucleotides at positions 3-11 according to the numbering scheme in FIG. 11. It should be appreciated that a person of skill in the art will be able to design suitable guide RNAs to target the fusion proteins to a target sequence that comprises a nucleotide to be deaminated. Both PAM-dependent Cas9 proteins or Cas9 proteins that can target PAM-less target sequences as provided herein, can be employed for deamination of a target nucleotide.

Some exemplary suitable nucleic-acid editing domains, e.g., deaminases and deaminase domains, that can be fused to Cas9 domains according to aspects of this disclosure are provided below. Typically, deaminase require a $Zn^{2+}$-coordinating motif (His-X-Glu-$X_{23-26}$-Pro-Cys-$X_{2-4}$-Cys; SEQ ID NO: 283) and bound water molecule for catalytic activity. The Glu residue acts to activate the water molecule to a zinc hydroxide for nucleophilic attack in the deamination reaction. It will be understood that, in some embodiments, the active domain of the respective sequence can be used, e.g., the domain without a localizing signal (nuclear localizing signal, without nuclear export signal, cytoplasmic localizing signal).

```
Human AID:
                                    (SEQ ID NO: 263)
MDSLLMNRRKFLYQFKNVRWAKGRRETYLCYVVKRRDSATSFSLDFGYL

RNKNGCHVELLFLRYISDWDLDPGRCYRVTWFTSWSPCYDCARHVADFL

RGNPNLSLRIFTARLYFCEDRKAEPEGLRRLHRAGVQIAIMTFKDYFYC

WNTFVENHERTFKAWEGLHENSVRLSRQLRRILLPLYEVDDLRDAFRTL

GL (underline: nuclear localization signal; double
underline: nuclear export signal)

Mouse AID:
                                    (SEQ ID NO: 264)
MDSLLMKQKKFLYHFKNVRWAKGRHETYLCYVVKRRDSATSCSLDFGHL

RNKSGCHVELLFLRYISDWDLDPGRCYRVTWFTSWSPCYDCARHVAEFL

RWNPNLSLRIFTARLYFCEDRKAEPEGLRRLHRAGVQIGIMTFKDYFYC

WNTFVENRERTFKAWEGLHENSVRLTRQLRRILLPLYEVDDLRDAFRML

GF (underline: nuclear localization signal; double
underline: nuclear export signal)

Dog AID:
                                    (SEQ ID NO: 265)
MDSLLMKQRKFLYHFKNVRWAKGRHETYLCYVVKRRDSATSFSLDFGHL

RNKSGCHVELLFLRYISDWDLDPGRCYRVTWFTSWSPCYDCARHVADFL

RGYPNLSLRIFAARLYFCEDRKAEPEGLRRLHRAGVQIAIMTFKDYFYC

WNTFVENREKTFKAWEGLHENSVRLSRQLRRILLPLYEVDDLRDAFRTL

GL
```

```
(underline: nuclear localization signal; double
underline: nuclear export signal)

Bovine AID:
                                    (SEQ ID NO: 266)
MDSLLKKQRQFLYQFKNVRWAKGRHETYLCYVVKRRDSPTSFSLDFGHL

RNKAGCHVELLFLRYISDWDLDPGRCYRVTWFTSWSPCYDCARHVADFL

RGYPNLSLRIFTARLYFCDKERKAEPEGLRRLHRAGVQIAIMTFKDYFY

CWNTFVENHERTFKAWEGLHENSVRLSRQLRRILLPLYEVDDLRDAFRT

LGL (underline: nuclear localization signal; double
underline: nuclear export signal)

Mouse APOBEC-3:
                                    (SEQ ID NO: 267)
MGPFCLGCSHRKCYSPIRNLISQETFKFHFKNLGYAKGRKDTFLCYEVT

RKDCDSPVSLHHGVFKNKDNI HAEICFLYWFHDKVLKVLSPREEFKITW

YMSWSPCFECAEQIVRFLATHHNLSLDIFSSRLYNVQDPETQQNLCRLV

QEGAQVAAMDLYEFKKCWKKFVDNGGRRFRPWKRLLTNFRYQDSKLQEI

LRPCYIPVPSSSSSTLSNICLTKGLPETRFCVEGRRMDPLSEEEFYSQF

YNQRVKHLCYYHRMKPYLCYQLEQFNGQAPLKGCLLSEKGKQHAEILFL

DKIRSMELSQVTITCYLTWSPCPNCAWQLAAFKRDRPDLILHIYTSRLY

FHWKRPFQKGLCSLWQSGILVDVMDLPQFTDCWTNFVNPKRPFWPWKGL

EIISRRTQRRLRRIKESWGLQDLVNDFGNLQLGPPMS (italic: nucleic acid editing domain)

Rat APOBEC-3:
                                    (SEQ ID NO: 268)
MGPFCLGCSHRKCYSPIRNLISQETFKFHFKNLRYAIDRKDTFLCYEVT

RKDCDSPVSLHHGVFKNKDNI HAEICFLYWFHDKVLKVLSPREEFKITW

YMSWSPCFECAEQVLRFLATHHNLSLDIFSSRLYNIRDPENQQNLCRLV

QEGAQVAAMDLYEFKKCWKKFVDNGGRRFRPWKKLLTNFRYQDSKLQEI

LRPCYIPVPSSSSSTLSNICLTKGLPETRFCVERRRVHLLSEEEFYSQF

YNQRVKHLCYYHGVKPYLCYQLEQFNGQAPLKGCLLSEKGKQHAEILFL

DKIRSMELSQVIITCYLTWSPCPNCAWQLAAFKRDRPDLILHIYTSRLY

FHWKRPFQKGLCSLWQSGILVDVMDLPQFTDCWTNFVNPKRPFWPWKGL

EIISRRTQRRLHRIKESWGLQDLVNDFGNLQLGPPMS (italic: nucleic acid editing domain)

Rhesus macaque APOBEC-3G:
                                    (SEQ ID NO: 269)
MVEPMDPRTFVSNFNNRPILSGLNTVWLCCEVKTKDPSGPPLDAKIFQG

KVYSKAKYHPEMRFLRWFHKWRQLHHDQEYKVTWYVSWSPCTRCANSVA

TFLAKDPKVTLTIFVARLYYFWKPDYQQALRILCQKRGGPHATMKIMNY

NEFQDCWNKFVDGRGKPFKPRNNLPKHYTLLQATLGELLRHLMDPGTFT

SNFNNKPWVSGQHETYLCYKVERLHNDTWVPLNQHRGFLRNQAPNIFIG

FPKGRHAELCFLDHPFWKLDGQQYRVTCFTSWSPCFSCAQEMAKFISNN

EHVSLCIFAARIYDDQGRYQEGLRALHRDGAKIAMMNYSEFEYCWDTFV

DRQGRPFQPWDGLDEHSQALSGRLRAI
```

(italic: nucleic acid editing domain; underline: cytoplasmic localization signal)

Chimpanzee APOBEC-3G:
(SEQ ID NO: 270)
<u>MKPHFRNPVERMYQDTFSDNFYNRPILSHRNTVWLCYEVKTKGPSRPPL</u>
<u>DAKIFRGQVYSKLKY</u>*HPEAIRFFHWFSKWRKLHRDQEYEVTWYISWSPC*
*TKC*TRDVATFLAEDPKVTLTIFVARLYYFWDPDYQEALRSLCQKRDGPR
ATMKIMNYDEFQHCWSKFVYSQRELFEPWNNLPKYYILLHIMLGEILRH
SMDPPTFTSNFNNELWVRGRHETYLCYEVERLHNDTWVLLNQRRGFLCN
QAPHKHGFLEGR*HAELCFLDVIPFWKLDLHQDYRVTCFTSWSPCFSCAQ*
EMAKFISNNKHVSLCIFAARIYDDQGRCQEGLRTLAKAGAKISIMTYSE
FKHCWDTFVDHQGCPFQPWDGLEEHSQALSGRLRAILQNQGN (italic: nucleic acid editing domain; underline: cytoplasmic localization signal)

Green monkey APOBEC-3G:
(SEQ ID NO: 271)
<u>MNPQIRNMVEQMEPDIFVYYFNNRPILSGRNTVWLCYEVKTKDPSGPPL</u>
<u>DANIFQGKLYPEAKD</u>*HPEMKFLHWFRKWRQLHRDQEYEVTWYVSWSPCT*
*RC*ANSVATFLAEDPKVTLTIFVARLYYFWKPDYQQALRILCQERGGPHA
TMKIMNYNEFQHCWNEFVDGQGKPFKPRKNLPKHYTLLHATLGELLRHV
MDPGTFTSNFNNKPWVSGQRETYLCYKVERSHNDTWVLLNQHRGFLRNQ
APDRHGFPKGR*HAELCFLDHPFWKLDDQQYRVTCFTSWSPCFSCAQKMA*
KFISNNKHVSLCIFAARIYDDQGRCQEGLRTLHRDGAKIAVMNYSEFEY
CWDTFVDRQGRPFQPWDGLDEHSQALSGRLRAI (italic: nucleic acid editing domain; underline: cytoplasmic localization signal)

Human APOBEC-3G:
(SEQ ID NO: 272)
<u>MKPHFRNTVERMYRDTFSYNFYNRPILSRRNTVWLCYEVKTKGPSRPPL</u>
<u>DAKIFRGQVYSELKY</u>*HPEMRFFHWFSKWRKLHRDQEYEVTWYISWSPCT*
*KC*TRDMATFLAEDPKVTLTIFVARLYYFWDPDYQEALRSLCQKRDGPRA
TMKIMNYDEFQHCWSKFVYSQRELFEPWNNLPKYYILLHIMLGEILRHS
MDPPTFTFNFNNEPWVRGRHETYLCYEVERMHNDTWVLLNQRRGFLCNQ
APHKHGFLEGR*HAELCFLDVIPFWKLDLDQDYRVTCFTSWSPCFSCAQE*
MAKFISKNKHVSLCIFTARIYDDQGRCQEGLRTLAEAGAKISIMTYSEF
KHCWDTFVDHQGCPFQPWDGLDEHSQDLSGRLRAILQNQEN (italic: nucleic acid editing domain; underline: cytoplasmic localization signal)

Human APOBEC-3F:
(SEQ ID NO: 273)
MKPHFRNTVERMYRDTFSYNFYNRPILSRRNTVWLCYEVKTKGPSRPRL
DAKIFRGQVYSQPEH*HAEMCFLSWFCGNQLPAYKCFQITWFVSWTPCPD*
*CV*AKLAEFLAEHPNVTLTISAARLYYWERDYRRALCRLSQAGARVKIM
DDEEFAYCWENFVYSEGQPFMPWYKFDDNYAFLHRTLKEILRNPMEAMY
PHIFYFHFKNLRKAYGRNESWLCFTMEVVKHHSPVSWKRGVFRNQVDPE THC*HAERCFLSWFCDDILSPNTNYEVTWYTSWSPCPEC*AGEVAEFLARH
SNVNLTIFTARLYYFWDTDYQEGLRSLSQEGASVEIIVIGYKDFKYCWE
NFVYNDDEPFKPWKGLKYNFLFLDSKLQEILE (italic: nucleic acid editing domain)

Human APOBEC-3B:
(SEQ ID NO: 274)
MNPQIRNPMERMYRDTFYDNFENEPILYGRSYTWLCYEVKIKRGRSNLL
WDTGVFRGQVYFKPQY*HAEMCFLSWFCGNQLPAYKCFQITWFVSWTPCP*
*DCV*AKLAEFLSEHPNVTLTISAARLYYWERDYRRALCRLSQAGARVTI
MDYEEFAYCWENFVYNEGQQFMPWYKFDENYAFLHRTLKEILRYLMDPD
TFTFNFNNDPLVLRRRQTYLCYEVERLDNGTWVLMDQHMGFLCNEAKNL
LCGFY*GRHAELRFLDLVPSLQLDPAQIYRVTWFISWSPCFSWGC*AGEVR
AFLQENTHVRLRIFAARIYDYDPLYKEALQMLRDAGAQVSIIVITYDEF
EYCWDTFVYRQGCPFQPWDGLEEHSQALSGRLRAILQNQGN (italic: nucleic acid editing domain)

Human APOBEC-3C:
(SEQ ID NO: 275)
MNPQIRNPMKAMYPGTFYFQFKNLWEANDRNETWLCFTVEGIKRRSVVS
WKTGVFRNQVDSETH*CHAERCFLSWFCDDILSPNTKYQVTWYTSWSPCP*
*DC*AGEVAEFLARHSNVNLTIFTARLYYFQYPCYQEGLRSLSQEGVAVEI
MDYEDFKYCWENFVYNDNEPFKPWKGLKTNFRLLKRRLRESLQ (italic: nucleic acid editing domain)

Human APOBEC-3A:
(SEQ ID NO: 276)
MEASPASGPRHLMDPHIFTSNFNNGIGREIKTYLCYEVERLDNGTSVKM
DQHRGFLHNQAKNLLCGFYGR*HAELRFLDLVPSLQLDPAQIYRVTWFIS*
*WSPCFSWGC*AGEVRAFLENTHVRLRIFAARIYDYDPLYKEALQMLRDAG
AQVSIMTYDEFKHCWDTFVDHQGCPFQPWDGLDEHSQALSGRLRAILQN
QGN (italic: nucleic acid editing domain)

Human APOBEC-3H:
(SEQ ID NO: 277)
MALLTAETFRLQFNNKRRLRRPYYPRKALLCYQLTPQNGSTPTRGYFEN
KKKC*HAEICFINEIKSMGLDETQCYQVTCYLTWSPCSSC*AWELVDFIKA
HDHLNLGIFASRLYYHWKPQQKGLRLLCGSQVPVEVMGFPKFADCWENF
VDHEKPLSFNPYKMLEELDKNSRAIKRRLERIKIPGVRAQGRYMDILCD
AEV (italic: nucleic acid editing domain)

Human APOBEC-3D:
(SEQ ID NO: 278)
MNPQIRNPMERMYRDTFYDNFENEPILYGRSYTWLCYEVKIKRGRSNLL
WDTGVFRGPVLPKRQSNHRQEVYFRFEN*HAEMCFLSWFCGNRLPANRRF*
*QITWFVSWNPCLPCV*VKVTKFLAEHPNVTLTISAARLYYYRDRDWRWVL
LRLHKAGARVKIMDYEDFAYCWENFVCNEGQPFMPWYKFDDNYASLHRT
LKEILRNPMEAMYPHIFYFHPKNLLKACGRNESWLCFTMEVTKHHSAVF -continued

RKRGVFRNQVDPETHC*HAERCFLSWFCDDILSPNTNYEVTWYTSWSPCP*

*ECA*GEVAEFLARHSNVNLTIFTARLCYFWDTDYQEGLCSLSQEGASVKI

IVIGYKDFVSCWKNFVYSDDEPFKPWKGLQTNFRLLKRRLREILQ (italic: nucleic acid editing domain)

Human APOBEC-1:

(SEQ ID NO: 279)
MTSEKGPSTGDPTLRRRIEPWEFDVFYDPRELRKEACLLYEIKWGMSRK

IWRSSGKNTTNHVEVNFIKKFTSERDFHPSMSCSITWFLSWSPCWECSQ

AIREFLSRHPGVTLVIYVARLFWHMDQQNRQGLRDLVNSGVTIQIMRAS

EYYHCWRNFVNYPPGDEAHWPQYPPLWM MLYALELHCI1LSLPPCLKI

SRRWQNHLTFFRLHLQNCHYQTIPPHILLATGLIHPSVAWR

Mouse APOBEC-1:

(SEQ ID NO: 280)
MSSETGPVAVDPTLRRRIEPHEFEVFFDPRELRKETCLLYEINWGGRHS

VWRHTSQNTSNHVEVNFLEKFTTERYFRPNTRCSITWFLSWSPCGECSR

AITEFLSRHPYVTLFIYIARLYHHTDQRNRQGLRDLISSGVTIQIIVIT

EQEYCYCWRNFVNYPPSNEAYWPRYPHLWVKLYVLELYCIILGLPPCLK

ILRRKQPQLTFFTITLQTCHYQRIPPHLLWATGLK

Rat APOBEC-1:

(SEQ ID NO: 281)
MSSETGPVAVDPTLRRRIEPHEFEVFFDPRELRKETCLLYEINWGGRHS

IWRHTSQNTNKHVEVNFIEKFTTERYFCPNTRCSITWFLSWSPCGECSR

AITEFLSRYPHVTLFIYIARLYHHADPRNRQGLRDLISSGVTIQIIVIT

EQESGYCWRNFVNYSPSNEAHWPRYPHLWVRLYVLELYCIILGLPPCLN

ILRRKQPQLTFFTIALQSCHYQRLPPHILWATGLK

In some embodiments, fusion proteins as provided herein comprise the full-length amino acid of a effector domain, e.g., one of the sequences provided above. In other embodiments, however, fusion proteins as provided herein do not comprise a full-length sequence of a effector domain, but only a fragment thereof. For example, in some embodiments, a fusion protein provided herein comprises a Cas9 protein and a fragment of a effector domain, e.g., wherein the fragment comprises a effector domain. Exemplary amino acid sequences of effector domains are shown in the sequences above as italicized letters, and additional suitable sequences of such domains will be apparent to those of skill in the art.

Additional suitable nucleic-acid editing domain, e.g., deaminase domain sequences, that can be used according to aspects of this disclosure, e.g., that can be fused to a nuclease-inactive Cas9 protein, will be apparent to those of skill in the art based on this disclosure. In some embodiments, such additional domain sequences include deaminase domain sequences that are at least 70%, at least 75%, at least 80%, at least 85%, at least 90%, at least 95%, at least 96%, at least 97%, at least 98%, or at least 99% similar to the sequences provided herein. Additional suitable Cas9 proteins, variants, and sequences will also be apparent to those of skill in the art. Examples of such additional suitable Cas9 proteins include, but are not limited to Cas9 proteins with the following mutations: D10A, D10A/D839A/H840A, and D10A/D839A/H840A/N863A (See, e.g., Prashant et al., CAS9 transcriptional activators for target specificity screening and paired nickases for cooperative genome engineering. Nature Biotechnology. 2013; 31(9): 833-838 the entire contents of which are incorporated herein by reference).

Additional suitable strategies for generating fusion proteins comprising a Cas9 protein and an effector domain, such as a DNA-editing domain, will be apparent to those of skill in the art based on this disclosure in combination with the general knowledge in the art. Suitable strategies for generating fusion proteins according to aspects of this disclosure using linkers or without the use of linkers will also be apparent to those of skill in the art in view of the instant disclosure and the knowledge in the art. For example, Gilbert et al., CRISPR-mediated modular RNA-guided regulation of transcription in eukaryotes. Cell. 2013; 154 (2):442-51, showed that C-terminal fusions of Cas9 with VP64 using 2 NLS's as a linker (SPKKKRKVEAS, SEQ ID NO: 284), can be employed for transcriptional activation. Mali et al., Cas9 transcriptional activators for target specificity screening and paired nickases for cooperative genome engineering. Nat Biotechnol. 2013; 31(9):833-8, reported that C-terminal fusions with VP64 without linker can be employed for transcriptional activation. And Maeder et al., CRISPR RNA-guided activation of endogenous human genes. Nat Methods. 2013; 10: 977-979, reported that C-terminal fusions with VP64 using a Gly$_4$Ser (SEQ ID NO: 5) linker can be used as transcriptional activators. Recently, dCas9-FokI nuclease fusions have successfully been generated and exhibit improved enzymatic specificity as compared to the parental Cas9 enzyme (In Guilinger J P, Thompson D B, Liu D R. Fusion of catalytically inactive Cas9 to FokI nuclease improves the specificity of genome modification. Nat. Biotechnol. 2014; 32(6):577-82, and in Tsai S Q, Wyvekens N, Khayter C, Foden J A, Thapar V, Reyon D, Goodwin M J, Aryee M J, Joung J K. Dimeric CRISPR RNA-guided FokI nucleases for highly specific genome editing. Nat. Biotechnol. 2014; 32(6):569-76. PMID: 24770325 a SGSETPGTSESATPES (SEQ ID NO: 7) or a GGGGS (SEQ ID NO: 5) linker was used in FokI-dCas9 fusion proteins, respectively).

In some embodiments, the Cas9 fusion protein comprises: (i) Cas9 protein; and (ii) a transcriptional activator domain. In some embodiments, the transcriptional activator domain comprises a VPR. VPR is a VP64-SV40-P65-RTA tripartite activator. In some embodiments, VPR comprises a VP64 amino acid sequence encoded by the nucleic acid sequence of SEQ ID NO: 292:

(SEQ ID NO: 292)
GAGGCCAGCGGTTCCGGACGGGCTGACGCATTGGACGATTTTGATCTGGA

TATGCTGGGAAGTGACGCCCTCGATGATTTTGACCTTGACATGCTTGGTT

CGGATGCCCTTGATGACTTTGACCTCGACATGCTCGGCAGTGACGCCCTT

GATGATTTCGACCTGGACATGCTGATTAACTCTAGATAG

In some embodiments, VPR comprises a VP64 amino acid sequence as set forth in SEQ ID NO: 293:

(SEQ ID NO: 293)
EASGSGRADALDDFDLDMLGSDALDDFDLDMLGSDALDDFDLDMLGSDAL

DDFDLDMLINSR

In some embodiments, VPR comprises a VP64-SV40-P65-RTA amino acid sequence encoded by the nucleic acid sequence of SEQ ID NO: 294:

(SEQ ID NO: 294)
TCGCCAGGGATCCGTCGACTTGACGCGTTGATATCAACAAGTTTGTACAA

AAAAGCAGGCTACAAAGAGGCCAGCGGTTCCGGACGGGCTGACGCATTGG

ACGATTTTGATCTGGATATGCTGGGAAGTGACGCCCTCGATGATTTTGAC

CTTGACATGCTTGGTTCGGATGCCCTTGATGACTTTGACCTCGACATGCT

CGGCAGTGACGCCCTTGATGATTTCGACCTGGACATGCTGATTAACTCTA

GAAGTTCCGGATCTCCGAAAAAGAAACGCAAAGTTGGTAGCCAGTACCTG

CCCGACACCGACGACCGGCACCGGATCGAGGAAAAGCGGAAGCGGACCTA

CGAGACATTCAAGAGCATCATGAAGAAGTCCCCCTTCAGCGGCCCCACCG

ACCCTAGACCTCCACCTAGAAGAATCGCCGTGCCCAGCAGATCCAGCGCC

AGCGTGCCAAAACCTGCCCCCCAGCCTTACCCCTTCACCAGCAGCCTGAG

CACCATCAACTACGACGAGTTCCCTACCATGGTGTTCCCCAGCGGCCAGA

TCTCTCAGGCCTCTGCTCTGGCTCCAGCCCCTCCTCAGGTGCTGCCTCAG

GCTCCTGCTCCTGCACCAGCTCCAGCCATGGTGTCTGCACTGGCTCAGGC

ACCAGCACCCGTGCCTGTGCTGGCTCCTGGACCTCCACAGGCTGTGGCTC

CACCAGCCCCTAAACCTACACAGGCCGGCGAGGGCACACTGTCTGAAGCT

CTGCTGCAGCTGCAGTTCGACGACGAGGATCTGGGAGCCCTGCTGGGAAA

CAGCACCGATCCTGCCGTGTTCACCGACCTGGCCAGCGTGGACAACAGCG

AGTTCCAGCAGCTGCTGAACCAGGGCATCCCTGTGGCCCCTCACACCACC

GAGCCCATGCTGATGGAATACCCCGAGGCCATCACCCGGCTCGTGACAGG

CGCTCAGAGGCCTCCTGATCCAGCTCCTGCCCCTCTGGGAGCACCAGGCC

TGCCTAATGGACTGCTGTCTGGCGACGAGGACTTCAGCTCTATCGCCGAT

ATGGATTTCTCAGCCTTGCTGGGCTCTGGCAGCGGCAGCCGGGATTCCAG

GGAAGGGATGTTTTTGCCGAAGCCTGAGGCCGGCTCCGCTATTAGTGACG

TGTTTGAGGGCCGCGAGGTGTGCCAGCCAAAACGAATCCGGCCATTTCAT

CCTCCAGGAAGTCCATGGGCCAACCGCCCACTCCCCGCCAGCCTCGCACC

AACACCAACCGGTCCAGTACATGAGCCAGTCGGGTCACTGACCCCGGCAC

CAGTCCCTCAGCCACTGGATCCAGCGCCCGCAGTGACTCCCGAGGCCAGT

CACCTGTTGGAGGATCCCGATGAAGAGACGAGCCAGGCTGTCAAAGCCCT

TCGGGAGATGGCCGATACTGTGATTCCCCAGAAGGAAGAGGCTGCAATCT

GTGGCCAAATGGACCTTTCCCATCCGCCCCAAGGGGCCATCTGGATGAG

CTGACAACCACACTTGAGTCCATGACCGAGGATCTGAACCTGGACTCACC

CCTGACCCCGGAATTGAACGAGATTCTGGATACCTTCCTGAACGACGAGT

GCCTCTTGCATGCCATGCATATCAGCACAGGACTGTCCATCTTCGACACA

TCTCTGTTTTGA

In some embodiments, VPR comprises a VP64-SV40-P65-RTA amino acid sequence as set forth in SEQ ID NO: 295:

(SEQ ID NO: 295)
SPGIRRLDALISTSLYKKAGYKEASGSGRADALDDFDLDMLGSDALDDFD

LDMLGSDALDDFDLDMLGSDALDDFDLDMLINSRSSGSPKKKRKVGSQYL

PDTDDRHRIEEKRKRTYETFKSIMKKSPFSGPTDPRPPPRRIAVPSRSSA

SVPKPAPQPYPFTSSLSTINYDEFPTMVFPSGQISQASALAPAPPQVLPQ

APAPAPAPAMVSALAQAPAPVPVLAPGPPQAVAPPAPKPTQAGEGTLSEA

LLQLQFDDEDLGALLGNSTDPAVFTDLASVDNSEFQQLLNQGIPVAPHTT

EPMLMEYPEAITRLVTGAQRPPDPAPAPLGAPGLPNGLLSGDEDFSSIAD

MDFSALLGSGSGSRDSREGMFLPKPEAGSAISDVFEGREVCQPKRIRPFH

PPGSPWANRPLPASLAPTPTGPVHEPVGSLTPAPVPQPLDPAPAVTPEAS

HLLEDPDEETSQAVKALREMADTVIPQKEEAAICGQMDLSHPPPRGHLDE

LTTTLESMTEDLNLDSPLTPELNEILDTFLNDECLLHAMHISTGLSIFDT

SLF

Some aspects of this disclosure provide fusion proteins comprising a transcription activator. In some embodiments, the transcriptional activator is VPR. In some embodiments, the VPR comprises a wild type VPR or a VPR as set forth in SEQ ID NO: 293. In some embodiments, the VPR proteins provided herein include fragments of VPR and proteins homologous to a VPR or a VPR fragment. For example, in some embodiments, a VPR comprises a fragment of the amino acid sequence set forth in SEQ ID NO: 293. In some embodiments, a VPR comprises an amino acid sequence homologous to the amino acid sequence set forth in SEQ ID NO: 293 or an amino acid sequence homologous to a fragment of the amino acid sequence set forth in SEQ ID NO: 293. In some embodiments, proteins comprising VPR or fragments of VPR or homologs of VPR or VPR fragments are referred to as "VPR variants." A VPR variant shares homology to VPR, or a fragment thereof. For example a VPR variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% to a wild type VPR or a VPR as set forth in SEQ ID NO: 293. In some embodiments, the VPR variant comprises a fragment of VPR, such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% to the corresponding fragment of wild type VPR or a VPR as set forth in SEQ ID NO: 293. In some embodiments, the VPR comprises the amino acid sequence set forth in SEQ ID NO: 293. In some embodiments, the VPR comprises an amino acid sequence encoded by the nucleotide sequence set forth in SEQ ID NO: 292.

In some embodiments, a VPR is a VP64-SV40-P65-RTA triple activator. In some embodiments, the VP64-SV40-P65-RTA comprises a VP64-SV40-P65-RTA as set forth in SEQ ID NO: 295. In some embodiments, the VP64-SV40-P65-RTA proteins provided herein include fragments of VP64-SV40-P65-RTA and proteins homologous to a VP64-SV40-

P65-RTA or a VP64-SV40-P65-RTA fragment. For example, in some embodiments, a VP64-SV40-P65-RTA comprises a fragment of the amino acid sequence set forth in SEQ ID NO: 295. In some embodiments, a VP64-SV40-P65-RTA comprises an amino acid sequence homologous to the amino acid sequence set forth in SEQ ID NO: 295 or an amino acid sequence homologous to a fragment of the amino acid sequence set forth in SEQ ID NO: 295. In some embodiments, proteins comprising VP64-SV40-P65-RTA or fragments of VP64-SV40-P65-RTA or homologs of VP64-SV40-P65-RTA or VP64-SV40-P65-RTA fragments are referred to as "VP64-SV40-P65-RTA variants." A VP64-SV40-P65-RTA variant shares homology to VP64-SV40-P65-RTA, or a fragment thereof. For example a VP64-SV40-P65-RTA variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% to a VP64-SV40-P65-RTA as set forth in SEQ ID NO: 295. In some embodiments, the VP64-SV40-P65-RTA variant comprises a fragment of VP64-SV40-P65-RTA, such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% to the corresponding fragment of a VP64-SV40-P65-RTA as set forth in SEQ ID NO: 295. In some embodiments, the VP64-SV40-P65-RTA comprises the amino acid sequence set forth in SEQ ID NO: 295. In some embodiments, the VP64-SV40-P65-RTA comprises an amino acid sequence encoded by the nucleotide sequence set forth in SEQ ID NO: 294.

Some aspects of this disclosure provide fusion proteins comprising (i) a Cas9 protein; and (ii) a effector domain. In some aspects, the fusion proteins provided herein further include (iii) a DNA-binding protein, for example, a zinc-finger domain, a TALE, or a second Cas9 protein. Without wishing to be bound by any particular theory, fusing a DNA-binding protein (e.g., a second Cas9 protein) to a fusion protein comprising (i) a protein; and (ii) a effector domain may be useful for improving specificity of the fusion protein to a target nucleic acid sequence, or for improving specificity or binding affinity of the fusion protein to bind a target nucleic acid sequence that does not contain the canonical PAM (5'-NGG-3') sequence. In some embodiments, the second Cas9 protein is any of the Cas9 proteins provided herein. In some embodiments, the second Cas9 protein is fused to the fusion protein N-terminal to the Cas9 protein. In some embodiments, the second Cas9 protein is fused to the fusion protein C-terminal to the Cas9 protein. In some embodiments, the Cas9 protein and the second Cas9 protein are fused via a linker.

Further provided herein are complexes comprising any of the fusion proteins provided herein, a first guide RNA bound to the Cas9 protein of the fusion protein, and a second guide RNA bound to the second Cas9 protein of the fusion protein. In some embodiments, the first guide RNA is about 15-100 nucleotides long and comprises a sequence of at least 10 contiguous nucleotides that is complementary to a first target sequence and the second guide RNA is about 15-100 nucleotides long and comprises a sequence of at least 10 contiguous nucleotides that is complementary to a second target sequence. In some embodiments, the first guide RNA and/or the second guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the first guide RNA and the second guide RNA are different. In some embodiments, the first guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a first target sequence, and wherein the second guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a second target sequence. In some embodiments, the first target sequence and the second target sequence are different. In some embodiments, the first target sequence and the second target sequence are DNA sequences. In some embodiments, the first target sequence and the second target sequence are in the genome of a mammal. In some embodiments, the first target sequence and the second target sequence are in the genome of a human. In some embodiments, the first target sequence is within 30 nucleotides of the second target sequence. In some embodiments, the 3' end of the first target sequence is not immediately adjacent to the canonical PAM sequence (5'-NGG-3'). In some embodiments, the 3' end of the second target sequence is not immediately adjacent to the canonical PAM sequence (5'-NGG-3').

In some embodiments, the general architecture of exemplary Cas9 fusion proteins provided herein is of the structure:

[NH$_2$]-[effector domain]-[Cas9]-[second Cas9 protein]-[COOH];

[NH$_2$]-[second Cas9 protein]-[Cas9]-[effector domain]-[COOH];

[NH$_2$]-[Cas9]-[effector domain]-[second Cas9 protein]-[COOH];

[NH$_2$]-[second Cas9 protein]-[effector or domain]-[Cas9]-[COOH];

[NH$_2$]-[UGI]-[effector domain]-[Cas9]-[second Cas9 protein]-[COOH];

[NH$_2$]-[UGI]-[second Cas9 protein]-[Cas9]-[effector domain]-[COOH];

[NH$_2$]-[UGI]-[Cas9]-[effector domain]-[second Cas9 protein]-[COOH];

[NH$_2$]-[UGI]-[second Cas9 protein]-[effector domain]-[Cas9]-[COOH];

[NH$_2$]-[effector domain]-[Cas9]-[second Cas9 protein]-[UGI]-[COOH];

[NH$_2$]-[second Cas9 protein]-[Cas9]-[effector domain]-[UGI]-[COOH];

[NH$_2$]-[Cas9]-[effector domain]-[second Cas9 protein]-[UGI]-[COOH]; or

[NH$_2$]-[second Cas9 protein]-[effector domain]-[Cas9]-[UGI]-[COOH];

wherein NH$_2$ is the N-terminus of the fusion protein, and COOH is the C-terminus of the fusion protein. In some embodiments, the "]-[" used in the general architecture above indicates the presence of an optional linker sequence. In other examples, the general architecture of exemplary Cas9 fusion proteins provided herein is of the structure:

[NH$_2$]-[effector domain]-[Cas9]-[second Cas9 protein]-[COOH];

[NH$_2$]-[second Cas9 protein]-[Cas9]-[effector domain]-[COOH];

[NH$_2$]-[Cas9]-[effector domain]-[second Cas9 protein]-[COOH];

[NH$_2$]-[second Cas9 protein]-[effector domain]-[Cas9]-[COOH];

[NH₂]-[UGI]-[effector domain]-[Cas9]-[second Cas9 protein]-[COOH],

[NH₂]-[UGI]-[second Cas9 protein]-[Cas9]-[effector domain]-[COOH];

[NH₂]-[UGI]-[Cas9]-[effector domain]-[second Cas9 protein]-[COOH];

[NH₂]-[UGI]-[second Cas9 protein]-[effector domain]-[Cas9]-[COOH];

[NH₂]-[effector domain]-[Cas9]-[second Cas9 protein]-[UGI]-[COOH];

[NH₂]-[second Cas9 protein]-[Cas9]-[effector domain]-[UGI]-[COOH];

[NH₂]-[Cas9]-[effector domain]-[second Cas9 protein]-[UGI]-[COOH]; or

Figure 8:
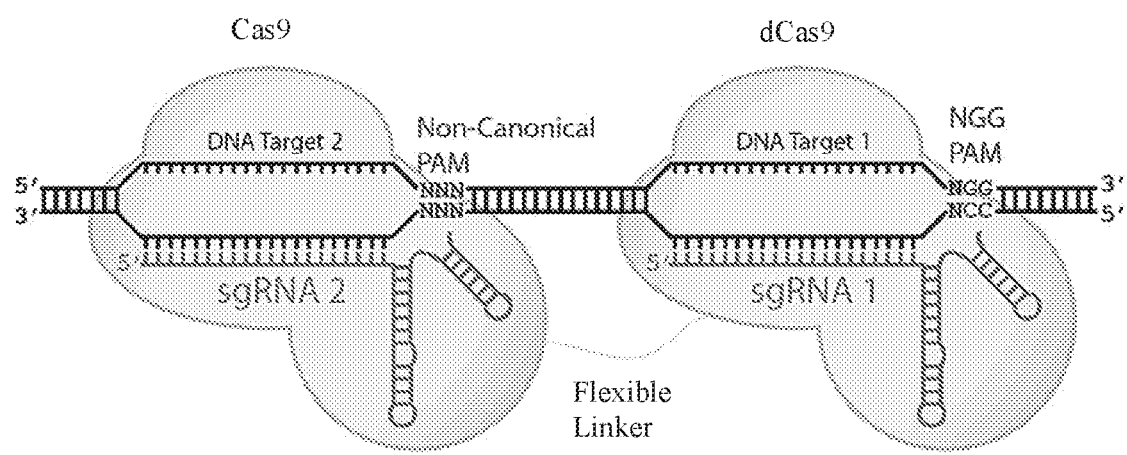
FIG. 8 shows a Cas9 fusion protein that can be used to modulate PAM specificity. One possible configuration for a linked Cas9-dCas9 system that could be used for increasing Cas9 targeting to non-canonical PAMs is shown. dCas9 binding to 5'-NGG-3' or another PAM could localize Cas9 to an area close to target 2. This localization could help Cas9 cut a previously inaccessible PAM.

[NH₂]-[second Cas9 protein]-[effector domain]-[Cas9]-[UGI]-[COOH];

wherein NH₂ is the N-terminus of the fusion protein, and COOH is the C-terminus of the fusion protein. In some embodiments, the "-" used in the general architecture above indicates the presence of an optional linker sequence. In some embodiments, the second Cas9 is a dCas9 protein. In some examples, the general architecture of exemplary Cas9 fusion proteins provided herein comprises a structure as shown in FIG. 8. It should be appreciated that any of the proteins provided in any of the general architectures of exemplary Cas9 fusion proteins may be connected by one or more of the linkers provided herein. In some embodiments, the linkers are the same. In some embodiments, the linkers are different. In some embodiments, one or more of the proteins provided in any of the general architectures of exemplary Cas9 fusion proteins are not fused via a linker. In some embodiments, the fusion proteins further comprise a nuclear targeting sequence, for example a nuclear localization sequence. In some embodiments, fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the second Cas9 protein. In some embodiments, the NLS is fused to the C-terminus of the second Cas9 protein. In some embodiments, the NLS is fused to the N-terminus of the Cas9 protein. In some embodiments, the NLS is fused to the C-terminus of the Cas9 protein. In some embodiments, the NLS is fused to the N-terminus of the effector domain. In some embodiments, the NLS is fused to the C-terminus of the effector domain. In some embodiments, the NLS is fused to the N-terminus of the UGI protein. In some embodiments, the NLS is fused to the C-terminus of the UGI protein. In some embodiments, the NLS is fused to the fusion protein via one or more linkers. In some embodiments, the NLS is fused to the fusion protein without a linker.

Uracil Glycosylase Inhibitor Fusion Proteins

Some aspects of this disclosure provide fusion proteins comprising a Cas9 protein fused to a effector domain, e.g., a deaminase, and a uracil glycosylase inhibitor (UGI). In some embodiments, the fusion protein comprises the structure:

[deaminase]-[optional linker sequence]-[Cas9]-[optional linker sequence]-[UGI];

[deaminase]-[optional linker sequence]-[UGI]-[optional linker sequence]-[Cas9];

[UGI]-[optional linker sequence]-[deaminase]-[optional linker sequence]-[Cas9];

[UGI]-[optional linker sequence]-[Cas9]-[optional linker sequence]-[deaminase];

[Cas9]-[optional linker sequence]-[deaminase]-[optional linker sequence]-[UGI]; or

[Cas9]-[optional linker sequence]-[UGI]-[optional linker sequence]-[deaminase].

In some embodiments, the fusion proteins do not comprise a linker sequence. In some embodiments, one or both of the optional linker sequences are present.

In some embodiments, the fusion protein further comprises a second Cas9 protein. For example, the second Cas9 protein may be any of the Cas9 proteins provided herein. In some embodiments, fusion protein comprises the structure:

[deaminase]-[Cas9]-[UGI]; [deaminase]-[UGI]-[Cas9];
[UGI]-[deaminase]-[Cas9];
[UGI]-[Cas9]-[deaminase];
[Cas9]-[deaminase]-[UGI];
[Cas9]-[UGI]-[deaminase];
[second Cas9]-[deaminase]-[Cas9]-[UGI];
[second Cas9]-[deaminase]-[UGI]-[Cas9];
[second Cas9]-[UGI]-[deaminase]-[Cas9];
[second Cas9]-[UGI]-[Cas9]-[deaminase];
[second Cas9]-[Cas9]-[deaminase]-[UGI];
[second Cas9]-[Cas9]-[UGI]-[deaminase];
[deaminase]-[second Cas9]-[Cas9]-[UGI];
[deaminase]-[second Cas9]-[UGI]-[Cas9];
[UGI]-[second Cas9]-[deaminase]-[Cas9];
[UGI]-[second Cas9]-[Cas9]-[deaminase];
[Cas9]-[second Cas9]-[deaminase]-[UGI];
[Cas9]-[second Cas9]-[UGI]-[deaminase]
[deaminase]-[Cas9]-[second Cas9]-[UGI];
[deaminase]-[UGI]-[second Cas9]-[Cas9];
[UGI]-[deaminase]-[second Cas9]-[Cas9];
[UGI]-[Cas9]-[second Cas9]-[deaminase];
[Cas9]-[deaminase]-[second Cas9]-[UGI];
[Cas9]-[UGI]-[second Cas9]-[deaminase];
[deaminase]-[Cas9]-[UGI]-[second Cas9];
[deaminase]-[UGI]-[Cas9]-[second Cas9];
[UGI]-[deaminase]-[Cas9]-[second Cas9];
[UGI]-[Cas9]-[deaminase]-[second Cas9];
[Cas9]-[deaminase]-[UGI]-[second Cas9]; or
[Cas9]-[UGI]-[deaminase]-[second Cas9].

In some embodiments, the "-" used in the general architecture above indicates the presence of an optional linker sequence. In some embodiments, the fusion proteins comprising a UGI further comprise a nuclear targeting sequence, for example a nuclear localization sequence. In some embodiments, fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the UGI protein. In some embodiments, the NLS is fused to the C-terminus of the UGI protein. In some embodiments, the NLS is fused to the N-terminus of the Cas9 protein. In some embodiments, the NLS is fused to the C-terminus of the Cas9 protein. In some embodiments, the NLS is fused to the N-terminus of the deaminase. In some embodiments, the NLS is fused to the C-terminus of the deaminase. In some embodiments, the NLS is fused to the N-terminus of the second Cas9. In some embodiments, the NLS is fused to the C-terminus of the second Cas9. In some embodiments, the NLS is fused to the fusion protein via one or more linkers. In some embodiments, the NLS is fused to the fusion protein without a linker.

In some embodiments, the UGI comprises a wild type UGI or a UGI as set forth in SEQ ID NO: 553. In some embodiments, the UGI proteins provided herein include fragments of UGI and proteins homologous to a UGI or a UGI fragment. For example, in some embodiments, a UGI comprises a fragment of the amino acid sequence set forth in SEQ ID NO: 553. In some embodiments, a UGI comprises an amino acid sequence homologous to the amino acid sequence set forth in SEQ ID NO: 553 or an amino acid sequence homologous to a fragment of the amino acid sequence set forth in SEQ ID NO: 553. In some embodiments, proteins comprising UGI or fragments of UGI or homologs of UGI or UGI fragments are referred to as "UGI variants." A UGI variant shares homology to UGI, or a fragment thereof. For example a UGI variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% to a wild type UGI or a UGI as set forth in SEQ ID NO: 553. In some embodiments, the UGI variant comprises a fragment of UGI, such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% to the corresponding fragment of wild type UGI or a UGI as set forth in SEQ ID NO: 553. In some embodiments, the UGI comprises the following amino acid sequence: >sp|P14739|UNGI_BPPB2 Uracil-DNA glycosylase inhibitor MTNLSDIIEKETGKQLVIQE-SILMLPEEVEEVIGNKPESDILVHTAYDEST-DENVMLLTSD APEYKPWALVIQDSNGENKIKML (SEQ ID NO: 553)

Suitable UGI protein and nucleotide sequences are provided herein and additional suitable UGI sequences are known to those in the art, and include, for example, those published in Wang et al., Uracil-DNA glycosylase inhibitor gene of bacteriophage PBS2 encodes a binding protein specific for uracil-DNA glycosylase. *J. Biol. Chem.* 264: 1163-1171(1989); Lundquist et al., Site-directed mutagenesis and characterization of uracil-DNA glycosylase inhibitor protein. Role of specific carboxylic amino acids in complex formation with *Escherichia coli* uracil-DNA glycosylase. *J. Biol. Chem.* 272:21408-21419(1997); Ravishankar et al., X-ray analysis of a complex of *Escherichia coli* uracil DNA glycosylase (EcUDG) with a proteinaceous inhibitor. The structure elucidation of a prokaryotic UDG. *Nucleic Acids Res.* 26:4880-4887(1998); and Putnam et al., Protein mimicry of DNA from crystal structures of the uracil-DNA glycosylase inhibitor protein and its complex with *Escherichia coli* uracil-DNA glycosylase. *J. Mol. Biol.* 287:331-346(1999), the entire contents of each are incorporated herein by reference.

It should be appreciated that additional proteins may be uracil glycosylase inhibitors. For example, other proteins that are capable of inhibiting (e.g., sterically blocking) a uracil-DNA glycosylase base-excision repair enzyme are within the scope of this disclosure. In some embodiments, a uracil glycosylase inhibitor is a protein that binds DNA. In some embodiments, a uracil glycosylase inhibitor is a protein that binds single-stranded DNA. For example, a uracil glycosylase inhibitor may be a *Erwinia tasmaniensis* single-stranded binding protein. In some embodiments, the single-stranded binding protein comprises the amino acid sequence (SEQ ID NO: 303). In some embodiments, a uracil glycosylase inhibitor is a protein that binds uracil. In some embodiments, a uracil glycosylase inhibitor is a protein that binds uracil in DNA. In some embodiments, a uracil glycosylase inhibitor is a catalytically inactive uracil DNA-glycosylase protein. In some embodiments, a uracil glycosylase inhibitor is a catalytically inactive uracil DNA-glycosylase protein that does not excise uracil from the DNA. For example, a uracil glycosylase inhibitor is a UdgX. In some embodiments, the UdgX comprises the amino acid sequence (SEQ ID NO: 304). As another example, a uracil glycosylase inhibitor is a catalytically inactive UDG. In some embodiments, a catalytically inactive UDG comprises the amino acid sequence (SEQ ID NO: 305). It should be appreciated that other uracil glycosylase inhibitors would be apparent to the skilled artisan and are within the scope of this disclosure.

Erwinia tasmaniensis SSB (themostable single-
stranded DNA binding protein)
(SEQ ID NO: 303)
MASRGVNKVILVGNLGQDPEVRYMPNGGAVANITLATSESWRDKQTGETK

EKTEWHRVVLFGKLAEVAGEYLRKGSQVYIEGALQTRKWTDQAGVEKYTT

EVVVNVGGTMQMLGGRSQGGGASAGGQNGGSNNGWGQPQQPQGGNQFSGG

AQQQARPQQQPQQNNAPANNEPPIDFDDDIP

UdgX (binds to Uracil in DNA but does not excise)
(SEQ ID NO: 304)
MAGAQDFVPHTADLAELAAAAGECRGCGLYRDATQAVFGAGGRSARIMMI

GEQPGDKEDLAGLPFVGPAGRLLDRALEAADIDRDALYVTNAVKHFKFTR

AAGGKRRIHKTPSRTEVVACRPWLIAEMTSVEPDVVVLLGATAAKALLGN

DFRVTQHRGEVLHVDDVPGDPALVATVHPSSLLRGPKEERESAFAGLVDD

LRVAADVRP

UDG (catalytically inactive human UDG, binds to
Uracil in DNA but does not excise)
(SEQ ID NO: 305)
MIGQKTLYSFFSPSPARKRHAPSPEPAVQGTGVAGVPEESGDAAAIPAKK

APAGQEEPGTPPSSPLSAEQLDRIQRNKAAALLRLAARNVPVGFGESWKK

HLSGEFGKPYFIKLMGFVAEERKHYTVYPPPHQVFTWTQMCDIKDVKVVI

LGQEPYHGPNQAHGLCFSVQRPVPPPPSLENIYKELSTDIEDFVHPGHGD

LSGWAKQGVLLLNAVLTVRAHQANSHKERGWEQFTDAVVSWLNQNSNGLV

FLLWGSYAQKKGSAIDRKRHHVLQTAHPSPLSVYRGFFGCRHFSKTNELL

QKSGKKPIDWKEL

High Fidelity Cas9

Some aspects of the disclosure provide high fidelity Cas9 proteins. In some embodiments, high fidelity Cas9 proteins have decreased electrostatic interactions between the Cas9 protein and a sugar-phosphate backbone of a DNA, as compared to a wild-type Cas9 domain. In some embodiments, any of the Cas9 proteins provided herein comprise one or more mutations that decrease the association between the Cas9 protein and a sugar-phosphate backbone of a DNA. In some embodiments, any of the Cas9 proteins provided herein comprise one or more mutations that decrease the association between the Cas9 protein and a sugar-phosphate backbone of a DNA by at least 5%, at least 10%, at least 15%, at least 20%, at least 25%, at least 30%, at least 35%, at least 40%, at least 45%, at least 50%, at least 60%, at least 70%, at least 80%, at least 90%, or at least 95%. In some embodiments, any of the Cas9 proteins provided herein comprise one or more of a N497X, a R661X, a Q695X, and/or a Q926X mutation of the amino acid sequence provided in SEQ ID NO: 9, or a corresponding mutation in any of the amino acid sequences provided in SEQ ID NOs: 10-262, wherein X is any amino acid. In some embodiments, any of the Cas9 proteins provided herein comprise one or more of a N497A, a R661A, a Q695A, and/or a Q926A mutation of the amino acid sequence provided in SEQ ID NO: 9, or a corresponding mutation in any of the amino acid sequences provided in SEQ ID NOs: 10-262. In some embodiments, the Cas9 protein comprises a D10A mutation of the amino acid sequence provided in SEQ ID NO: 9, or a corresponding mutation in any of the amino acid sequences provided in SEQ ID NOs: 10-262. In some embodiments, the Cas9 protein comprises the amino acid sequence as set forth in SEQ ID NO: 306. High fidelity Cas9 proteins have been described in the art and would be apparent to the skilled artisan. For example, high fidelity Cas9 proteins have been described in Kleinstiver, B. P., et al. "High-fidelity CRISPR-Cas9 nucleases with no detectable genome-wide off-target effects." Nature 529, 490-495 (2016); and Slaymaker, I. M., et al. "Rationally engineered Cas9 nucleases with improved specificity." Science 351, 84-88 (2015); the entire contents of each are incorporated herein by reference. It should be appreciated that, based on the present disclosure and knowledge in the art, that mutations in any Cas9 protein may be generated to make high fidelity Cas9 proteins that have decreased electrostatic interactions between the Cas9 protein and a sugar-phosphate backbone of a DNA, as compared to a wild-type Cas9 domain.

Cas9 domain where mutations relative to Cas9 of SEQ ID NO: 9 are shown in bold and underlines.

```
                                        (SEQ ID NO: 306)
MDKKYSIGLDIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTAFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGALSRKLINGIRDKQSGKTILDFLKSDGFANRNFMALIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRAITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD
```

Cas9 Proteins with Reduced PAM Exclusivity

Some aspects of the disclosure provide Cas9 proteins that have different PAM specificities. Typically, Cas9 proteins, such as Cas9 from *S. pyogenes* (spCas9), require a canonical NGG PAM sequence to bind a particular nucleic acid region. This may limit the ability to of the Cas9 protein to bind to a particular nucleotide sequence within a genome. Accordingly, in some embodiments, any of the Cas proteins provided herein may be capable of binding a nucleotide sequence that does not contain a canonical (e.g., NGG) PAM sequence. For example, Cas9 proteins that bind non-canonical PAM sequences have been described in Kleinstiver, B. P., et al., "Engineered CRISPR-Cas9 nucleases with altered PAM specificities" *Nature* 523, 481-485 (2015); and Kleinstiver, B. P., et al., "Broadening the targeting range of *Staphylococcus aureus* CRISPR-Cas9 by modifying PAM recognition" *Nature Biotechnology* 33, 1293-1298 (2015); the entire contents of each are hereby incorporated by reference.

In some embodiments, the Cas9 protein is a Cas9 protein from *Staphylococcus aureus* (SaCas9). In some embodiments, the SaCas9 protein is a nuclease active SaCas9, a nuclease inactive SaCas9 (SaCas9d), or a SaCas9 nickase (SaCas9n). In some embodiments, the SaCas9 comprises the amino acid sequence SEQ ID NO: 307. In some embodiments, the SaCas9 comprises a N579X mutation of SEQ ID NO: 307, or a corresponding mutation in any of the amino acid sequences provided in SEQ ID NOs: 9-262, wherein X is any amino acid except for N. In some embodiments, the SaCas9 comprises a N579A mutation of SEQ ID NO: 307, or a corresponding mutation in any of the amino acid sequences provided in SEQ ID NOs: 10-262. In some embodiments, the SaCas9 protein, the SaCas9d protein, or the SaCas9n protein can bind to a nucleic acid sequence having a non-canonical PAM. In some embodiments, the SaCas9 protein, the SaCas9d protein, or the SaCas9n protein can bind to a nucleic acid sequence having a NNGRRT PAM sequence. In some embodiments, the SaCas9 protein comprises one or more of a E781X, N967X, or R1014X mutation of SEQ ID NO: 307, or a corresponding mutation in any of the amino acid sequences provided in SEQ ID NOs: 10-262, wherein X is any amino acid. In some embodiments, the SaCas9 protein comprises one or more of a E781K, N967K, or R1014H mutation of SEQ ID NO: 307, or one or more corresponding mutation in any of the amino acid sequences provided in SEQ ID NOs: 10-262. In some embodiments, the SaCas9 protein comprises a E781K, a N967K, and a R1014H mutation of SEQ ID NO: 307, or corresponding mutations in any of the amino acid sequences provided in SEQ ID NOs: 10-262. It should be appreciated that these mutations may be combined with any of the other mutations provided herein In some embodiments, the Cas9 protein of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 307-309. In some embodiments, the Cas9 protein of any of the fusion proteins provided herein comprises the amino acid sequence of any one of SEQ ID NOs: 307-309. In some embodiments, the Cas9 protein of any of the fusion proteins provided herein consists of the amino acid sequence of any one of SEQ ID NOs: 307-309.

Exemplary SaCas9 sequence
(SEQ ID NO: 307)
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEENSKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRELINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYNNDLIKINGELYRVIGVNNDLLNRIEVNMIDITY

REYLENMNDKRPPRIIKTIASKTQSIKKYSTDILGNLYEVKSKKHPQIIK

KG

Residue N579 of SEQ ID NO: 307, which is underlined and in bold, may be mutated (e.g., to a A579) to yield a SaCas9 nickase.

Exemplary SaCas9n sequence
(SEQ ID NO: 308)
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEEASKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRELINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYNNDLIKINGELYRVIGVNNDLLNRIEVNMIDITY

REYLENMNDKRPPRIIKTIASKTQSIKKYSTDILGNLYEVKSKKHPQIIK

KG.

Residue A579 of SEQ ID NO: 308, which can be mutated from N579 of SEQ ID NO: 307 to yield a SaCas9 nickase, is underlined and in bold.

Exemplary SaKKH Cas9
(SEQ ID NO: 309)
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEEASKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRKLINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

-continued

```
KLKKISNQAEFIASFYKNDLIKINGELYRVIGVNNDLLNRIEVNMIDITY

REYLENMNDKRPPHIIKTIASKTQSIKKYSTDILGNLYEVKSKKHPQIIK

KG.
```

Residue A579 of SEQ ID NO: 309, which can be mutated from N579 of SEQ ID NO: 307 to yield a SaCas9 nickase, is underlined and in bold. Residues K781, K967, and H1014 of SEQ ID NO: 309, which can be mutated from E781, N967, and R1014 of SEQ ID NO: 307 to yield a SaKKH Cas9 are underlined and in italics.

In some embodiments, the Cas9 protein is a Cas9 protein from *Streptococcus pyogenes* (SpCas9). In some embodiments, the SpCas9 protein is a nuclease active SpCas9, a nuclease inactive SpCas9 (SpCas9d), or a SpCas9 nickase (SpCas9n). In some embodiments, the SpCas9 comprises the amino acid sequence SEQ ID NO: 9. In some embodiments, the SpCas9 comprises a D10X mutation of SEQ ID NO: 9, or a corresponding mutation in any of the amino acid sequences provided in SEQ ID NOs: 10-262, wherein X is any amino acid except for D. In some embodiments, the SpCas9 comprises a D10A mutation of SEQ ID NO: 9, or a corresponding mutation in any of the amino acid sequences provided in SEQ ID NOs: 10-262. In some embodiments, the SpCas9 protein, the SpCas9d protein, or the SpCas9n protein can bind to a nucleic acid sequence having a non-canonical PAM. In some embodiments, the SpCas9 protein, the SpCas9d protein, or the SpCas9n protein can bind to a nucleic acid sequence having a NGG, a NGA, or a NGCG PAM sequence. In some embodiments, the SpCas9 protein comprises one or more of a D1135X, R1335X, and T1337X mutation of SEQ ID NO: 9, or a corresponding mutation in any of the amino acid sequences provided in SEQ ID NOs: 10-262, wherein X is any amino acid. In some embodiments, the SpCas9 protein comprises one or more of a D1135E, R1335Q, and T1337R mutation of SEQ ID NO: 9, or a corresponding mutation in any of the amino acid sequences provided in SEQ ID NOs: 10-262. In some embodiments, the SpCas9 protein comprises a D1135E, a R1335Q, and a T1335R mutation of SEQ ID NO: 9, or corresponding mutations in any of the amino acid sequences provided in SEQ ID NOs: 10-262. In some embodiments, the SpCas9 protein comprises one or more of a D1135X, R1335X, and T1337X mutation of SEQ ID NO: 9, or a corresponding mutation in any of the amino acid sequences provided in SEQ ID NOs: 10-262, wherein X is any amino acid. In some embodiments, the SpCas9 protein comprises one or more of a D1135V, R1335Q, and T1337R mutation of SEQ ID NO: 9, or a corresponding mutation in any of the amino acid sequences provided in SEQ ID NOs: 10-262. In some embodiments, the SpCas9 protein comprises a D1135V, a R1335Q, and a T1337R mutation of SEQ ID NO: 9, or corresponding mutations in any of the amino acid sequences provided in SEQ ID NOs: 10-262. In some embodiments, the SpCas9 protein comprises one or more of a D1135X, G1218X, R1335X, and T1337X mutation of SEQ ID NO: 9, or a corresponding mutation in any of the amino acid sequences provided in SEQ ID NOs: 10-262, wherein X is any amino acid. In some embodiments, the SpCas9 protein comprises one or more of a D1135V, G1218R, R1335Q, and T1337R mutation of SEQ ID NO: 9, or a corresponding mutation in any of the amino acid sequences provided in SEQ ID NOs: 10-262. In some embodiments, the SpCas9 protein comprises a D1135V, a G1218R, a R1335Q, and a T1337R mutation of SEQ ID NO: 9, or corresponding mutations in any of the amino acid sequences provided in SEQ ID NOs: 10-262. It should be appreciated that these mutations may be combined with any of the other mutations provided herein In some embodiments, the Cas9 protein of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 9, 310-313. In some embodiments, the Cas9 domain of any of the fusion proteins provided herein comprises the amino acid sequence of any one of SEQ ID NOs: 9, 310-313. In some embodiments, the Cas9 domain of any of the fusion proteins provided herein consists of the amino acid sequence of any one of SEQ ID NOs: 9, 310-313.

Exemplary SpCas9

(SEQ ID NO: 9)
```
MDKKYSIGLDIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD
```

Exemplary SpCas9n
(SEQ ID NO: 310)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Exemplary SpEQR Cas9
(SEQ ID NO: 311)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKEDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFESPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKQYRSTKEVLDATLIHQS

ITGLYETRIDLSQLGGD

Residues E1134, Q1334, and R1336 of SEQ ID NO: 311, which can be mutated from D1134, R1334, and T1336 of SEQ ID NO: 9 to yield a SpEQR Cas9, are underlined and in bold.

Exemplary SpVQR Cas9
(SEQ ID NO: 312)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

```
KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFVSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKQYRSTKEVLDATLIHQS

ITGLYETRIDLSQLGGD
```

Residues V1134, Q1334, and R1336 of SEQ ID NO: 312, which can be mutated from D1134, R1334, and T1336 of SEQ ID NO: 9 to yield a SpVQR Cas9, are underlined and in bold.

```
Exemplary SpVRER Cas9
                                    (SEQ ID NO: 313)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFVSPTVAYSVLVVAKVEK

GKSKKLKSVKELLGITIMIERSSFEKNPIDFLEAKGYKEVKKDLIIKLPK

YSLFELENGRKRMLASARELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKEYRSTKEVLDATLIHQ

SITGLYETRIDLSQLGGD
```

Residues V1134, R1217, Q1334, and R1336 of SEQ ID NO: 313, which can be mutated from D1134, G1217, R1334, and T1336 of SEQ ID NO: 9 to yield a SpVRER Cas9, are underlined and in bold.

Cas9 Complexes with Guide RNAs

Some aspects of this disclosure provide complexes comprising a Cas9 protein or a Cas9 fusion protein as provided herein, and a guide RNA bound to the Cas9 protein or the Cas9 fusion protein. In some embodiments, the guide RNA is about 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is a sequence in the genome of a mammal. In some embodiments, the target sequence is a sequence in the genome of a human. In some embodiments, the 3' end of the target sequence is not immediately adjacent to the canonical PAM sequence (5'-NGG-3').

Some aspects of the disclosure provide complexes comprising a first guide RNA bound to a Cas9 protein of a fusion protein, and a second guide RNA bound to a second Cas9 protein of the fusion protein. In some embodiments, the first guide RNA is about 15-100 nucleotides long and comprises a sequence of at least 10 contiguous nucleotides that is complementary to a first target sequence and the second guide RNA is about 15-100 nucleotides long and comprises a sequence of at least 10 contiguous nucleotides that is complementary to a second target sequence. In some embodiments, the first guide RNA and/or the second guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the first guide RNA and the second guide RNA are different. In some embodiments, the first guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a first target sequence and wherein the second guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a second target sequence.

In some embodiments, first target sequence and the second target sequence are different. In some embodiments, the first target sequence and the second target sequence are DNA sequences. In some embodiments, the first target sequence and the second target sequence are in the genome of a mammal. In some embodiments, the first target sequence and the second target sequence are in the genome of a human. In some embodiments, the first target sequence is within at least 5, 10, 15, 20, 25, 30, 35, 40, 45, 50, 60, 70, 80, 90, 100, 150, or 200 nucleotides of the second target sequence. In some embodiments, the 3'-end of the first target sequence is not immediately adjacent to the canonical PAM sequence (5'-NGG-3'). In some embodiments, the 3'-end of the second target sequence is not immediately adjacent to the canonical PAM sequence (5'-NGG-3').

Methods of Using Cas9 Fusion Proteins

Some aspects of this disclosure provide methods of using the Cas9 proteins, fusion proteins, or complexes provided herein. For example, some aspects of this disclosure provide methods comprising contacting a DNA molecule (a) with any of the the Cas9 proteins or fusion proteins provided herein, and with at least one guide RNA, wherein the guide RNA is about 15-100 nucleotides long and comprises a sequence of at least 10 contiguous nucleotides that is complementary to a target sequence; or (b) with a Cas9 protein, a Cas9 fusion protein, or a Cas9 protein or fusion protein complex with at least one gRNA as provided herein. In some embodiments, the 3' end of the target sequence is not immediately adjacent to the canonical PAM sequence (5'-NGG-3'). In some embodiments, the 3' end of the target sequence is immediately adjacent to an AGC, GAG, TTT, GTG, or CAA sequence.

In some embodiments, the target DNA sequence comprises a sequence associated with a disease or disorder. In some embodiments, the target DNA sequence comprises a point mutation associated with a disease or disorder. In some embodiments, the activity of the Cas9 protein, the Cas9 fusion protein, or the complex results in a correction of the point mutation. In some embodiments, the target DNA sequence comprises a T→C point mutation associated with a disease or disorder, and wherein the deamination of the mutant C base results in a sequence that is not associated with a disease or disorder. In some embodiments, the target DNA sequence encodes a protein and wherein the point mutation is in a codon and results in a change in the amino acid encoded by the mutant codon as compared to the wild-type codon. In some embodiments, the deamination of the mutant C results in a change of the amino acid encoded by the mutant codon. In some embodiments, the deamination of the mutant C results in the codon encoding the wild-type amino acid. In some embodiments, the contacting is in vivo in a subject. In some embodiments, the subject has or has been diagnosed with a disease or disorder. In some embodiments, the disease or disorder is cystic fibrosis, phenylketonuria, epidermolytic hyperkeratosis (EHK), Charcot-Marie-Toot disease type 4J, neuroblastoma (NB), von Willebrand disease (vWD), myotonia congenital, hereditary renal amyloidosis, dilated cardiomyopathy (DCM), hereditary lymphedema, familial Alzheimer's disease, HIV, Prion disease, chronic infantile neurologic cutaneous articular syndrome (CINCA), desmin-related myopathy (DRM), a neoplastic disease associated with a mutant PI3KCA protein, a mutant CTNNB1 protein, a mutant HRAS protein, or a mutant p53 protein.

Some embodiments provide methods for using the Cas9 DNA editing fusion proteins provided herein. In some embodiments, the fusion protein is used to introduce a point mutation into a nucleic acid by deaminating a target nucleobase, e.g., a C residue. In some embodiments, the deamination of the target nucleobase results in the correction of a genetic defect, e.g., in the correction of a point mutation that leads to a loss of function in a gene product. In some embodiments, the genetic defect is associated with a disease or disorder, e.g., a lysosomal storage disorder or a metabolic disease, such as, for example, type I diabetes. In some embodiments, the methods provided herein are used to introduce a deactivating point mutation into a gene or allele that encodes a gene product that is associated with a disease or disorder. For example, in some embodiments, methods are provided herein that employ a Cas9 DNA editing fusion protein to introduce a deactivating point mutation into an oncogene (e.g., in the treatment of a proliferative disease). A deactivating mutation may, in some embodiments, generate a premature stop codon in a coding sequence, which results in the expression of a truncated gene product, e.g., a truncated protein lacking the function of the full-length protein.

In some embodiments, the purpose of the methods provide herein is to restore the function of a dysfunctional gene via genome editing. The Cas9 deaminase fusion proteins provided herein can be validated for gene editing-based human therapeutics in vitro, e.g., by correcting a disease-associated mutation in human cell culture. It will be understood by the skilled artisan that the fusion proteins provided herein, e.g., the fusion proteins comprising a Cas9 domain and a nucleic acid deaminase domain can be used to correct any single point T→C or A→G mutation. In the first case, deamination of the mutant C back to U corrects the mutation, and in the latter case, deamination of the C that is base-paired with the mutant G, followed by a round of replication, corrects the mutation.

An exemplary disease-relevant mutation that can be corrected by the provided fusion proteins in vitro or in vivo is the H1047R (A3140G) polymorphism in the PI3KCA protein. The phosphoinositide-3-kinase, catalytic alpha subunit (PI3KCA) protein acts to phosphorylate the 3-OH group of the inositol ring of phosphatidylinositol. The PI3KCA gene has been found to be mutated in many different carcinomas, and thus it is considered to be a potent oncogene.[50] In fact, the A3140G mutation is present in several NCI-60 cancer cell lines, such as, for example, the HCT116, SKOV3, and T47D cell lines, which are readily available from the American Type Culture Collection (ATCC).[51]

In some embodiments, a cell carrying a mutation to be corrected, e.g., a cell carrying a point mutation, e.g., an A3140G point mutation in exon 20 of the PI3KCA gene, resulting in a H1047R substitution in the PI3KCA protein, is contacted with an expression construct encoding a Cas9 deaminase fusion protein and an appropriately designed sgRNA targeting the fusion protein to the respective mutation site in the encoding PI3KCA gene. Control experiments can be performed where the sgRNAs are designed to target the fusion enzymes to non-C residues that are within the PI3KCA gene. Genomic DNA of the treated cells can be extracted, and the relevant sequence of the PI3KCA genes PCR amplified and sequenced to assess the activities of the fusion proteins in human cell culture.

It will be understood that the example of correcting point mutations in PI3KCA is provided for illustration purposes and is not meant to limit the instant disclosure. The skilled artisan will understand that the instantly disclosed DNA-editing fusion proteins can be used to correct other point mutations and mutations associated with other cancers and with diseases other than cancer including other proliferative diseases.

The successful correction of point mutations in disease-associated genes and alleles opens up new strategies for gene correction with applications in therapeutics and basic research. Site-specific single-base modification systems like the disclosed fusions of Cas9 and deaminase enzymes or domains also have applications in "reverse" gene therapy, where certain gene functions are purposely suppressed or abolished. In these cases, site-specifically mutating Trp (TGG), Gln (CAA and CAG), or Arg (CGA) residues to premature stop codons (TAA, TAG, TGA) can be used to abolish protein function in vitro, ex vivo, or in vivo.

The instant disclosure provides methods for the treatment of a subject diagnosed with a disease associated with or caused by a point mutation that can be corrected by a Cas9 DNA editing fusion protein provided herein. For example, in some embodiments, a method is provided that comprises administering to a subject having such a disease, e.g., a cancer associated with a PI3KCA point mutation as described above, an effective amount of a Cas9 deaminase fusion protein that corrects the point mutation or introduces a deactivating mutation into the disease-associated gene. In some embodiments, the disease is a proliferative disease. In some embodiments, the disease is a genetic disease. In some embodiments, the disease is a neoplastic disease. In some embodiments, the disease is a metabolic disease. In some embodiments, the disease is a lysosomal storage disease. Other diseases that can be treated by correcting a point mutation or introducing a deactivating mutation into a disease-associated gene will be known to those of skill in the art, and the disclosure is not limited in this respect.

Figure 4A:
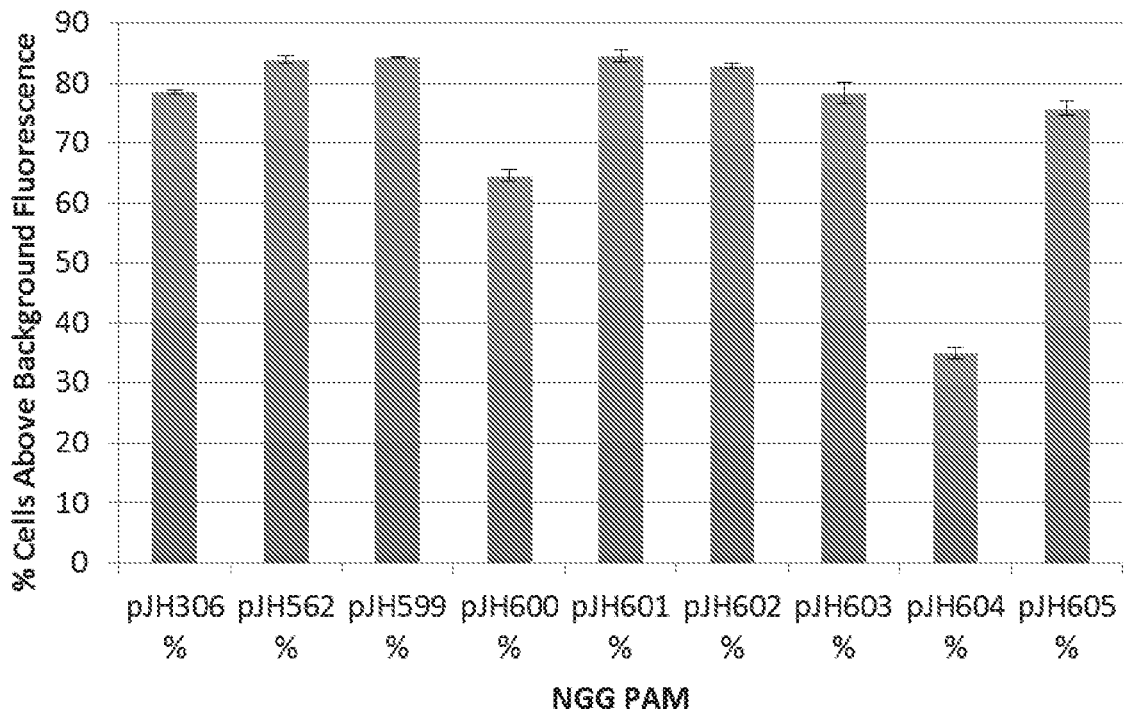
FIGS. 4A to 4B show the binding activity of Cas9 (pJH306) and evolved Cas9 proteins with an 5'-NGG-3' PAM sequence using GFP as a readout. On 5'-NGG-3' PAMs, many of the evolved Cas9 proteins showed increased Cas9 binding activity relative to wild-type Cas9 based on an increase in GFP fluorescence signal.
Figure 4B:
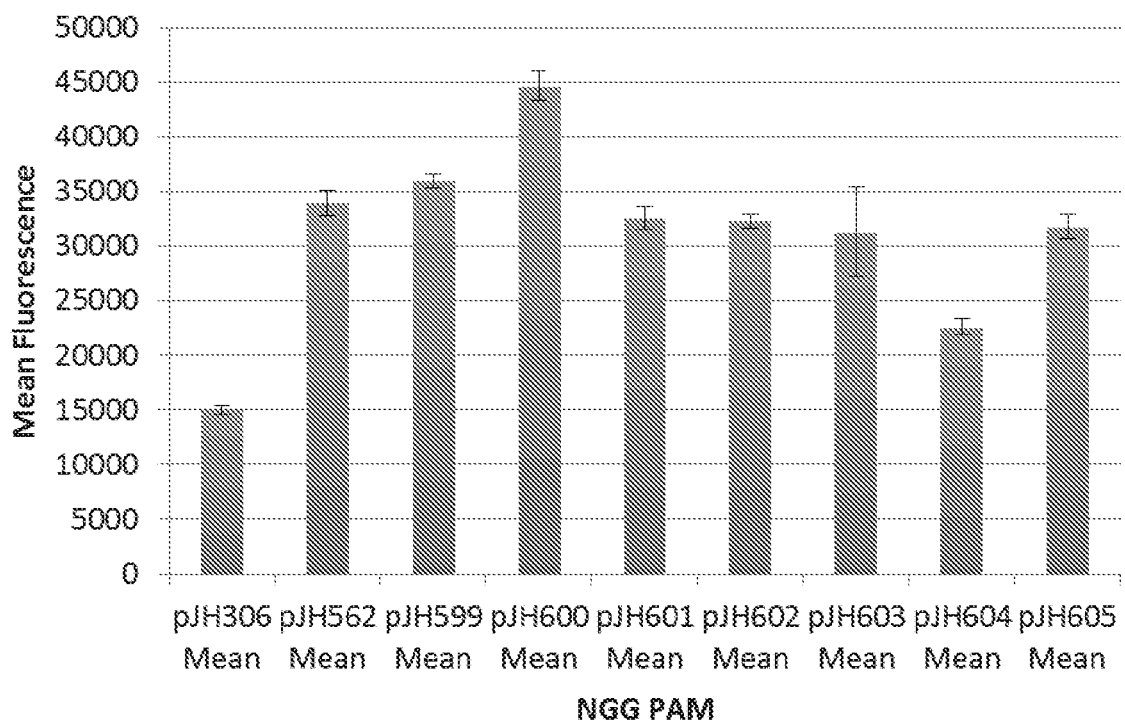

The instant disclosure provides methods for the treatment of additional diseases or disorders, e.g., diseases or disorders that are associated or caused by a point mutation that can be corrected by deaminase-mediated gene editing. Some such diseases are described herein, and additional suitable diseases that can be treated with the strategies and fusion proteins provided herein will be apparent to those of skill in the art based on the instant disclosure. Exemplary suitable diseases and disorders are listed below. It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues. Exemplary suitable diseases and disorders include, without limitation, cystic fibrosis (see, e.g., Schwank et al., Functional repair of CFTR by CRISPR/Cas9 in intestinal stem cell organoids of cystic fibrosis patients. *Cell stem cell*. 2013; 13: 653-658; and Wu et. al., Correction of a genetic disease in mouse via use of CRISPR-Cas9. *Cell stem cell*. 2013; 13: 659-662, neither of which uses a deaminase fusion protein to correct the genetic defect); phenylketonuria—e.g., phenylalanine to serine mutation at position 835 (mouse) or 240 (human) or a homologous residue in phenylalanine hydroxylase gene (T>C mutation)—see, e.g., McDonald et al., *Genomics*. 1997; 39:402-405; Bernard-Soulier syndrome (BSS)—e.g., phenylalanine to serine mutation at position 55 or a homologous residue, or cysteine to arginine at residue 24 or a homologous residue in the platelet membrane glycoprotein IX (T>C mutation)—see, e.g., Noris et al., *British Journal of Haematology*. 1997; 97: 312-320, and Ali et al., *Hematol*. 2014; 93: 381-384; epidermolytic hyperkeratosis (EHK)—e.g., leucine to proline mutation at position 160 or 161 (if counting the initiator methionine) or a homologous residue in keratin 1 (T>C mutation)—see, e.g., Chipev et al., *Cell*. 1992; 70: 821-828, see also accession number P04264 in the UNIPROT database at www[dot]uniprot[dot]org; chronic obstructive pulmonary disease (COPD)—e.g., leucine to proline mutation at position 54 or 55 (if counting the initiator methionine) or a homologous residue in the processed form of $α_1$-antitrypsin or residue 78 in the unprocessed form or a homologous residue (T>C mutation)—see, e.g., Poller et al., *Genomics*. 1993; 17: 740-743, see also accession number P01011 in the UNIPROT database; Charcot-Marie-Toot disease type 4J—e.g., isoleucine to threonine mutation at position 41 or a homologous residue in FIG. 4 (T>C mutation)—see, e.g., Lenk et al., PLoS Genetics. 2011; 7: e1002104; neuroblastoma (NB)—e.g., leucine to proline mutation at position 197 or a homologous residue in Caspase-9 (T>C mutation)—see, e.g., Kundu et al., 3 *Biotech*. 2013, 3:225-234; von Willebrand disease (vWD)—e.g., cysteine to arginine mutation at position 509 or a homologous residue in the processed form of von Willebrand factor, or at position 1272 or a homologous residue in the unprocessed form of von Willebrand factor (T>C mutation)—see, e.g., Lavergne et al., *Br. J. Haematol*. 1992, see also accession number P04275 in the UNIPROT database; 82: 66-72; myotonia congenital—e.g., cysteine to arginine mutation at position 277 or a homologous residue in the muscle chloride channel gene CLCN1 (T>C mutation)—see, e.g., Weinberger et al., *The J. of Physiology*. 2012; 590: 3449-3464; hereditary renal amyloidosis—e.g., stop codon to arginine mutation at position 78 or a homologous residue in the processed form of apolipoprotein AII or at position 101 or a homologous residue in the unprocessed form (T>C mutation)—see, e.g., Yazaki et al., *Kidney Int*. 2003; 64: 11-16; dilated cardiomyopathy (DCM)—e.g., tryptophan to Arginine mutation at position 148 or a homologous residue in the FOXD4 gene (T>C mutation), see, e.g., Minoretti et. al., *Int. J. of Mol. Med.* 2007; 19: 369-372; hereditary lymphedema—e.g., histidine to arginine mutation at position 1035 or a homologous residue in VEGFR3 tyrosine kinase (A>G mutation), see, e.g., Irrthum et al., *Am. J. Hum. Genet*. 2000; 67: 295-301; familial Alzheimer's disease—e.g., isoleucine to valine mutation at position 143 or a homologous residue in presenilin1 (A>G mutation), see, e.g., Gallo et. al., *J. Alzheimer's disease*. 2011; 25: 425-431; Prion disease—e.g., methionine to valine mutation at position 129 or a homologous residue in prion protein (A>G mutation)—see, e.g., Lewis et. al., *J. of General Virology*. 2006; 87: 2443-2449; chronic infantile neurologic cutaneous articular syndrome (CINCA)—e.g., Tyrosine to Cysteine mutation at position 570 or a homologous residue in cryopyrin (A>G mutation)—see, e.g., Fujisawa et. al. *Blood*. 2007; 109: 2903-2911; and desmin-related myopathy (DRM)—e.g., arginine to glycine mutation at position 120 or a homologous residue in αB crystallin (A>G mutation)—see, e.g., Kumar et al., *J. Biol. Chem.* 1999; 274: 24137-24141. The entire contents of all references and database entries is incorporated herein by reference.

The instant disclosure provides lists of genes comprising pathogenic T>C or A>G mutations, which may be corrected using any of the Cas9 fusion proteins provided herein. Provided herein, are the names of these genes, their respective SEQ ID NOs, their gene IDs, and sequences flanking the mutation site. See Tables 4 and 5. Without wishing to be bound by any particular theory, the mutations provided in Tables 4 and 5 may be corrected using the Cas9 fusions provided herein, which are able to bind to target sequences lacking the canonical PAM sequence. In some embodiments, a Cas9-deaminase fusion protein demonstrates activity on non-canonical PAMs and therefore can correct all the pathogenic T>C or A>G mutations listed in Tables 4 and 5 (SEQ ID NOs: 674-2539 and 3144-5083), respectively. In some embodiments, a Cas9-deaminase fusion protein recognizes canonical PAMs and therefore can correct the pathogenic T>C or A>G mutations with canonical PAMs, e.g., 5'-NGG-3'. It should be appreciated that a skilled artisan would understand how to design an RNA (e.g., a gRNA) to target any of the Cas9 proteins or fusion proteins provided herein to any target sequence in order to correct any of the mutations provided herein, for example, the mutations provided in Tables 4 and 5. It will be apparent to those of skill in the art that in order to target a Cas9:effector domain fusion protein as disclosed herein to a target site, e.g., a site comprising a point mutation to be edited, it is typically necessary to co-express the Cas9:effector domain fusion protein together with a guide RNA, e.g., an sgRNA. As explained in more detail elsewhere herein, a guide RNA typically comprises a tracrRNA framework allowing for Cas9 binding, and a guide sequence, which confers sequence specificity to the Cas9:effector domain fusion protein. In some embodiments, the guide RNA comprises a structure 5'-[guide sequence]-guuuuagagcua-gaaauagcaaguuaaaauaaaggcuaguccguuaucaac-uugaaaaaguggcaccgagucggugcuuuuu-3' (SEQ ID NO: 285), wherein the guide sequence comprises a sequence that is complementary to the target sequence. The guide sequence is typically 20 nucleotides long. The sequences of suitable guide RNAs for targeting Cas9:effector domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited.

Kits, Vectors, Cells

Some aspects of this disclosure provide kits comprising a nucleic acid construct, comprising (a) a nucleotide sequence encoding a Cas9 protein or a Cas9 fusion protein as provided herein; and (b) a heterologous promoter that drives expression of the sequence of (a). In some embodiments, the kit further comprises an expression construct encoding a guide RNA backbone, wherein the construct comprises a cloning site positioned to allow the cloning of a nucleic acid sequence identical or complementary to a target sequence into the guide RNA backbone.

Some aspects of this disclosure provide polynucleotides encoding a Cas9 protein of a fusion protein as provided herein. Some aspects of this disclosure provide vectors comprising such polynucleotides. In some embodiments, the vector comprises a heterologous promoter driving expression of polynucleotide.

Some aspects of this disclosure provide cells comprising a Cas9 protein, a fusion protein, a nucleic acid molecule, and/or a vector as provided herein.

The description of exemplary embodiments of the reporter systems herein is provided for illustration purposes only and not meant to be limiting. Additional reporter systems, e.g., variations of the exemplary systems described in detail above, are also embraced by this disclosure.

EXAMPLES

Example 1: PACE Evolution of a Cas9 without PAM Sequence Restriction

Building PAM Libraries. Four different protospacer target sequences were synthesized: Doench 1-5'-AAGAGA-GACAGTACATGCCC-3'(SEQ ID NO: 286); Doench 2-5'-GGAGCCCACCGAGTACCTGG-3'(SEQ ID NO: 287); G7'-5'-AGTCTCCTCAGCAAAACGAA-3' (SEQ ID NO: 288); and VEGF Target 2-5'-GACCCCTC-CACCCCGCCTC-3' (SEQ ID NO: 289). For each protospacer target sequence, a 3'-NNN PAM library was built. While the canonical PAM sequence is 5'-NGG-3', (e.g., an exemplary [Doench 1]-[canonical PAM] target sequence could be 5'-[AAGAGAGACAGTACATGCCC]-[NGG]-3' (SEQ ID NO: 291)), the 3'NNN PAM libraries for each protospacer target sequence contained a fully random PAM sequence, e.g., for Doench1 5'-AAGAGAGACAGTA-CATGCCCNNN-3' (SEQ ID NO: 290), wherein N represents any nucleotide. The NNN PAM libraries thus included every possible combination of PAM sequences at the 3' end of the respective protospacer target sequence.

Testing the Activity of Cas9 on PAM Libraries in a ω-dCas9 luciferase assay. Cas9 activity was tested using a bacterial luciferase activation assay in which a fusion protein of the ω subunit of *Escherichia coli* RNA polymerase (rpoZ) to dCas9 (see, e.g., Bikard et al., Nucleic Acids Res. 2013 August; 41(15): 7429-7437) drives the production of luciferase encoded by a nucleic acid under the control of a weak promoter comprising a sequence targeted by an sgRNA. Each PAM library was cloned into a plasmid comprising such a weak promoter, where the [target sequence]-[PAM library] nucleic acid sequences served as the sequence targeted by an sgRNA. A PAM library was cloned into the promoter for The w-dCas9 assay was run on all four protospacer targets for both the canonical PAM and the random PAM library. FIG. 1 shows the activity of wild-type *S. pyogenes* Cas9 on PAM Libraries.

Evolution of Cas9 on PAM Libraries. *S. pyogenes* dCas9 was fused to the ω unit of RNA polymerase. The resulting ω-dCas9 fusion protein was cloned into an M13 phage-based selection phagemid (SP), comprising the entire M13 phage genome except for a functional version of the gene encoding pIII, a gene essential for the generation of infectious phage particles. The phage gene encoding pIII was provided on a separate plasmid (accessory plasmid, AP), under the control of a promoter that is transcriptionally activated by ω-dCas9. The PAM library was cloned into the promoter region of the accessory plasmid. Host cells used for the directed evolution of Cas9 proteins without PAM restriction were provided that harbored the accessory plasmid. Upon infection with a selection phage, the amount of infectious phage particles produced by a given host cell thus depends on the activity of the ω-dCas9 fusion protein encoded by the selection phage on the promoter of the accessory plasmid, which is required for the production of pIII protein. The accessory plasmid thus confers a selective advantage to those selection phages encoding ω-dCas9 fusion protein variants with an increased activity on different non-canonical PAM sequences.

A lagoon was provided and a flow of host cells comprising the accessory plasmid was generated through the lagoon. The host cells were contacted with the selection phagemid, resulting in a population of selection phage propagating in the flow of host cells in the lagoon. Phage-infected host cells were removed from the lagoon and fresh, uninfected host cells were fed into the lagoon at a rate resulting in the average time a host cell remained in the lagoon being shorter than the average time between cell division of the host cells, but longer than the average M13 phage life cycle time.

In order to generate Cas9 variants during a directed evolution experiment, the host cells in the lagoon were incubated under conditions resulting in an increased mutation rate. The host cells were harboring a mutagenesis plasmid (MP), which increased the mutagenesis rate, thus introducing mutations in the ω-dCas9 fusion protein encoded by the selection phagemid during the phage life cycle. Because the flow rate of host cells through the lagoon results in the average time a host cell remains in the lagoon being shorter than the average time between host cell divisions, the host cells in the lagoon cannot accumulate mutations resulting from the increased mutation rate conferred by the mutagenesis plasmid in their genome or on the accessory plasmid. The selection phage, however, replicate in the lagoon in the flow of host cells and thus accumulate mutations over time, resulting in the generation of new, evolved ω-dCas9 fusion protein variants.

If any of these evolved ω-dCas9 fusion protein variants includes a mutation that confers an increased activity on the accessory plasmid comprising the PAM library, this will directly translate into the generation of more pIII by a host cell infected with a selection phage encoding the respective ω-dCas9 fusion protein variant. The production of more pIII will, in turn, result in the generation of more infectious selection phage particles, which, over time, results in a competitive advantage of the mutant selection phage harboring such beneficial mutations over selection phage not harboring such mutations. After a period of time, the selective pressure exerted by the accessory plasmid will, therefore, result in selection phage having acquired beneficial mutations being the predominant species replicating in the flow of host cells, while selection phage with no mutations or with detrimental mutations will be washed out of the lagoon.

Because the ω-dCas9 fusion protein activity on the PAM library was very low at the beginning of the experiment, multiple rounds of overnight propagation of the selection phagemid in host cells harboring an accessory plasmid containing the PAM library were carried out to evolve Cas9 variants that show increased activity on noncanonical PAM sequences. At the end of a directed evolution experiment, the evolved population of selection phage was isolated from the lagoon, and a representative number of clones was analyzed to detect Cas9 variants having beneficial mutations. While all mutations observed confer a beneficial phenotype, mutations shared by more than one clone, or by all clones, are of particular interest.

Mutations from Cas9 PACE. A number of selection phage clones was isolated from a directed evolution experiment using a PAM library accessory plasmid as described above. The mutations identified in the Cas9 amino acid sequence of some exemplary clones is provided below in Table 1 (residue numbering according to SEQ ID NO: 9):

TABLE 1

Cas9 mutations identified in PACE (residue numbering according to SEQ ID NO: 9.

| Clone | Mutations | | | |
|---|---|---|---|---|
| 1 | | D182 | | E1219V |
| 2 | H137 | D182 | | E1219V |
| 3 | | D182 | G660 | E1219V |
| 4 | I122 | D182 | | E1219V |

Figure 2:
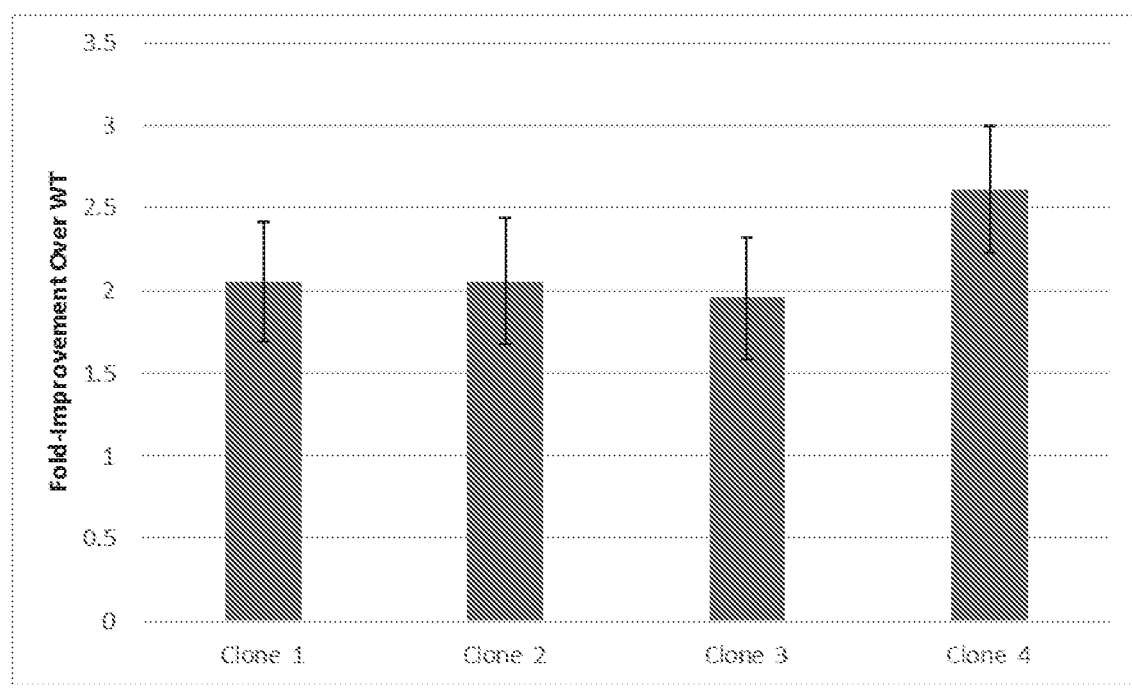
FIG. 2 shows the activity of exemplary evolved Cas9 clones on a PAM library after directed evolution.

Clones 1-4 were tested in the ω-dCas9 luciferase activation assay described above. When tested on the PAM library as a whole, the different clones showed an improvement in luciferase expression (FIG. 2—Cas9 activity of exemplary evolved clones on PAM library after directed evolution).

Improvement of Cas9 activity on non-canonical PAM sequences. The activity of evolved Cas9 proteins on target sequences with noncanonical PAMs was evaluated in more detail. The relative activity of Clone 4, harboring I122, D182, and E1219V mutations, for various [Doench 2 (5'-GGAGCCCACCGAGTACCTGG-3' (SEQ ID NO: 287))]-[PAM] target sequences was tested in the ω-dCas9 luciferase activation assay and compared to the activity of wild-type dCas9.

Improvement of Cas9 activity on non-canonical PAM sequences. The activity of evolved Cas9 proteins on target sequences with noncanonical PAMs was evaluated in more detail. The relative activity of Clone 4, harboring I122, D182, and E1219V mutations, for various [Doench 2 (5'-GGAGCCCACCGAGTACCTGG-3'(SEQ ID NO: 287))]-[PAM] target sequences was tested in the ω-dCas9 luciferase activation assay and compared to the activity of wild-type dCas9. The data are shown in Table 2.

TABLE 2

Relative activity of clone 4 on various PAM sequences.

| PAM | Clone 4 dCas9 Luciferase Activity | Wild-type dCas9 Luciferase Activity |
|---|---|---|
| GTC | 44.84 | 4.07 |
| AGC | 25.01 | 4.42 |
| GAG | 186.22 | 73.60 |
| TTT | 36.49 | 3.96 |
| GTG | 119.53 | 6.86 |
| AGG | 238.29 | 244.27 |
| CAA | 13.90 | 5.28 |

Example 2: PACE Evolution of a Cas9 without any PAM Sequence Restriction

Because the activity of the ω-dCas9 fusion protein on the NNN-PAM libraries was very low, a second round of PACE experiments was performed, in which an initial phase of diversification of the ω-dCas9 fusion protein population was carried out in the absence of selective pressure by providing a source of pIII that did not depend on w-dCas9 fusion protein activity. The initial diversification stage allows mutations to develop that may not be accessible in a PACE experiment where selective pressure is applied throughout the experiment.

Selection phage harboring a w-dCas9 fusion protein with a dCas9 sequence provided as SEQ ID NO: 8 with D10A and H840A mutations was propagated overnight in 1030 host cells together with MP6 mutagenesis plasmid in the presence of arabinose in order to create a library of mutated selection phage encoding a library of ω-dCas9 fusion protein variants. PIII was expressed from a separate plasmid in the host cells during this initial diversification stage. After overnight (12 h) diversification, 1030 host cells harboring an accessory plasmid comprising an NNN PAM library cloned into a weak promoter as the guide RNA target sequence and a mutagenesis plasmid were grown to log phase, and used as the source of host cells to create a flow of host cells through a lagoon. The cells in the lagoon were infected with the diversified selection phage from the overnight incubation. The host cells in the lagoon were contacted with arabinose in order to maintain a high level of expression of the mutagenic genes from the mutagenesis plasmid.

The initial phage titers were about $10^8$ pfu/mL. A PACE experiment was performed for each of the four NNN-PAM libraries ([Doench 1]-[NNN-PAM], [Doench 2]-[NNN-PAM], [G7]-[NNN-PAM], and [VEGF target]-[NNN-PAM] cloned into an accessory plasmid driving pIII expression from a weak promoter as described above. The phage titers were monitored during the PACE experiments. A slow drop in phage titers to $10^4$ pfu/mL was observed. The phage population was isolated from the lagoon at that point, and grown on 2208 host cells containing a separate source of pIII (psp-driven pIII). After this low-stringency propagation period, a 1:100 dilution of the supernatant was added to fresh host cells harboring the accessory plasmid as the only source of pIII in a new lagoon, and the PACE experiments were continued. No drop in phage titers was observed after this low-stringency incubation in 2208 cells.

One exemplary PACE experiment that was run for 72 hours. After that period of time, 24 surviving clones were isolated from the lagoon, sequenced, and characterized. The mutations identified included A262T, K294R, S409I, M694I, E480K, E543D, and E1219V (amino acid numbering according to SEQ ID NO: 9). In another exemplary experiment, surviving clones were isolated after 15 days of incubation. Activity of the identified dVas9 mutants was characterized in a ω-dCas9 luciferase assay. Clones with the best ω-dCas9 fusion protein activity on noncanonical PAM target sequences had the following mutations: E480K, E543D, E1219V, and T1329.

Cas9 Mammalian GFP Activation. Both wild-type dCas9 (SEQ ID NO: 9) and the evolved Cas9 clones were tested in a dCas9-GFP assay in Hek293T cells. The cells were contacted with a reporter construct in which a GFP-encoding sequence was driven from a weak promoter that includes a [gRNA target sequence]-[PAM] sequence. Fusion proteins of dCas9 (wild-type and PACE variants) attached to the transcriptional activator VP64-p65-Rta (VPR) were generated, and the various dCas9-VPR variants were tested for their capacity to activate the GFP reporter in HEK293 cells.

Hek293T were transfected with four separate plasmids: a dCas9-VPR expression plasmid; a plasmid expressing the sgRNA targeting the gRNA target sequence of the GFP reporter plasmid; the GFP reporter plasmid; and an iRFP transfection control. In one experiment, the HEK293 cells were contacted with a GFP reporter included a TAA PAM, and in another experiment, the HEK293 cells were contacted with a population of reporter plasmids containing an NNN PAM library. Cells were harvested 48 hours after transfection and GFP expressing cells were quantified using a BD LSR-FORTESSA cell analyzer.

Figure 3:
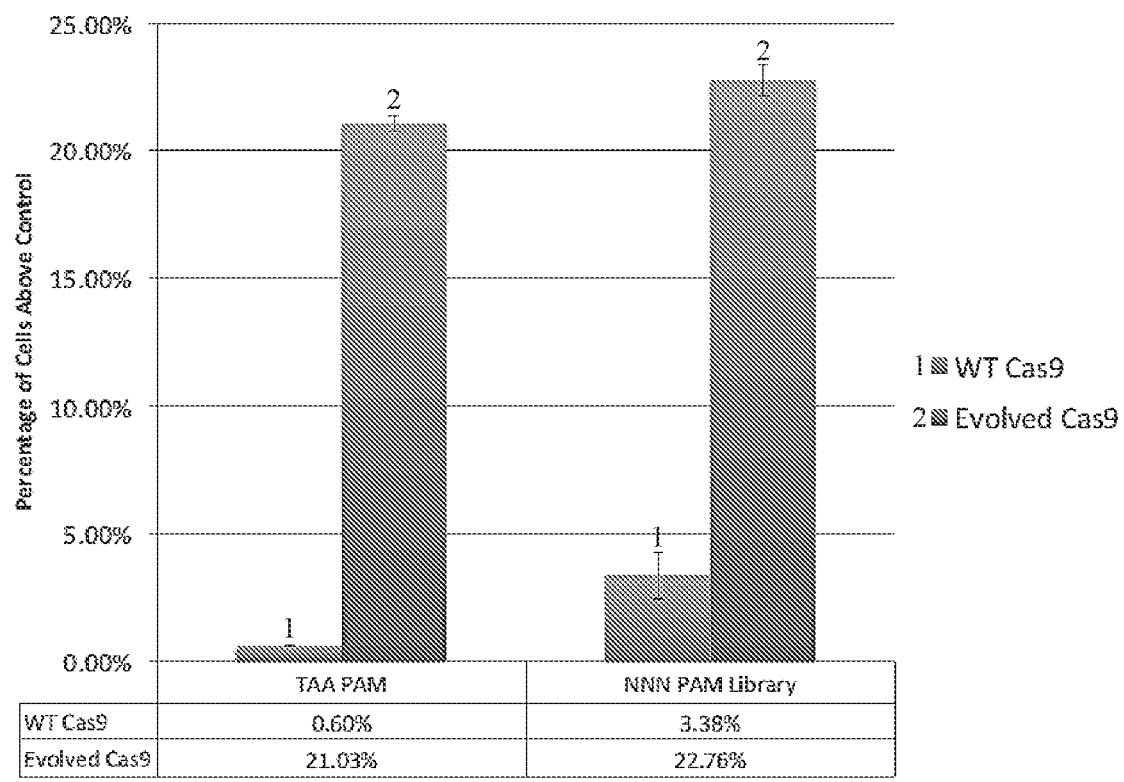
FIG. 3 shows a comparison of wild-type and evolved Cas9 in a mammalian GFP activation assay.

FIG. 3—Cas9 Mammalian GFP Activation. Compared with WT Cas9, the evolved Cas9s showed much higher activity on both the TAA PAM (21.08% vs. 0.60% of cells above negative control) and a library of NNN PAM (22.76% vs. 3.38% of cells above negative control).

Evolved Cas9 Cutting Activity on Target Sequences with noncanonical PAM. In order to demonstrate that the PACE mutations universally confer Cas9 activity without PAM restriction, nuclease-active Cas9 proteins were generated based on the sequence provided in, i.e., without the D10A and H840A mutations, but harboring the various PACE mutations. The evolved Cas9 variants were tested in a Cas9 GFP assay, assessing the capacity of the evolved Cas9 protein variants to target and inactivate an emGFP gene integrated into the genome of HEK293 cells using a guide RNA targeting a sequence with a noncanonical PAM. It was observed that 6.45% of cells showed loss of GFP expression when contacted with a wild-type nuclease-active Cas9 (SEQ ID NO: 9), while 54.55% of cells contacted with the evolved Cas9 (E480K, E543D, E1219V, and T1329) showed a loss of GFP expression.

Example 3: Cas9 Variants without PAM Restrictions

The beneficial mutations conferring Cas9 activity on noncanonical PAM sequences were mapped to a S. pyogenes wild-type sequence. Below is an exemplary Cas9 sequence (S. pyogenes Cas9 with D10 and H840 residues marked with an asterisk following the respective amino acid residues, SEQ ID NO: 9). The D10 and H840 residues of SEQ ID NO: 9 may be mutated to generate a nuclease inactive Cas9 (e.g., to D10A and H840A) or to generate a nickase Cas9 (e.g., to D10A with H840; or to D10 with H840A). The HNH domain (bold and underlined) and the RuvC domain (boxed) are identified. The residues found mutated in the clones isolated from the various PACE experiments, amino acid residues 122, 137, 182, 262, 294, 409, 480, 543, 660, 694, 1219, and 1329 are identified with an asterisk following the respective amino acid residue.

(SEQ ID NO: 9)
MDKKYSIGLD*IGTNSVGWAVITDEYKVPSKKFKVLGNTDRHSIKKNLIGALLFDSGETAEATRLKRTARRRYTR

RKNRICYLQEIFSNEMAKVDDSFFHRLEESFLVEEDKKHERHPIFGNI*VDEVAYHEKYPTIYH*LRKKLVDSTD

KADLRLIYLALAHMIKFRGHFLIEGDLNPDNSDVD*KLFIQLVQTYNQLFEENPINASGVDAKAILSARLSKSRR

LENLIAQLPGEKKNGLFGNLIALSLGLTPNFKSNFDLAEDA*KLQLSKDTYDDDLDNLLAQIGDQYADLFLAAK*

NLSDAILLSDILRVNTEITKAPLSASMIKRYDEHHQDLTLLKALVRQQLPEKYKEIFFDQSKNGYAGYIDGGASQ

EEFYKFIKPILEKMDGTEELLVKLNREDLLRKQRTEDNGS*IPHQIHLGELHAILRRQEDFYPFLKDNREKIEKI

LTFRIPYYVGPLARGNSRFAWMTRKSEETITPWNFEE*VVDKGASAQSFIERMTNFDKNLPNEKVLPKHSLLYEY

FTVYNELTKVKYVTEGMRKPAFLSGE*QKKAIVDLLFKTNRKVTVKQLKEDYFKKIECEDSVEISGVEDRFNASL

GTYHDLLKIIKDKDFLDNEENEDILEDIVLTLTLFEDREMIEERLKTYAHLFDDKVMKQLKRRRYTGWG*RLSRK

LINGIRDKQSGKTILDFLKSDGFANRNFM*QLIHDDSLTFKEDIQKAQVSGQG[DSLHEHIANLAGSPAIKKGILQ

[TVKVVDELVKVMGRHKPENIVIEMA]RENQTTQKGQKNSRERMKRIEEGIKELGSQILKEHPVENTQLQNEKLYLY

**YLQNGRDMYVDQELDINRLSDYDVDH*IVPQSFLKDDSIDNKVLTRSDKNRGKSDNVPSEEVVKKMKNYWRQLLN**

AKLITQRKFDNLTKAERG[GLSELDKAGFIKRQLVETRQITKHVAQILDSRMNTKYDENDKLIREVKVITLKSKLV

SDFRKDFQFYKVREINNYHHAHDAYLNAVVGTALIKKYPKLESEFVYGDYKVYDVRKMIAKSEQEIGKATAKYFF]

-continued

YSNIMNFFKTEITLANGEIRKRPLIETNGETGEIVWDKGRDFATVRKVLSMPQVNIVKKTEVQTGGFSKESILPK

RNSDKLIARKKDWDPKKYGGFDSPTVAYSVLVVAKVEKGKSKKLKSVKELLGITIMERSSFEKNPIDFLEAKGYK

EVKKDLIIKLPKYSLFELENGRKRMLASAGE*LQKGNELALPSKYVNFLYLASHYEKLKGSPEDNEQKQLFVEQH

KHYLDEIIEQISEFSKRVILADANLDKVLSAYNKHRDKPIREQAENIIHLFTLTNLGAPAAFKYFDT*TIDRKRY

TSTKEVLDATLIHQSITGLYETRIDLSQLGGD

The beneficial mutations conferring Cas9 activity on noncanonical PAM sequences were mapped to additional exemplary wild-type Cas9 sequences. The HNH domain (bold and underlined) and the RuvC domain (boxed) are identified. The residues homologous to the residues found mutated in SEQ ID NO: 9, amino acid residues 122, 137, 182, 262, 294, 409, 480, 543, 660, 694, 1219, and 1329 are identified with an asterisk following the respective amino acid residue. In addition, amino acid residues 10 and 840, which are mutated in dCas9 protein variants, are also identified by an asterisk.

(SEQ ID NO: 297)
MDKK**YSIGLD\*IGTNSVGWAVITDDYKVPSKKFKVLGNTDRHSIKKNLIGALLFGSGET**AEATRLKRTARRRYTR

RKNRICYLQEIFSNEMAKVDDSFEHRLEESFLVEEDKKHERHPIEGNI*VDEVAYHEKYPTIYH*LRKKLADSTD

KADLRLIYLALAHMIKFRGHFLIEGDLNPDNSDVD*KLFIQLVQIYNQLFEENPINASRVDAKAILSARLSKSRR

LENLIAQLPGEKRNGLEGNLIALSLGLIPNFKSNFDLAEDA*KLQLSKDTYDDDLDNLLAQIGDQYADLFLAAK*

NLSDAILLSDILRVNSEITKAPLSASMIKRYDEHHQDLTLLKALVRQQLPEKYKEIFFDQSKNGYAGYIDGGASQ

EEFYKFIKPILEKMDGTEELLVKLNREDLLRKQRTFDNGS*IPHQIHLGELHAILRRQEDFYPFLKDNREKIEKI

LTFRIPYYVGPLARGNSRFAWMTRKSEETITPWNFEE*VVDKGASAQSFIERMTNFDKNLPNEKVLPKHSLLYEY

FTVYNELTKVKYVTEGMRKPAFLSGE*QKKAIVDLLFKTNRKVTVKQLKEDYFKKIECEDSVEISGVEDRFNASL

GAYHDLLKIIKDKDFLDNEENEDILEDIVLTLTLFEDRGMIEERLKTYAHLFDDKVMKQLKRRRYTGWG*RLSRK

LINGIRDKQSGKTILDFLKSDGFANRNFM*QLIHDDSLTFKEDIQKAQVSGQGHSLHEQIANLAGSPAIKKGILQ

TVKIVDELVKVMGHKPENIVIEMARENQTTQKGQKNSRERMKRIEEGIKELGSQILKEHPVENTQLQNEKLYLYY

**LQNGRDMYVDQELDINRLSDYDVDH\*IVPQSFIKDDSIDNKVLTRSDKNRGKSDNVPSEEVVKKMKNYWRQLLNA**

KLITQRKFDNLTKAERGGLSELDKAGFIKRQLVETRQITKHVAQILDSRMNTKYDENDKLIREVKVITLKSKLVS

DFRKDFQFYKVREINNYHHAHDAYLNAVVGTALIKKYPKLESEFVYGDYKVYDVRKMIAKSEQEIGKATAKYFFY

SNIMNFFKTEITLANGEIRKRPLIETNGETGEIVWDKGRDFATVRKVLSMPQVNIVKKTEVQTGGFSKESILPKP

NSDKLIARKKDWDPKKYGGFDSPIVAYSVLVVAKVEKGKSKKLKSVKELLGITIMERSSFEKNPIDFLEAKGYKE

VKKDLIIKLPKYSLFELENGRKRMLASAGE*LQKGNELALPSKYVNFLYLASHYEKLKGSPEDNEQKQLFVEQHK

HYLDEIIEQISEFSKRVILADANLDKVLSAYNKHRDKPIREQAENIIHLFTLINLGAPAAFKYFDT*TIDRKRYT

STKEVLDATLIHQSITGLYETRIDLSQLGGD (SEQ ID NO: 298)
MDKK**YSIGLA\*IGTNSVGWAVITDEYKVPSKKFKVLGNTDRHSIKKNLIGALLFDSGET**AEATRLKRTARRRYTR

RKNRICYLQEIFSNEMAKVDDSFFHRLEESELVEEDKKHERHPIFGNI*VDEVAYHEKYPTIYH*LRKKLVDSTD

KADLRLIYLALAHMIKFRGHFLIEGDLNPDNSDVD*KLFIQLVQTYNQLFEENPINASGVDAKAILSARLSKSRR

LENLIAQLPGEKKNGLFGNLIALSLGLIPNFKSNFDLAEDA*KLQLSKDTYDDDLDNLLAQIGDQYADLFLAAK*

NLSDAILLSDILRVNTEITKAPLSASMIKRYDEHHQDLTLLKALVRQQLPEKYKEIFFDQSKNGYAGYIDGGASQ

EEFYKFIKPILEKMDGTEELLVKLNREDLLRKQRTEDNGS*IPHQIHLGELHAILRRQEDFYPFLKDNREKIEKI

LTFRIPYYVGPLARGNSRFAWMTRKSEETITPWNFEE*VVDKGASAQSFIERMTNFDKNLPNEKVLPKHSLLYEY

-continued

FTVYNELTKVKYVTEGMRKPAFLSGE*QKKAIVDLLFKTNRKVTVKQLKEDYFKKIECFDSVEISGVEDRFNASL

GTYHDLLKIIKDKDFLDNEENEDILEDIVLILTLFEDREMIEERLKTYAHLFDDKVMKQLKRRRYTGWG*RLSRK

LINGIRDKQSGKTILDFLKSDGFANRNFM*QLIHDDSLTFKEDIQKAQVSGQG<u>DSLHEHIANLAGSPAIKKGILQ</u>

<u>TVKVVDELVKVMGRHKPENIVIEMA</u>RENQTTQKGQKNSRERMKRIEEGIKELGSQILKEHPVENTQLQNEKLYLY

**YLQNGRDMYVDQELDINRLSDYDVDH\*IVPQSFLKDDSIDNKVLTRSDKNRGKSDNVPSEEVVKKMKNYWRQLLN**

AKLITQRKFDNLTKAERG<u>GLSELDKAGFIKRQLVETRQITKHVAQILDSRMNTKYDENDKLIREVKVITLKSKLV</u>

<u>SDFRKDFQFYKVREINNYHHAHDAYLNAVVGTALIKKYPKLESEFVYGDYKVYDVRKMIAKSEQEIGKATAKYFF</u>

<u>YSNIMNFFKTEITLANGEIRKRPLIETNGETGEIVWDKGRDFATVRKVLSMPQVNIVKKTEVQT</u>GGFSKESILPK

RNSDKLIARKKDWDPKKYGGFDSPTVAYSVLVVAKVEKGKSKKLKSVKELLGITIMERSSFEKNPIDFLEAKGYK

EVKKDLIIKLPKYSLFELENGRKRMLASAGE*LQKGNELALPSKYVNFLYLASHYEKLKGSPEDNEQKQLFVEQH

KHYLDEIIEQISEFSKRVILADANLDKVLSAYNKHRDKPIREQAENIIHLFTLINLGAPAAFKYFDT*TIDRKRY

TSTKEVLDATLIHQSITGLYETRIDLSQLGGD

>gi|504540549|ref|WP_014727651.1| type II CRISPR RNA-guided endonuclease
Cas9 [*Streptococcus thermophilus*]

(SEQ ID NO: 260)

MTKP**YSIGLD\*IGTNSVGWAVITDNYKVPSKKMKVLGNTSKKYIKKNLLGVLLFDSGIT**AEGRRLKRTARRRYTR

RRNRILYLQEIFSTEMATLDDAFFQRLDDSFLVPDDKRDSKYPIFGNL*VEEKAYHDEEPTIYH*LRKYLADSTK

KADLRLVYLALAHMIKYRGHFLIEGEFNSKNNDIQ*KNFQDFLDTYNAIFESDLSLENSKQLEEIVKDKISKLEK

KDRILKLFPGEKNSGIFSEFLKLIVGNQADFRKCFNLDEKA*SLHFSKESYDEDLETLLGYIGDDYSDVFLKAK*

KLYDAILLSGFLTVTDNETEAPLSSAMIKRYNEHKEDLALLKEYIRNISLKTYNEVFKDDTKNGYAGYIDGKTNQ

EDFYVYLKNLLAEFEGADYFLEKIDREDFLRKQRTEDNGS*IPYQIHLQEMRAILDKQAKFYPFLAKNKERIEKI

LTFRIPYYVGPLARGNSDFAWSIRKRNEKITPWNFED*VIDKESSAEAFINRMTSFDLYLPEEKVLPKHSLLYET

FNVYNELTKVRFIAESMRDYQFLDSK*QKKDIVRLYFKDKRKVTDKDIIEYLHAIYGYDGIELKGIEKQFNSSLS

TYHDLLNIINDKEFLDDSSNEAIIEEIIHTLTIFEDREMIKQRLSKFENIFDKSVLKKLSRRHYTGWG*KLSAKL

INGIRDEKSGNTILDYLIDDGISNRNFM*QLIHDDALSFKKKIQKAQIIGDE<u>DKGNIKEVVKSLPGSPAIKKGIL</u>

<u>QSIKIVDELVKVMGGRKPESIVVEMA</u>RENQYTNQGKSNSQQRLKRLEKSLKELGSKILKENIPAKLSKIDNNALQ

**NDRLYLYYLQNGKDMYTGDDLDIDRLSNYDIDH\*IIPQAFLKDNSIDNKVLVSSASNRGKSDDFPSLEVVKKRKT**

FWYQLLKSKLISQRKFDNLTKAERG<u>GLLPEDKAGFIQRQLVETRQITKHVARLLDEKFNNKKDENNRAVRTVKII</u>

<u>TLKSTLVSQFRKDFELYKVREINDFHHAHDAYLNAVIASALLKKYPKLEPEFVYGDYPKYNSFRERKSATEKVYF</u>

<u>YSNIMNIFKKSISLADGRVIERPLIEVNEETGESVWNKESDLATVRRVLSYPQVNVVKKVEEQN</u>HGLDRGKPKGL

FNANLSSKPKPNSNENLVGAKEYLDPKKYGGYAGISNSFAVLVKGTIEKGAKKKITNVLEFQGISILDRINYRKD

KLNFLLEKGYKDIELIIELPKYSLFELSDGSRRMLASILSTNNKRGE*IHKGNQIFLSQKFVKLLYHAKRISNTI

NENHRKYVENHKKEFEELFYYILEFNENYVGAKKNGKLLNSAFQSWQNHSIDELCSSFIGPTGSERKGLFELTSR

GSAADFEFLGV*KIPRYRDYTPSSLLKDATLIHQSVTGLYETRIDLAKLGEG

>gi 924443546 | *Staphylococcus Aureus* Cas9

(SEQ ID NO: 261)

GSHMKRN**YILGLD\*IGITSVGYGIIDYETRDVIDAGVRLFKEANVEN**NEGRRSKRGARRLKRRRHRIQRVKKLL

FDYNLLTDHSELSGINP*YEARVKGLSQKLSEEEFSAALLHLAKRRGVHNVNEVEEDTGNELST*KEQISRNSKA

LEEKYVAELQLERLKKDGEVRGSINRFKTSDYVKEAKQLLKVQKAYHQLDQSFIDTYIDLLETRRTYYEGPGEGS

-continued

```
PFGWKDIKEWYEMLMGHCTYFPEELRSVKYAYNADLYNALNDLNNLVITRDENEKLEYY*EKFQIIENVEKQKKK

PTLKQIAKEILVNEEDIKGYRVTSTGKPEFTNLKVYHDIKDITARKEIIENAELLDQIAKILTIYQSSEDIQEEL

TNLNSELTQEEIEQISNLKGYTGTH*NLSLKAINLILDELWHTNDNQIAIFNRL*KLVPKKVDLSQQK EIPTTLV

DDFILSPVVKRSFIQSIKVINAIIKKYGLPNDIIIELA REKNSKDAQKMINE MQKRNRQTNERIEEIIRTTGKEN

AKYLIEKIKLHDMQEGKCLYSLEAIPLEDLLNNPFNYEVDH*IIPRSVSFDNSFNNKVLVKQEEASKKGNRTPFQ

YLSSSDSKISYETFKKHILNLAKGKGRISK TKKE YLLEERDINRFSVQKDFINRNLVDTRYATRGLMNLLRSYFR

VNNLDVKVKSINGGFTSFLRRKWKFKKERNKGYKHHAEDALIIANADFIPKEWKKLDKAKKVMENQMFEEKQAES

MPEIETEQEYKEIFITPHQIKHIKDFKDYKYSHRVDKKPNRELINDTLYST RKDDKGNTLIVNNLNGLYDKDNDK

LKKLINKSPEKLLMYHHDPQTYQKLKLIMEQYGDEKNPLYKYYEETGNYLTKYSKKDNGPVIKKIKYYGNKLNAH

LDITDDYPNS*RNKVVKLSLKPYRFDVYLDNGVYKFVTVKNLDVIKKENYYEVNSKAYEEAKKLKKISNQAEFIA

SFYNNDLIKINGELYRVIGVNNDLLNRIEVNMIDITYREYLEN*MNDKRPPRIIKTIASKTQSIKKYSTDILGNL

YEVKSKKHPQIIKKG
```

This disclosure provides Cas9 variants in which one or more of the amino acid residues identified by an asterisk are mutated as described herein. In some embodiments, the D10 and H840 residues are mutated, e.g., to an alanine residue, and the Cas9 variants provided include one or more additional mutations of the amino acid residues identified by an asterisk as provided herein. In some embodiments, the D10 residue is mutated, e.g., to an alanine residue, and the Cas9 variants provided include one or more additional mutations of the amino acid residues identified by an asterisk as provided herein.

A number of Cas9 sequences from various species were aligned to determine whether corresponding homologous amino acid residues can be identified in other Cas9 proteins, allowing the generation of Cas9 variants with corresponding mutations of the homologous amino acid residues. The alignment was carried out using the NCBI Constraint-based Multiple Alignment Tool (COBALT(accessible at st-va.ncbi.nlm.nih.gov/tools/cobalt), with the following parameters. Alignment parameters: Gap penalties −11,−1; End-Gap penalties −5,−1. CDD Parameters: Use RPS BLAST on; Blast E-value 0.003; Find Conserved columns and Recompute on. Query Clustering Parameters: Use query clusters on; Word Size 4; Max cluster distance 0.8; Alphabet Regular.

An exemplary alignment of four Cas9 sequences is provided below. The Cas9 sequences in the alignment are: Sequence 1 (S1): SEQ ID NO: 10|WP_010922251| gi 499224711| type II CRISPR RNA-guided endonuclease Cas9 [Streptococcus pyogenes]; Sequence 2 (S2): SEQ ID NO: 11|WP_039695303|gi 746743737|type II CRISPR RNA-guided endonuclease Cas9 [Streptococcus gallolyticus]; Sequence 3 (S3): SEQ ID NO: 12|WP_045635197|gi 782887988|type II CRISPR RNA-guided endonuclease Cas9 [Streptococcus mitis]; Sequence 4 (S4): SEQ ID NO: 13|5AXW_A|gi 924443546|Staphylococcus Aureus Cas9. The HNH domain (bold and underlined) and the RuvC domain (boxed) are identified for each of the four sequences. Amino acid residues 10, 122, 137, 182, 262, 294, 409, 480, 543, 660, 694, 840, 1219, and 1329 in S1 and the homologous amino acids in the aligned sequences are identified with an asterisk following the respective amino acid residue.

```
S1    1  --MDKK-YSIGLD*IGTNSVGWAVITDEYKVPSKKFKVLGNTDRHSIKKNLI--GALLFDSG--ETAEATRLKRTARRRYT    73

S2    1  --MTKKNYSIGLD*IGTNSVGWAVITDDYKVPAKKMKVLGNTDKKYIKKNLL--GALLFDSG--ETAEATRLKRTARRRYT    74

S3    1  --M-KKGYSIGLD*IGTNSVGFAVITDDYKVPSKKMKVLGNTDKRFIKKNLI--GALLFDEG--TTAEARRLKRTARRRYT    73

S4    1  GSHMKRNYILGLD*IGITSVGYGII--DYET----------------RDVIDAGVRLFKEANVENNEGRRSKRGARRLKR    61

S1   74  RRKNRICYLQEIFSNEMAKVDDSFFHRLEESELVEEDKKHERHPIFGNI*VDEVAYHEKYPTIYH*LRKKLVDSTDKADLRL   153

S2   75  RRKNRLRYLQEIFANEIAKVDESFFQRLDESFLTDDDKTFDSHPIFGNK*AEEDAYHQKFPTIYH*LRKHLADSSEKADLRL   154

S3   74  RRKNRLRYLQEIFSEEMSKVDSSFFHRLDDSFLIPEDKRESKYPIFATL*TEEKEYHKQFPTIYH*LRKQLADSKEKTDLRL   153

S4   62  RRRHRIQRVKKLL--------------FDYNLLTD--------------------HSELSGINP*YEARVKGLSQKLSEEE   107

S1  154  IYLALAHMIKFRGHFLIEGDLNPDNSDVD*KLFIQLVQTYNQLFEENPINASGVDAKAILSARLSKSRRLENLIAQLPGEK    233

S2  155  VYLALAHMIKFRGHFLIEGELNAENTDVQ*KIFADFVGVYNRTFDDSHLSEITVDVASILTEKISKSRRLENLIKYYPTEK    234

S3  154  IYLALAHMIKYRGHFLYEEAFDIKNNDIQ*KIFNEFISIYDNTFEGSSLSGQNAQVEAIFTDKISKSAKRERVLKLFPDEK    233
```

```
                                       -continued
S4   108 FSAALLHLAKRRG---------------------VHNVNEVEEDT----------------------------------  131

S1   234 KNGLFGNLIALSLGLTPNFKSNFDLAEDA*KLQLSKDTYDDDLDNLLAQIGDQYADLFLAAK*NLSDAILLSDILRVNTEIT  313

S2   235 KNTLFGNLIALALGLQPNFKTNFKLSEDA*KLQFSKDTYEEDLEELLGKIGDDYADLFTSAK*NLYDAILLSGILTVDDNST  314

S3   234 STGLFSEFLKLIVGNQADFKKHFDLEDKA*PLQFSKDTYDEDLENLLGQIGDDFTDLFVSAK*KLYDAILLSGILTVTDPST  313

S4   132 -----GNELS------------------T*KEQISRN-------------------------------------------  144

S1   314 KAPLSASMIKRYDEHHQDLTLLKALVRQQLPEKYKEIFFDQSKNGYAGYIDGGASQEEFYKFIKPILEKM--DGTEELLV   391

S2   315 KAPLSASMIKRYVEHHEDLEKLKEFIKANKSELYHDIFKDKNKNGYAGYIENGVKQDEFYKYLKNILSKIKIDGSDYFLD   394

S3   314 KAPLSASMIERYENHQNDLAALKQFIKNNLPEKYDEVFSDQSKDGYAGYIDGKTTQETFYKYIKNLLSKF--EGTDYFLD   391

S4   145 ----SKALEEKYVAELQ------------------------------------------------LERLKKDG------  165

S1   392 KLNREDLLRKQRTFDNGS*IPHQIHLGELHAILRRQEDFYPFLKDNREKIEKILTFRIPYYVGPLARGNSRFAWMTRKSEE  471

S2   395 KIEREDFLRKQRTFDNGS*IPHQIHLQEMHAILRRQGDYYPFLKEKQDRIEKILTFRIPYYVGPLVRKDSRFAWAEYRSDE  474

S3   392 KIEREDFLRKQRTFDNGS*IPHQIHLQEMNAILRRQGEYYPFLKDNKEKIEKILTFRIPYYVGPLARGNRDFAWLTRNSDE  471

S4   166 --EVRGSINRFKTSD---------YVKEAKQLLKVQKAYHQLDQSFIDTYIDLLETRRTYYEGP--GEGSPFGW------K  227

S1   472 TITPWNFEE*VVDKGASAQSFIERMTNEDKNLPNEKVLPKHSLLYEYFTVYNELTKVKYVTEGMRKPAFLSGE*QKKAIVDL  551

S2   475 KITPWNFDK*VIDKEKSAEKFITRMTLNDLYLPEEKVLPKHSHVYETYAVYNELTKIKYVNEQGKE-SFFDSN*MKQEIFDH  553

S3   472 AIRPWNFEE*IVDKASSAEDFINKMTNYDLYLPEEKVLPKHSLLYETFAVYNELTKVKFIAEGLRDYQFLDSG*QKKQIVNQ  551

S4   228 DIKEW---------------YEMLMGHCTYFPEELRSVKYAYNADLYNALNDLNNLVITRDENEK---LEYY*EKFQIIEN  289

S1   552 LFKTNRKVTVKQLKEDYFKKIECFDSVEISGVEDR---FNASLGTYHDLLKIIKDKDFLDNEENEDILEDIVLTLTLFED   628

S2   554 VFKENRKVTKEKLLNYLNKEFPEYRIKDLIGLDKENKSFNASLGTYHDLKKIL-DKAFLDDKVNEEVIEDIIKTLTLFED   632

S3   552 LFKENRKVTEKDIIHYLHN-VDGYDGIELKGIEKQ---FNASLSTYHDLLKIIKDKEFMDDAKNEAILENIVHTLTIFED   627

S4   290 VFKQKKKPTLKQIAKEILVNEEDIKGYRVTSTGKPEF---TNLKVYHDIKDITARKEII---ENAELLDQIAKILTIYQS   363

S1   629 REMIEERLKTYAHLFDDKVMKQLKR-RRYTGWG*RLSRKLINGIRDKQSGKTILDFLKSDGFANRNFM*QLIHDDSLTEKED  707

S2   633 KDMIHERLQKYSDIFTANQLKKLER-RHYTGWG*RLSYKLINGIRNKENNKTILDYLIDDGSANRNFM*QLINDDTLPFKQI  711

S3   628 REMIKQRLAQYDSLFDEKVIKALTR-RHYTGWG*KLSAKLINGICDKQTGNTILDYLIDDGKINRNFM*QLINDDGLSFKEI  706

S4   364 SEDIQEELTNLNSELTQEEIEQISNLKGYTGTH*NLSLKAINLILDE------LWHTNDNQIAIFNRL*KLVP---------  428

S1   708 IQKAQVSGQQ[DSLHEHIANLAGSPAIKKGILQTVKVVDELVKVMGRHKPENIVIEMA]RENQTT------QKGQKNSRERM  781

S2   712 IQKSQVVGDV[DDIEAVVHDLPGSPAIKKGILQSVKIVDELVKVMG-GNPDNIVIEMA]RENQTT------NRGRSQSQQRL  784

S3   707 IQKAQVIGKT[DDVKQVVQELSGSPAIKKGILQSIKIVDELVKVMG-HAPESIVIEMA]RENQTT------ARGKKNSQQRY  779

S4   429 -KKVDLSQQK[EIPTTLVDDFILSPVVKRSFIQSIKVINAIIKKYG--LPNDIIIELA]REKNSKDAQKMINEMQKPNRQTN  505

S1   782 KRIEEGIKELGSQIL-------KEHPVENTQLQNEKLYLYLQNGRDMYVDQELDINRLSD----YDVDH*IVPQSFLKDD   850

S2   785 KKLQNSLKELGSNILNEEKPSYIEDKVENSHLQNDQLFYYIQNGKDMYTGDELDIDHLSD----YDIDH*IIPQAFIKDD   860

S3   780 KRIEDSLKILASGL----DSNILKENPTDNNQLQNDRLFLYYLQNGKDMYTGEALDINQLSS----YDIDH*IIPQAFIKDD   852

S4   506 ERIEEIIRTTGK---------------ENAKYLIEKIKLHDMQEGKCLYSLEAIPLEDLLNNPFNYEVDH*IIPRSVSFDN   570

S1   851 SIDNKVLTRSDKNRGKSDNVPSEEVVKKMKNYWRQLLNAKLITQRKFDN-LTKAERG[GL-SELD------KAGFIKRQLV]  922

S2   861 SIDNRVLTSSAKNRGKSDDVPSLDIVRARKAEWVRLYKSGLISKRKFDN-LTKAERG[GL-TEAD------KAGFIKRQLV]  932

S3   853 SLDNRVLTSSKDNRGKSDNVPSIEVVQKRKAFWQQLLDSKLISERKFNN-LTKAERG[GL-DERD------KVGFIKRQLV]  924

S4   571 SFNNKVLVKQEEASKKGNRTPFQYLSSSDSKISYETFKKHILNLAKGKGRISKTKKE[YLLEERDINRFSVQKDFINRNLV]  650
```

```
S1   923  ETRQITKHVAQILDSRMNTKYDENDKLIREVKVITLKSKLVSDFRKDFQFYKVREINNYHHAHDAYLNAVVGTALIKKYP  1002

S2   933  ETRQITKHVAQILDARFNTEHDENDKVIRDVKVITLKSNLVSQFRKDFEFYKVREINDYHHAHDAYLNAVVGTALLKKYP  1012

S3   925  ETRQITKHVAQILDARYNTEVNEKDKKNRTVKIITLKSNLVSNFRKEFRLYKVREINDYHHAHDAYLNAVVAKAILKKYP  1004

S4   651  DTRYATRGLMNLLRSYFRVN-------NLDVKVKSINGGFTSFLRRKWKFKKERNKGYKHHAEDALIIA----------  712

S1  1003  KLESEFVYGDYKVYDVRKMIAKSEQ--EIGKATAKYFFYSNIMNFFKTEITLANGEIRKRPLIETNGETGEIVWDKG---  1077

S2  1013  KLASEFVYGEYKKYDIRKFITNSSD-----KATAKYFFYSNLMNFFKTKVKYADGTVFPERPIIETNAD-GEIAWNKQ---  1083

S3  1005  KLEPEFVYGEYQKYDLKRYISRSKDPKEVEKATEKYFFYSNLLNFFKEEVHYADGTIVKRENIEYSKDTGEIAWNKE---  1081

S4   713  --NADFIFKWEWKKLDKAKKVMENQM------------------------FEEKQAESMPEIETEQEYKEIFITPHQIK  764

S1  1078  -----RDFATVRKVLSMPQVNIVKKTEVQTGGFSKESILPKRNSDKLIARKKD---WDPKKYGGFDSPTVAYSVLVVAKV  1149

S2  1084  -----IDFEKVRKVLSYPQVNIVKKVETQTGGFSKESILPKGDSDKLIPRKTKKVYWDTKKYGGFDSPTVAYSVFVVADV  1158

S3  1082  -----KDFAIIKKVLSLPQVNIVKKREVQTGGFSKESILPKGNSDKLIPRKTKDILLDTTKYGGFDSPVIAYSILLIADI  1156

S4   765  HIKDFKDYKYSHRVDKKPNRELINDTLYSTRKDDKGNTLIVNNLNGLYDKDNDKL----KKLIN-KSP----EKLLMYHH  835

S1  1150  EKGKSKKLKSVKELLGITIMERSSFEKNPI-DFLEAKG-----YKEVKKDLIIKLPKYSLFELENGRKRMLASAGE*LQKG  1223

S2  1159  EKGKAKKLKTVKELVGISIMERSFFEENPV-EFLENKG-----YHNIREDKLIKLPKYSLFEFEGGRRRLLASASE*LQKG  1232

S3  1157  EKGKAKKLKTVKTLVGITIMEKAAFEENPI-TFLENKG-----YHNVRKENILCLPKYSLFELENGRRRLLASAKE*LQKG  1230

S4   836  DPQTYQKLK--------LIMEQYGDEKNPLYKYYEETGNYLTKYSKKDNGPVIKKIKYYGNKLNAHLDITDDYPNS*RNKV  907

S1  1224  NELALPSKYVNFLYLASHYEKLKGSPEDNEQKQLFVEQHKHYLDEIIEQISEFSKRVILADANLDKVLSAYNKH------  1297

S2  1233  NEMVLPGYLVELLYHAHRADNF-----NSTEYLNYVSEHKKEFEKVLSCVEDFANLYVDVEKNLSKIRAVADSM------  1301

S3  1231  NEIVLPVYLTTLLYHSKNVHKL-----DEPGHLEYIQKHRNEFKDLLNLVSEFSQKYVLADANLEKIKSLYADN------  1299

S4   908  VKLSLKPYRFD-VYLDNGVYKFV-----TVKNLDVIK--KENYYEVNSKAYEEAKKLKKISNQAEFIASFYNNDLIKING  979

S1  1298  RDKPIREQAENIIHLFTLTNLGAPAAFKYFDT*TIDRKRYTSTKEVLDATLIHQSIT--------GLYETRI----DLSQL  1365

S2  1302  DNFSIEEISNSFINLLTLTALGAPADFNFLGE*KIPRKRYTSTKECLNATLIHQSIT--------GLYETRI----DLSKL  1369

S3  1300  EQADIEILANSFINLLTFTALGAPAAFKFFGK*DIDRKRYTTVSEILNATLIHQSIT--------GLYETWI----DLSKL  1367

S4   980  ELYRVIGVNNDLLNRIEVNMIDITYR-EYLEN*MNDKRPPRIIKTIASKT---QSIKKYSTDILGNLYEVKSKKHPQIIKK  1055

S1  1366  GGD  1368

S2  1370  GEE  1372

S3  1368  GED  1370

S4  1056  G--  1056
```

The alignment demonstrates that amino acid sequences and amino acid residues that are homologous to a reference Cas9 amino acid sequence or amino acid residue can be identified across Cas9 sequence variants, including, but not limited to Cas9 sequences from different species, by identifying the amino acid sequence or residue that aligns with the reference sequence or the reference residue using alignment programs and algorithms known in the art. This disclosure provides Cas9 variants in which one or more of the amino acid residues identified by an asterisk in SEQ ID NO: 9 are mutated as described herein. The residues in Cas9 sequences other than SEQ ID NO: 9 that correspond to the residues identified in SEQ ID NO: 9 by an asterisk are referred to herein as "homologous" or "corresponding" residues. Such homologous residues can be identified by sequence alignment, e.g., as described above, and by identifying the sequence or residue that aligns with the reference sequence or residue. Similarly, mutations in Cas9 sequences other than SEQ ID NO: 9 that correspond to mutations identified in SEQ ID NO: 9 herein, e.g., mutations of residues 10, 122, 137, 182, 262, 294, 409, 480, 543, 660, 694, 840, 1219, and 1329 in SEQ ID NO: 9, are referred to herein as "homologous" or "corresponding" mutations. For example, the mutations corresponding to the D10A mutation in S1 for the four aligned sequences above are D10A for S2, D9A for S3, and D13A for S4; the corresponding mutations for H840A in S1 are H850A for S2, H842A for S3, and H560 for S4; the corresponding mutation for X1219V in S1 are X1228V for S2, X1226 for S3, and X903V for S4, and so on.

A total of 250 Cas9 sequences (SEQ ID NOs: 10-262) from different species were aligned using the same algorithm and alignment parameters outlined above. Amino acid residues homologous to residues 10, 122, 137, 182, 262, 294, 409, 480, 543, 660, 694, 840, 1219, and 1329 were identified in the same manner as outlined above. The alignments are provided below. The HNH domain (bold and underlined) and the RuvC domain (boxed) are identified for each of the four sequences. Residues corresponding to amino acid residues 10, 122, 137, 182, 262, 294, 409, 480, 543, 660, 694, 840, 1219, and 1329 in SEQ ID NO: 9 are boxed in SEQ ID NO: 10 in the alignments, allowing for the identification of the corresponding amino acid residues in the aligned sequences.

Cas9 variants with one or more mutations in amino acid residues homologous to amino acid residues 122, 137, 182, 262, 294, 409, 480, 543, 660, 694, 1219, and 1329 of SEQ ID NO: 9 are provided herein. In some embodiments, the Cas9 variants provided herein comprise mutations corresponding to the D10A and the H840A mutations in SEQ ID NO: 9, resulting in a nuclease-inactive dCas9, and at least one, at least two, at least three, at least four, at least five, at least six, or at least seven mutations of amino acid residues homologous to amino acid residues 122, 137, 182, 262, 294, 409, 480, 543, 660, 694, 1219, and 1329 of SEQ ID NO: 9.

Cas9 variants with one or more mutations in amino acid residues homologous to amino acid residues 122, 137, 182, 262, 294, 409, 480, 543, 660, 694, 1219, and 1329 of SEQ ID NO: 9 are provided herein. In some embodiments, the Cas9 variants provided herein comprise mutations corresponding to the D10A mutations in SEQ ID NO: 9, resulting in a partially nuclease-inactive dCas9, wherein the Cas9 can nick the non-target strand but not the targeted strand, and at least one, at least two, at least three, at least four, at least five, at least six, or at least seven mutations of amino acid residues homologous to amino acid residues 122, 137, 182, 262, 294, 409, 480, 543, 660, 694, 1219, and 1329 of SEQ ID NO: 9.

| | | |
|---|---|---|
| WP_010922251.1 | type II CRISPR RNA-guided endonuclease Cas9 [Streptococcus pyogenes] | SEQ ID NO: 10 |
| WP_039695303.1 | type II CRISPR RNA-guided endonuclease Cas9 [Streptococcus gallolyticus] | SEQ ID NO: 11 |
| WP_045635197.1 | type II CRISPR RNA-guided endonuclease Cas9 [Streptococcus mitis] | SEQ ID NO: 12 |
| 5AXW_A | Cas9, Chain A, Crystal Structure [Staphylococcus aureus] | SEQ ID NO: 13 |
| WP_009880683.1 | type II CRISPR RNA-guided endonuclease Cas9 [Streptococcus pyogenes] | SEQ ID NO: 14 |
| WP_010922251.1 | type II CRISPR RNA-guided endonuclease Cas9 [Streptococcus pyogenes] | SEQ ID NO: 15 |
| WP_011054416.1 | type II CRISPR RNA-guided endonuclease Cas9 [Streptococcus pyogenes] | SEQ ID NO: 16 |
| WP_011284745.1 | type II CRISPR RNA-guided endonuclease Cas9 [Streptococcus pyogenes] | SEQ ID NO: 17 |
| WP_011285506.1 | type II CRISPR RNA-guided endonuclease Cas9 [Streptococcus pyogenes] | SEQ ID NO: 18 |
| WP_011527619.1 | type II CRISPR RNA-guided endonuclease Cas9 [Streptococcus pyogenes] | SEQ ID NO: 19 |
| WP_012560673.1 | type II CRISPR RNA-guided endonuclease Cas9 [Streptococcus pyogenes] | SEQ ID NO: 20 |
| WP_014407541.1 | type II CRISPR RNA-guided endonuclease Cas9 [Streptococcus pyogenes] | SEQ ID NO: 21 |
| WP_020905136.1 | type II CRISPR RNA-guided endonuclease Cas9 [Streptococcus pyogenes] | SEQ ID NO: 22 |
| WP_023080005.1 | type II CRISPR RNA-guided endonuclease Cas9 [Streptococcus pyogenes] | SEQ ID NO: 23 |
| WP_023610282.1 | type II CRISPR RNA-guided endonuclease Cas9 [Streptococcus pyogenes] | SEQ ID NO: 24 |
| WP_030125963.1 | type II CRISPR RNA-guided endonuclease Cas9 [Streptococcus pyogenes] | SEQ ID NO: 25 |
| WP_030126706.1 | type II CRISPR RNA-guided endonuclease Cas9 [Streptococcus pyogenes] | SEQ ID NO: 26 |
| WP_031488318.1 | type II CRISPR RNA-guided endonuclease Cas9 [Streptococcus pyogenes] | SEQ ID NO: 27 |
| WP_032460140.1 | type II CRISPR RNA-guided endonuclease Cas9 [Streptococcus pyogenes] | SEQ ID NO: 28 |
| WP_032461047.1 | type II CRISPR RNA-guided endonuclease Cas9 [Streptococcus pyogenes] | SEQ ID NO: 29 |
| WP_032462016.1 | type II CRISPR RNA-guided endonuclease Cas9 [Streptococcus pyogenes] | SEQ ID NO: 30 |
| WP_032462936.1 | type II CRISPR RNA-guided endonuclease Cas9 [Streptococcus pyogenes] | SEQ ID NO: 31 |
| WP_032464890.1 | type II CRISPR RNA-guided endonuclease Cas9 [Streptococcus pyogenes] | SEQ ID NO: 32 |
| WP_033888930.1 | type II CRISPR RNA-guided endonuclease Cas9 [Streptococcus pyogenes] | SEQ ID NO: 33 |
| WP_038431314.1 | type II CRISPR RNA-guided endonuclease Cas9 [Streptococcus pyogenes] | SEQ ID NO: 34 |
| WP_038432938.1 | type II CRISPR RNA-guided endonuclease Cas9 [Streptococcus pyogenes] | SEQ ID NO: 35 |
| WP_038434062.1 | type II CRISPR RNA-guided endonuclease Cas9 [Streptococcus pyogenes] | SEQ ID NO: 36 |
| BAQ51233.1 | CRISPR-associated protein, Csn1 family [Streptococcus pyogenes] | SEQ ID NO: 37 |
| KGE60162.1 | hypothetical protein MGAS2111_0903 [Streptococcus pyogenes MGAS2111] | SEQ ID NO: 38 |
| KGE60856.1 | CRISPR-associated endonuclease protein [Streptococcus pyogenes SS1447] | SEQ ID NO: 39 |
| WP_002989955.1 | MULTISPECIES: type II CRISPR RNA-guided endonuclease Cas9 [Streptococcus] | SEQ ID NO: 40 |
| WP_003000002.1 | MULTISPECIES: type II CRISPR RNA-guided endonuclease Cas9 [Streptococcus] | SEQ ID NO: 41 |
| WP_003065552.1 | MULTISPECIES: type II CRISPR RNA-guided endonuclease Cas9 [Streptococcus] | SEQ ID NO: 42 |
| WP_001040076.1 | type II CRISPR RNA-guided endonuclease Cas9 [Streptococcus agalactiae] | SEQ ID NO: 43 |
| WP_001040078.1 | type II CRISPR RNA-guided endonuclease Cas9 [Streptococcus agalactiae] | SEQ ID NO: 44 |
| WP_001040080.1 | type II CRISPR RNA-guided endonuclease Cas9 [Streptococcus agalactiae] | SEQ ID NO: 45 |
| WP_001040081.1 | type II CRISPR RNA-guided endonuclease Cas9 [Streptococcus agalactiae] | SEQ ID NO: 46 |
| WP_001040083.1 | type II CRISPR RNA-guided endonuclease Cas9 [Streptococcus agalactiae] | SEQ ID NO: 47 |
| WP_001040085.1 | type II CRISPR RNA-guided endonuclease Cas9 [Streptococcus agalactiae] | SEQ ID NO: 48 |
| WP_001040087.1 | type II CRISPR RNA-guided endonuclease Cas9 [Streptococcus agalactiae] | SEQ ID NO: 49 |
| WP_001040088.1 | type II CRISPR RNA-guided endonuclease Cas9 [Streptococcus agalactiae] | SEQ ID NO: 50 |
| WP_001040089.1 | type II CRISPR RNA-guided endonuclease Cas9 [Streptococcus agalactiae] | SEQ ID NO: 51 |
| WP_001040090.1 | type II CRISPR RNA-guided endonuclease Cas9 [Streptococcus agalactiae] | SEQ ID NO: 52 |
| WP_001040091.1 | type II CRISPR RNA-guided endonuclease Cas9 [Streptococcus agalactiae] | SEQ ID NO: 53 |
| WP_001040092.1 | type II CRISPR RNA-guided endonuclease Cas9 [Streptococcus agalactiae] | SEQ ID NO: 54 |
| WP_001040094.1 | type II CRISPR RNA-guided endonuclease Cas9 [Streptococcus agalactiae] | SEQ ID NO: 55 |
| WP_001040095.1 | type II CRISPR RNA-guided endonuclease Cas9 [Streptococcus agalactiae] | SEQ ID NO: 56 |
| WP_001040096.1 | type II CRISPR RNA-guided endonuclease Cas9 [Streptococcus agalactiae] | SEQ ID NO: 57 |
| WP_001040097.1 | type II CRISPR RNA-guided endonuclease Cas9 [Streptococcus agalactiae] | SEQ ID NO: 58 |
| WP_001040098.1 | type II CRISPR RNA-guided endonuclease Cas9 [Streptococcus agalactiae] | SEQ ID NO: 59 |
| WP_001040099.1 | type II CRISPR RNA-guided endonuclease Cas9 [Streptococcus agalactiae] | SEQ ID NO: 60 |
| WP_001040100.1 | type II CRISPR RNA-guided endonuclease Cas9 [Streptococcus agalactiae] | SEQ ID NO: 61 |

| Accession | Description | SEQ ID NO |
|---|---|---|
| WP_001040104.1 | type II CRISPR RNA-guided endonuclease Cas9 [Streptococcus agalactiae] | SEQ ID NO: 62 |
| WP_001040105.1 | type II CRISPR RNA-guided endonuclease Cas9 [Streptococcus agalactiae] | SEQ ID NO: 63 |
| WP_001040106.1 | type II CRISPR RNA-guided endonuclease Cas9 [Streptococcus agalactiae] | SEQ ID NO: 64 |
| WP_001040107.1 | type II CRISPR RNA-guided endonuclease Cas9 [Streptococcus agalactiae] | SEQ ID NO: 65 |
| WP_001040108.1 | type II CRISPR RNA-guided endonuclease Cas9 [Streptococcus agalactiae] | SEQ ID NO: 66 |
| WP_001040109.1 | type II CRISPR RNA-guided endonuclease Cas9 [Streptococcus agalactiae] | SEQ ID NO: 67 |
| WP_001040110.1 | type II CRISPR RNA-guided endonuclease Cas9 [Streptococcus agalactiae] | SEQ ID NO: 68 |
| WP_015058523.1 | type II CRISPR RNA-guided endonuclease Cas9 [Streptococcus agalactiae] | SEQ ID NO: 69 |
| WP_017643650.1 | type II CRISPR RNA-guided endonuclease Cas9 [Streptococcus agalactiae] | SEQ ID NO: 70 |
| WP_017647151.1 | type II CRISPR RNA-guided endonuclease Cas9 [Streptococcus agalactiae] | SEQ ID NO: 71 |
| WP_017648376.1 | type II CRISPR RNA-guided endonuclease Cas9 [Streptococcus agalactiae] | SEQ ID NO: 72 |
| WP_017649527.1 | type II CRISPR RNA-guided endonuclease Cas9 [Streptococcus agalactiae] | SEQ ID NO: 73 |
| WP_017771611.1 | type II CRISPR RNA-guided endonuclease Cas9 [Streptococcus agalactiae] | SEQ ID NO: 74 |
| WP_017771984.1 | type II CRISPR RNA-guided endonuclease Cas9 [Streptococcus agalactiae] | SEQ ID NO: 75 |
| CFQ25032.1 | CRISPR-associated protein [Streptococcus agalactiae] | SEQ ID NO: 76 |
| CFV16040.1 | CRISPR-associated protein [Streptococcus agalactiae] | SEQ ID NO: 77 |
| KLJ37842.1 | CRISPR-associated protein Csn1 [Streptococcus agalactiae] | SEQ ID NO: 78 |
| KLJ72361.1 | CRISPR-associated protein Csn1 [Streptococcus agalactiae] | SEQ ID NO: 79 |
| KLL20707.1 | CRISPR-associated protein Csn1 [Streptococcus agalactiae] | SEQ ID NO: 80 |
| KLL42645.1 | CRISPR-associated protein Csn1 [Streptococcus agalactiae] | SEQ ID NO: 81 |
| WP_047207273.1 | type II CRISPR RNA-guided endonuclease Cas9 [Streptococcus agalactiae] | SEQ ID NO: 82 |
| WP_047209694.1 | type II CRISPR RNA-guided endonuclease Cas9 [Streptococcus agalactiae] | SEQ ID NO: 83 |
| WP_050198062.1 | type II CRISPR RNA-guided endonuclease Cas9 [Streptococcus agalactiae] | SEQ ID NO: 84 |
| WP_050201642.1 | type II CRISPR RNA-guided endonuclease Cas9 [Streptococcus agalactiae] | SEQ ID NO: 85 |
| WP_050204027.1 | type II CRISPR RNA-guided endonuclease Cas9 [Streptococcus agalactiae] | SEQ ID NO: 86 |
| WP_050881965.1 | type II CRISPR RNA-guided endonuclease Cas9 [Streptococcus agalactiae] | SEQ ID NO: 87 |
| WP_050886065.1 | type II CRISPR RNA-guided endonuclease Cas9 [Streptococcus agalactiae] | SEQ ID NO: 88 |
| AHN30376.1 | CRISPR-associated protein Csn1 [Streptococcus agalactiae 138P] | SEQ ID NO: 89 |
| EAO78426.1 | reticulocyte binding protein [Streptococcus agalactiae H36B] | SEQ ID NO: 90 |
| CCW42055.1 | CRISPR-associated protein, SAG0894 family [Streptococcus agalactiae ILRI112] | SEQ ID NO: 91 |
| WP_003041502.1 | type II CRISPR RNA-guided endonuclease Cas9 [Streptococcus anginosus] | SEQ ID NO: 92 |
| WP_037593752.1 | type II CRISPR RNA-guided endonuclease Cas9 [Streptococcus anginosus] | SEQ ID NO: 93 |
| WP_049516684.1 | CRISPR-associated protein Csn1 [Streptococcus anginosus] | SEQ ID NO: 94 |
| GAD46167.1 | hypothetical protein ANG6_0662 [Streptococcus anginosus T5] | SEQ ID NO: 95 |
| WP_018363470.1 | type II CRISPR RNA-guided endonuclease Cas9 [Streptococcus caballi] | SEQ ID NO: 96 |
| WP_003043819.1 | type II CRISPR RNA-guided endonuclease Cas9 [Streptococcus canis] | SEQ ID NO: 97 |
| WP_006269658.1 | type II CRISPR RNA-guided endonuclease Cas9 [Streptococcus constellatus] | SEQ ID NO: 98 |
| WP_048800889.1 | type II CRISPR RNA-guided endonuclease Cas9 [Streptococcus constellatus] | SEQ ID NO: 99 |
| WP_012767106.1 | type II CRISPR RNA-guided endonuclease Cas9 [Streptococcus dysgalactiae] | SEQ ID NO: 100 |
| WP_014612333.1 | type II CRISPR RNA-guided endonuclease Cas9 [Streptococcus dysgalactiae] | SEQ ID NO: 101 |
| WP_015017095.1 | type II CRISPR RNA-guided endonuclease Cas9 [Streptococcus dysgalactiae] | SEQ ID NO: 102 |
| WP_015057649.1 | type II CRISPR RNA-guided endonuclease Cas9 [Streptococcus dysgalactiae] | SEQ ID NO: 103 |
| WP_048327215.1 | type II CRISPR RNA-guided endonuclease Cas9 [Streptococcus dysgalactiae] | SEQ ID NO: 104 |
| WP_049519324.1 | CRISPR-associated protein Csn1 [Streptococcus dysgalactiae] | SEQ ID NO: 105 |
| WP_012515931.1 | type II CRISPR RNA-guided endonuclease Cas9 [Streptococcus equi] | SEQ ID NO: 106 |
| WP_021320964.1 | type II CRISPR RNA-guided endonuclease Cas9 [Streptococcus equi] | SEQ ID NO: 107 |
| WP_037581760.1 | type II CRISPR RNA-guided endonuclease Cas9 [Streptococcus equinus] | SEQ ID NO: 108 |
| WP_042232481.1 | type II CRISPR RNA-guided endonuclease Cas9 [Streptococcus equinus] | SEQ ID NO: 109 |
| WP_009854540.1 | type II CRISPR RNA-guided endonuclease Cas9 [Streptococcus gallolyticus] | SEQ ID NO: 110 |
| WP_012962174.1 | type II CRISPR RNA-guided endonuclease Cas9 [Streptococcus gallolyticus] | SEQ ID NO: 111 |
| WP_039695303.1 | type II CRISPR RNA-guided endonuclease Cas9 [Streptococcus gallolyticus] | SEQ ID NO: 112 |
| WP_014334983.1 | type II CRISPR RNA-guided endonuclease Cas9 [Streptococcus infantarius] | SEQ ID NO: 113 |
| WP_003099269.1 | type II CRISPR RNA-guided endonuclease Cas9 [Streptococcus iniae] | SEQ ID NO: 114 |

| Accession | Description | SEQ ID NO |
|---|---|---|
| AHY15608.1 | CRISPR-associated protein Csn1 [Streptococcus iniae] | SEQ ID NO: 115 |
| AHY17476.1 | CRISPR-associated protein Csn1 [Streptococcus iniae] | SEQ ID NO: 116 |
| ESR09100.1 | hypothetical protein IUSA1_08595 [Streptococcus iniae IUSA1] | SEQ ID NO: 117 |
| AGM98575.1 | CRISPR-associated protein Cas9/Csn1, subtype II/NMEMI [Streptococcus iniae SF1] | SEQ ID NO: 118 |
| ALF27331.1 | CRISPR-associated protein Csn1 [Streptococcus intermedius] | SEQ ID NO: 119 |
| WP_018372492.1 | type II CRISPR RNA-guided endonuclease Cas9 [Streptococcus massiliensis] | SEQ ID NO: 120 |
| WP_045618028.1 | type II CRISPR RNA-guided endonuclease Cas9 [Streptococcus mitis] | SEQ ID NO: 121 |
| WP_045635197.1 | type II CRISPR RNA-guided endonuclease Cas9 [Streptococcus mitis] | SEQ ID NO: 122 |
| WP_002263549.1 | type II CRISPR RNA-guided endonuclease Cas9 [Streptococcus mutans] | SEQ ID NO: 123 |
| WP_002263887.1 | type II CRISPR RNA-guided endonuclease Cas9 [Streptococcus mutans] | SEQ ID NO: 124 |
| WP_002264920.1 | type II CRISPR RNA-guided endonuclease Cas9 [Streptococcus mutans] | SEQ ID NO: 125 |
| WP_002269043.1 | type II CRISPR RNA-guided endonuclease Cas9 [Streptococcus mutans] | SEQ ID NO: 126 |
| WP_002269448.1 | type II CRISPR RNA-guided endonuclease Cas9 [Streptococcus mutans] | SEQ ID NO: 127 |
| WP_002271977.1 | type II CRISPR RNA-guided endonuclease Cas9 [Streptococcus mutans] | SEQ ID NO: 128 |
| WP_002272766.1 | type II CRISPR RNA-guided endonuclease Cas9 [Streptococcus mutans] | SEQ ID NO: 129 |
| WP_002273241.1 | type II CRISPR RNA-guided endonuclease Cas9 [Streptococcus mutans] | SEQ ID NO: 130 |
| WP_002275430.1 | type II CRISPR RNA-guided endonuclease Cas9 [Streptococcus mutans] | SEQ ID NO: 131 |
| WP_002276448.1 | type II CRISPR RNA-guided endonuclease Cas9 [Streptococcus mutans] | SEQ ID NO: 132 |
| WP_002277050.1 | type II CRISPR RNA-guided endonuclease Cas9 [Streptococcus mutans] | SEQ ID NO: 133 |
| WP_002277364.1 | type II CRISPR RNA-guided endonuclease Cas9 [Streptococcus mutans] | SEQ ID NO: 134 |
| WP_002279025.1 | type II CRISPR RNA-guided endonuclease Cas9 [Streptococcus mutans] | SEQ ID NO: 135 |
| WP_002279859.1 | type II CRISPR RNA-guided endonuclease Cas9 [Streptococcus mutans] | SEQ ID NO: 136 |
| WP_002280230.1 | type II CRISPR RNA-guided endonuclease Cas9 [Streptococcus mutans] | SEQ ID NO: 137 |
| WP_002281696.1 | type II CRISPR RNA-guided endonuclease Cas9 [Streptococcus mutans] | SEQ ID NO: 138 |
| WP_002282247.1 | type II CRISPR RNA-guided endonuclease Cas9 [Streptococcus mutans] | SEQ ID NO: 139 |
| WP_002282906.1 | type II CRISPR RNA-guided endonuclease Cas9 [Streptococcus mutans] | SEQ ID NO: 140 |
| WP_002283846.1 | type II CRISPR RNA-guided endonuclease Cas9 [Streptococcus mutans] | SEQ ID NO: 141 |
| WP_002872255.1 | type II CRISPR RNA-guided endonuclease Cas9 [Streptococcus mutans] | SEQ ID NO: 142 |
| WP_002288990.1 | type II CRISPR RNA-guided endonuclease Cas9 [Streptococcus mutans] | SEQ ID NO: 143 |
| WP_002289641.1 | type II CRISPR RNA-guided endonuclease Cas9 [Streptococcus mutans] | SEQ ID NO: 144 |
| WP_002290427.1 | type II CRISPR RNA-guided endonuclease Cas9 [Streptococcus mutans] | SEQ ID NO: 145 |
| WP_002295753.1 | type II CRISPR RNA-guided endonuclease Cas9 [Streptococcus mutans] | SEQ ID NO: 146 |
| WP_002296423.1 | type II CRISPR RNA-guided endonuclease Cas9 [Streptococcus mutans] | SEQ ID NO: 147 |
| WP_002304487.1 | type II CRISPR RNA-guided endonuclease Cas9 [Streptococcus mutans] | SEQ ID NO: 148 |
| WP_002305844.1 | type II CRISPR RNA-guided endonuclease Cas9 [Streptococcus mutans] | SEQ ID NO: 149 |
| WP_002307203.1 | type II CRISPR RNA-guided endonuclease Cas9 [Streptococcus mutans] | SEQ ID NO: 150 |
| WP_002310390.1 | type II CRISPR RNA-guided endonuclease Cas9 [Streptococcus mutans] | SEQ ID NO: 151 |
| WP_002352408.1 | type II CRISPR RNA-guided endonuclease Cas9 [Streptococcus mutans] | SEQ ID NO: 152 |
| WP_012997688.1 | type II CRISPR RNA-guided endonuclease Cas9 [Streptococcus mutans] | SEQ ID NO: 153 |
| WP_014677909.1 | type II CRISPR RNA-guided endonuclease Cas9 [Streptococcus mutans] | SEQ ID NO: 154 |
| WP_019312892.1 | type II CRISPR RNA-guided endonuclease Cas9 [Streptococcus mutans] | SEQ ID NO: 155 |
| WP_019313659.1 | type II CRISPR RNA-guided endonuclease Cas9 [Streptococcus mutans] | SEQ ID NO: 156 |
| WP_019314093.1 | type II CRISPR RNA-guided endonuclease Cas9 [Streptococcus mutans] | SEQ ID NO: 157 |
| WP_019315370.1 | type II CRISPR RNA-guided endonuclease Cas9 [Streptococcus mutans] | SEQ ID NO: 158 |
| WP_019803776.1 | type II CRISPR RNA-guided endonuclease Cas9 [Streptococcus mutans] | SEQ ID NO: 159 |
| WP_019805234.1 | type II CRISPR RNA-guided endonuclease Cas9 [Streptococcus mutans] | SEQ ID NO: 160 |
| WP_024783594.1 | type II CRISPR RNA-guided endonuclease Cas9 [Streptococcus mutans] | SEQ ID NO: 161 |
| WP_024784288.1 | type II CRISPR RNA-guided endonuclease Cas9 [Streptococcus mutans] | SEQ ID NO: 162 |
| WP_024784666.1 | type II CRISPR RNA-guided endonuclease Cas9 [Streptococcus mutans] | SEQ ID NO: 163 |
| WP_024784894.1 | type II CRISPR RNA-guided endonuclease Cas9 [Streptococcus mutans] | SEQ ID NO: 164 |
| WP_024786433.1 | type II CRISPR RNA-guided endonuclease Cas9 [Streptococcus mutans] | SEQ ID NO: 165 |
| WP_049473442.1 | CRISPR-associated protein Csn1 [Streptococcus mutans] | SEQ ID NO: 166 |
| WP_049474547.1 | CRISPR-associated protein Csn1 [Streptococcus mutans] | SEQ ID NO: 167 |

-continued

| Accession | Description | SEQ ID NO |
|---|---|---|
| EMC03581.1 | hypothetical protein SMU69_09359 [Streptococcus mutans NLML4] | SEQ ID NO: 168 |
| WP_000428612.1 | type II CRISPR RNA-guided endonuclease Cas9 [Streptococcus oralis] | SEQ ID NO: 169 |
| WP_000428613.1 | type II CRISPR RNA-guided endonuclease Cas9 [Streptococcus oralis] | SEQ ID NO: 170 |
| WP_049523028.1 | CRISPR-associated protein Csn1 [Streptococcus parasanguinis] | SEQ ID NO: 171 |
| WP_003107102.1 | type II CRISPR RNA-guided endonuclease Cas9 [Streptococcus parauberis] | SEQ ID NO: 172 |
| WP_054279288.1 | type II CRISPR RNA-guided endonuclease Cas9 [Streptococcus phocae] | SEQ ID NO: 173 |
| WP_049531101.1 | CRISPR-associated protein Csn1 [Streptococcus pseudopneumoniae] | SEQ ID NO: 174 |
| WP_049538452.1 | CRISPR-associated protein Csn1 [Streptococcus pseudopneumoniae] | SEQ ID NO: 175 |
| WP_049549711.1 | CRISPR-associated protein Csn1 [Streptococcus pseudopneumoniae] | SEQ ID NO: 176 |
| WP_007896501.1 | type II CRISPR RNA-guided endonuclease Cas9 [Streptococcus pseudoporcinus] | SEQ ID NO: 177 |
| EFR44625.1 | CRISPR-associated protein, Csn1 family [Streptococcus pseudoporcinus SPIN 20026] | SEQ ID NO: 178 |
| WP_002897477.1 | type II CRISPR RNA-guided endonuclease Cas9 [Streptococcus sanguinis] | SEQ ID NO: 179 |
| WP_002906454.1 | type II CRISPR RNA-guided endonuclease Cas9 [Streptococcus sanguinis] | SEQ ID NO: 180 |
| WP_009729476.1 | type II CRISPR RNA-guided endonuclease Cas9 [Streptococcus sp. F0441] | SEQ ID NO: 181 |
| CQR24647.1 | CRISPR-associated protein [Streptococcus sp. FF10] | SEQ ID NO: 182 |
| WP_000066813.1 | type II CRISPR RNA-guided endonuclease Cas9 [Streptococcus sp. M334] | SEQ ID NO: 183 |
| WP_009754323.1 | type II CRISPR RNA-guided endonuclease Cas9 [Streptococcus sp. taxon 056] | SEQ ID NO: 184 |
| WP_044674937.1 | type II CRISPR RNA-guided endonuclease Cas9 [Streptococcus suis] | SEQ ID NO: 185 |
| WP_044676715.1 | type II CRISPR RNA-guided endonuclease Cas9 [Streptococcus suis] | SEQ ID NO: 186 |
| WP_044680361.1 | type II CRISPR RNA-guided endonuclease Cas9 [Streptococcus suis] | SEQ ID NO: 187 |
| WP_044681799.1 | type II CRISPR RNA-guided endonuclease Cas9 [Streptococcus suis] | SEQ ID NO: 188 |
| WP_049533112.1 | CRISPR-associated protein Csn1 [Streptococcus suis] | SEQ ID NO: 189 |
| WP_029090905.1 | type II CRISPR RNA-guided endonuclease Cas9 [Brochothrix thermosphacta] | SEQ ID NO: 190 |
| WP_006506696.1 | type II CRISPR RNA-guided endonuclease Cas9 [Catenibacterium mitsuokai] | SEQ ID NO: 191 |
| AIT42264.1 | Cas9hc:NLS:HA [Cloning vector pYB196] | SEQ ID NO: 192 |
| WP_034440723.1 | type II CRISPR endonuclease Cas9 [Clostridiales bacterium S5-A11] | SEQ ID NO: 193 |
| AKQ21048.1 | Cas9 [CRISPR-mediated gene targeting vector p(bh5p68-Cas9)] | SEQ ID NO: 194 |
| WP_002364836.1 | type II CRISPR RNA-guided endonuclease Cas9 [Dolosigranulum pigrum] | SEQ ID NO: 195 |
| WP_016631044.1 | MULTISPECIES: type II CRISPR RNA-guided endonuclease Cas9 [Enterococcus] | SEQ ID NO: 196 |
| EM575795.1 | MULTISPECIES: type II CRISPR RNA-guided endonuclease Cas9 [Enterococcus] | SEQ ID NO: 197 |
| WP_002373311.1 | hypothetical protein H318_06676 [Enterococcus durans IPLA 655] | SEQ ID NO: 198 |
| WP_002378009.1 | type II CRISPR RNA-guided endonuclease Cas9 [Enterococcus faecalis] | SEQ ID NO: 199 |
| WP_002407324.1 | type II CRISPR RNA-guided endonuclease Cas9 [Enterococcus faecalis] | SEQ ID NO: 200 |
| WP_002413717.1 | type II CRISPR RNA-guided endonuclease Cas9 [Enterococcus faecalis] | SEQ ID NO: 201 |
| WP_010775580.1 | type II CRISPR RNA-guided endonuclease Cas9 [Enterococcus faecalis] | SEQ ID NO: 202 |
| WP_010818269.1 | type II CRISPR RNA-guided endonuclease Cas9 [Enterococcus faecalis] | SEQ ID NO: 203 |
| WP_010824395.1 | type II CRISPR RNA-guided endonuclease Cas9 [Enterococcus faecalis] | SEQ ID NO: 204 |
| WP_016622645.1 | type II CRISPR RNA-guided endonuclease Cas9 [Enterococcus faecalis] | SEQ ID NO: 205 |
| WP_033624816.1 | type II CRISPR RNA-guided endonuclease Cas9 [Enterococcus faecalis] | SEQ ID NO: 206 |
| WP_033625576.1 | type II CRISPR RNA-guided endonuclease Cas9 [Enterococcus faecalis] | SEQ ID NO: 207 |
| WP_033791179.1 | type II CRISPR RNA-guided endonuclease Cas9 [Enterococcus faecalis] | SEQ ID NO: 208 |
| WP_002310644.1 | type II CRISPR RNA-guided endonuclease Cas9 [Enterococcus faecium] | SEQ ID NO: 209 |
| WP_002312694.1 | type II CRISPR RNA-guided endonuclease Cas9 [Enterococcus faecium] | SEQ ID NO: 210 |
| WP_002314015.1 | type II CRISPR RNA-guided endonuclease Cas9 [Enterococcus faecium] | SEQ ID NO: 211 |
| WP_002320716.1 | type II CRISPR RNA-guided endonuclease Cas9 [Enterococcus faecium] | SEQ ID NO: 212 |
| WP_002330729.1 | type II CRISPR RNA-guided endonuclease Cas9 [Enterococcus faecium] | SEQ ID NO: 213 |
| WP_002335161.1 | type II CRISPR RNA-guided endonuclease Cas9 [Enterococcus faecium] | SEQ ID NO: 214 |
| WP_002345439.1 | type II CRISPR RNA-guided endonuclease Cas9 [Enterococcus faecium] | SEQ ID NO: 215 |
| WP_034867970.1 | type II CRISPR RNA-guided endonuclease Cas9 [Enterococcus faecium] | SEQ ID NO: 216 |
| WP_047937432.1 | type II CRISPR RNA-guided endonuclease Cas9 [Enterococcus faecium] | SEQ ID NO: 217 |
| WP_010720994.1 | type II CRISPR RNA-guided endonuclease Cas9 [Enterococcus hirae] | SEQ ID NO: 218 |
| WP_010737004.1 | type II CRISPR RNA-guided endonuclease Cas9 [Enterococcus hirae] | SEQ ID NO: 219 |
| | | SEQ ID NO: 220 |

-continued

| Accession | | Description | SEQ ID NO: |
|---|---|---|---|
| WP_034700478.1 | | type II CRISPR RNA-guided endonuclease Cas9 [Enterococcus hirae] | SEQ ID NO: 221 |
| WP_007209003.1 | | type II CRISPR RNA-guided endonuclease Cas9 [Enterococcus italicus] | SEQ ID NO: 222 |
| WP_023519017.1 | | type II CRISPR RNA-guided endonuclease Cas9 [Enterococcus mundtii] | SEQ ID NO: 223 |
| WP_010777040.1 | | type II CRISPR RNA-guided endonuclease Cas9 [Enterococcus phoeniculicola] | SEQ ID NO: 224 |
| WP_048604708.1 | | type II CRISPR RNA-guided endonuclease Cas9 [Enterococcus sp. AM1] | SEQ ID NO: 225 |
| WP_010750235.1 | | type II CRISPR RNA-guided endonuclease Cas9 [Enterococcus villorum] | SEQ ID NO: 226 |
| AII16583.1 | | Cas9 endonuclease [Expression vector pCas9] | SEQ ID NO: 227 |
| WP_029073316.1 | | type II CRISPR RNA-guided endonuclease Cas9 [Kandleria vitulina] | SEQ ID NO: 228 |
| WP_031589969.1 | | type II CRISPR RNA-guided endonuclease Cas9 [Kandleria vitulina] | SEQ ID NO: 229 |
| KDA45870.1 | | CRISPR-associated protein Cas9/Csn1, subtype II/NMEMI [Lactobacillus animalis] | SEQ ID NO: 230 |
| WP_039099354.1 | | type II CRISPR RNA-guided endonuclease Cas9 [Lactobacillus curvatus] | SEQ ID NO: 231 |
| AKP02966.1 | | hypothetical protein ABB45_04605 [Lactobacillus farciminis] | SEQ ID NO: 232 |
| WP_010991369.1 | | type II CRISPR RNA-guided endonuclease Cas9 [Listeria innocua] | SEQ ID NO: 233 |
| WP_003838504.1 | | type II CRISPR RNA-guided endonuclease Cas9 [Listeria innocua] | SEQ ID NO: 234 |
| EHN60060.1 | | CRISPR-associated protein, Csn1 family [Listeria innocua ATCC 33091] | SEQ ID NO: 235 |
| EFR89594.1 | | crispr-associated protein, Csn1 family [Listeria innocua FSL S4-378] | SEQ ID NO: 236 |
| WP_038409211.1 | | type II CRISPR RNA-guided endonuclease Csn1 [Listeria ivanovii] | SEQ ID NO: 237 |
| EFR95520.1 | | crispr-associated protein Csn1 [Listeria ivanovii FSL F6-596] | SEQ ID NO: 238 |
| WP_003723650.1 | | type II CRISPR RNA-guided endonuclease Cas9 [Listeria monocytogenes] | SEQ ID NO: 239 |
| WP_003727705.1 | | type II CRISPR RNA-guided endonuclease Cas9 [Listeria monocytogenes] | SEQ ID NO: 240 |
| WP_003730785.1 | | type II CRISPR RNA-guided endonuclease Cas9 [Listeria monocytogenes] | SEQ ID NO: 241 |
| WP_003733029.1 | | type II CRISPR RNA-guided endonuclease Cas9 [Listeria monocytogenes] | SEQ ID NO: 242 |
| WP_003739838.1 | | type II CRISPR RNA-guided endonuclease Cas9 [Listeria monocytogenes] | SEQ ID NO: 243 |
| WP_014601172.1 | | type II CRISPR RNA-guided endonuclease Cas9 [Listeria monocytogenes] | SEQ ID NO: 244 |
| WP_023548323.1 | | type II CRISPR RNA-guided endonuclease Cas9 [Listeria monocytogenes] | SEQ ID NO: 245 |
| WP_031665337.1 | | type II CRISPR RNA-guided endonuclease Cas9 [Listeria monocytogenes] | SEQ ID NO: 246 |
| WP_031669209.1 | | type II CRISPR RNA-guided endonuclease Cas9 [Listeria monocytogenes] | SEQ ID NO: 247 |
| WP_039920898.1 | | type II CRISPR RNA-guided endonuclease Cas9 [Listeria monocytogenes] | SEQ ID NO: 248 |
| AKI42028.1 | | CRISPR-associated protein [Listeria monocytogenes] | SEQ ID NO: 249 |
| AKI50529.1 | | CRISPR-associated protein [Listeria monocytogenes] | SEQ ID NO: 250 |
| EFR83390.1 | | crispr-associated protein Csn1 [Listeria monocytogenes FSL F2-208] | SEQ ID NO: 251 |
| WP_046323366.1 | | type II CRISPR RNA-guided endonuclease Cas9 [Listeria seeligeri] | SEQ ID NO: 252 |
| AKE81011.1 | | Cas9 [Plant multiplex genome editing vector pYLCRISPR/Cas9Pubi-H] | SEQ ID NO: 253 |
| CU082355.1 | | Uncharacterized protein conserved in bacteria [Roseburia hominis] | SEQ ID NO: 254 |
| WP_033162887.1 | | type II CRISPR RNA-guided endonuclease Cas9 [Sharpea azabuensis] | SEQ ID NO: 255 |
| AGZ01981.1 | | Cas9 endonuclease [synthetic construct] | SEQ ID NO: 256 |
| AKA60242.1 | | nuclease deficient Cas9 [synthetic construct] | SEQ ID NO: 257 |
| AK540380.1 | | Cas9 [Synthetic plasmid pFC330] | SEQ ID NO: 258 |
| 4UN5_B | | Cas9, Chain B, Crystal Structure | SEQ ID NO: 259 |
| WP_010922251 | 1 | MDKK-YSIGLDIGTNSVGWAVITDEYKVPSKKFKVLGNTDRHSIKKNLIGALLFDSGETA--EATRLKRTARRRYT | 73 |
| WP_039695303 | 1 | MTKKnYSIGLDIGTNSVGWAVITDDYKVPAKKMKVLGNTDKKYIKKNLIGALLFDSGETA---EATRLKRTARRRYT | 74 |
| WP_045635197 | 1 | K-KG-YSIGLDIGTNSVGFAVITDDYKVPSKKMMKVLGNTDKRFIKKNLIGALLFDEGTTA--EARRLKRTARRRYT | 73 |
| 5AXW_A | 1 | MKRN-YILGLDIGITSVGYGII--DYET-------RDVIDA---GVRLFKEANVEnnEGRRSRKGAARRLKR | 61 |
| WP_009880683 | | | |
| WP_010922251 | 1 | MDKK-YSIGLDIGTNSVGWAVITDEYKVPSKKFKVLGNTDRHSIKKNLIGALLFDSGETA--EATRLKRTARRRYT | 73 |
| WP_011054416 | 1 | MDKK-YSIGLDIGINSVGWAVITDDYKVPSKKFKVLGNIDRHSIKKNLIGALLFDSGETA--EATRLKRTARRRYT | 73 |
| WP_011284745 | 1 | MDKK-YSIGLDIGINSVGWAVITDDYKVPSKKLKGLGNIDRHGIKKNLIGALLFDSGETA--EATRLKRTARRRYT | 73 |
| WP_011285506 | 1 | MDKK-YSIGLDIGINSVGWAVITDDYKVPSKKFKVLGNIDRHSIKKNLIGALLFDSGETA--EATRLKRTARRRYT | 73 |
| WP_011527619 | 1 | MDKK-YSIGLDIGINSVGWAVITDDYKVPSKKFKVLGNIDRHSIKKNLIGALLFDSGEIA--EATRLKRTARRRYT | 73 |
| WP_012560673 | 1 | MDKK-YSIGLDIGINSVGWAVITDDYKVPSKKFKVLGNIDRHSIKKNLIGALLFDSGETA--EATRLKRTARRRYT | 73 |
| WP_014407541 | 1 | MDKK-YSIGLDIGINSVGWAVITDDYKVPSKKFKVLGNIDRHSIKKNLIGALLFPGSGETA--EATRLKRTARRRYT | 73 |
| WP_020905136 | 1 | MDKK-YSIGLDIGINSVGWAVITDDYKVPSKKFKVLGNIDRHSIKKNLIGALLFDSGETA--EATRLKRTARRRYT | 73 |

| | | |
|---|---|---|
| WP_023080005 | MDKK-YSIGLDIGINSVGWAVITTDDYKVPSKKLKVLGNIDRHGIKKNLIGALLFDSGETA--EATRLKRTARRYT | 73 |
| WP_023610282 | MDKK-YSIGLDIGINSVGWAVITTDDYKVPSKKLKVLGNIDRHGIKKNLIGALLFDSGETA--EATRLKRTARRYT | 73 |
| WP_030125963 | MDKK-YSIGLDIGINSVGWAVITTDDYKVPSKKFKVLGNIDRHSIKKNLIGALLFDSGETA--EATRLKRTARRYT | 73 |
| WP_030126706 | MDKK-YSIGLDIGINSVGWAVITTDDYKVPSKKFKVLGNIDRHSIKKNLIGALLFDSGETA--EATRLKRTARRYT | 73 |
| WP_031488318 | MDKK-YSIGLDIGINSVGWAVITTDDYKVPSKKFKVLGNIDRHSIKKNLIGALLFDSGETA--EATRLKRTARRYT | 73 |
| WP_032460140 | MDKK-YSIGLDIGINSVGWAVITTDDYKVPSKKFKVLGNIDRHSIKKNLIGALLFDSGETA--EATRLKRTARRYT | 73 |
| WP_032461047 | MDKK-YSIGLDIGINSVGWAVITTDDYKVPSKKFKVLGNIDRHSIKKNLIGALLFDSGETA--EATRLKRTARRYT | 73 |
| WP_032462016 | MDKK-YSIGLDIGINSVGWAVITTDDYKVPSKKFKVLGNIDRHSIKKNLIGALLFDSGETA--EATRLKRTARRYT | 73 |
| WP_032462936 | MDKK-YSIGLDIGINSVGWAVITTDDYKVPSKKFKVLGNIDRHSIKKNLIGALLFDSGETA--EATRLKRTARRYT | 73 |
| WP_032464890 | MDKK-YSIGLDIGINSVGWAVITTDDYKVPSKKFKVLGNIDRHSIKKNLIGALLFDSGETA--EATRLKRTARRYT | 73 |
| WP_033888930 | ---------------------------------------------------------------------------- | |
| WP_038431314 | MDKK-YSIGLDIGTNSVGNAVITTDDYKVPSKKFKVLGNTDRHSIKKNLIGALLFDSGETA--EATRLKRTARRYT | 73 |
| WP_038432938 | MDKK-YSIGLDIGTNSVGWAVITTDDYKVPSKKFKVLGNTDRHSIKKNLIGALLFDSGETA--EATRLKRTARRYT | 73 |
| WP_038434062 | MDKK-YSIGLDIGTNSVGWAVITTDDYKVPSKKFKVLGNTDKHSIKKNLIGALLFDSGETA--EATRLKRTARRYT | 73 |
| BAQ51233 | ---------------------------------------------------------------------------- | |
| KGE60162 | ---------------------------------------------------------------------------- | |
| KGE60856 | ---------------------------------------------------------------------------- | |
| WP_002989955 | MDQK-YSIGLDIGTNSVGNAVVTTDDYKVPAKKMKVLGNTDKQSIKKNLIGALLFDGGNTA--ADRRLKRTARRYT | 73 |
| WP_003030002 | MTKKnYSIGLDIGTNSVGWAVITTDDYKVPAKKMKVLGNTDKKYIKKNLLGALLFDGGNTA--ADRRLKRTARRYT | 74 |
| WP_003065552 | MNKP-YSIGLDIGTNSVGWSIITTDDYKVPAKKIRVLGNTDKEYIKKNLIGALLFDGGNTA--ADRRLKRTARRYT | 73 |
| WP_001040076 | MNKP-YSIGLDIGTNSVGWSIITTDDYKVPAKKMRVLGNTDKEYIKKNLIGALLFDGGNTA--ADRRLKRTARRYT | 73 |
| WP_001040078 | MNKP-YSIGLDIGTNSVGWSIITTDDYKVPAKKMRVLGNTDKEYIKKNLIGALLFDGGNTA--ADRRLKRTARRYT | 73 |
| WP_001040080 | MNKP-YSIGLDIGTNSVGWSIITTDDYKVPAKKMRVLGNTDKEYIKKNLIGALLFDGGNTA--ADRRLKRTARRYT | 73 |
| WP_001040081 | MNKP-YSIGLDIGTNSVGWSIITTDDYKVPAKKMRVLGNTDKEYIKKNLIGALLFDGGNTA--ADRRLKRTARRYT | 73 |
| WP_001040083 | MNKP-YSIGLDIGTNSVGWSIITTDDYKVPAKKMRVLGNTDKEYIKKNLIGALLFDGGNTA--ADRRLKRTARRYT | 73 |
| WP_001040085 | MNKP-YSIGLDIGTNSVGWSIITTDDYKVPAKKMRVLGNTDKEYIKKNLIGALLFDGGNTA--ADRRLKRTARRYT | 73 |
| WP_001040087 | MNKP-YSIGLDIGTNSVGWSIITTDDYKVPAKKMRVLGNTDKEYIKKNLIGALLFDGGNTA--ADRRLKRTARRYT | 73 |
| WP_001040088 | MNKP-YSIGLDIGTNSVGWSIITTDDYKVPAKKMRVLGNTDKEYIKKNLIGALLFDGGNTA--ADRRLKRTARRYT | 73 |
| WP_001040089 | MNKP-YSIGLDIGTNSVGWSIITTDDYKVPAKKMRVLGNTDKEYIKKNLIGALLFDGGNTA--ADRRLKRTARRYT | 73 |
| WP_001040090 | MNKP-YSIGLDIGTNSVGWSIITTDDYKVPAKKMRVLGNTDKEYIKKNLIGALLFDGGNTA--ADRRLKRTARRYT | 73 |
| WP_001040091 | MNKP-YSIGLDIGTNSVGWSIITTDDYKVPAKKMRVLGNTDKEYIKKNLIGALLFDGGNTA--ADRRLKRTARRYT | 73 |
| WP_001040092 | MNKP-YSIGLDIGTNSVGWSIITTDDYKVPAKKMRVLGNTDKEYIKKNLIGALLFDGGNTA--ADRRLKRTARRYT | 73 |
| WP_001040094 | MNKP-YSIGLDIGTNSVGWSIITTDDYKVPAKKMRVLGNTDKEYIKKNLIGALLFDGGNTA--ADRRLKRTARRYT | 73 |
| WP_001040095 | MNKP-YSIGLDIGTNSVGWSIITTDDYKVPAKKMRVLGNTDKEYIKKNLIGALLFDGGNTA--ADRRLKRTARRYT | 73 |
| WP_001040096 | MNKP-YSIGLDIGTNSVGWSIITTDDYKVPAKKMRVLGNTDKEYIKKNLIGALLFDGGNTA--ADRRLKRTARRYT | 73 |
| WP_001040097 | MNKP-YSIGLDIGTNSVGYSVVTDDYKVPAKKMRVLGNTDKEYIKKNLIGALLFDGGNTA--ADRRLKRTARRYT | 73 |
| WP_001040098 | MNKP-YSIGLDIGTNSVGYSVVTDDYKVPAKKMRVLGNTDKEYIKKNLIGALLFDGGNTA--ADRRLKRTARRYT | 73 |
| WP_001040099 | MNKP-YSIGLDIGTNSVGYSVVTDDYKVPAKKMRVLGNTDKEYIKKNLIGALLFDGGNTA--ADRRLKRTARRYT | 73 |
| WP_001040100 | MNKP-YSIGLDIGTNSVGWSIITTDDYKVPAKKMRVLGNTDKEYIKKNLIGALLEDGGNTA--ADRRLKRTARRYT | 73 |
| WP_001040104 | MNKP-YSIGLDIGTNSVGWSIITTDDYKVPAKKMRVLGNTDKEYIKKNLIGALLEDGGNTA--ADRRLKRTARRYT | 73 |
| WP_001040105 | MNKP-YSIGLDIGTNSVGWSIITTDDYKVPAKKMRVLGNTDKEYIKKNLIGALLEDGGNTA--SDRRLKRTARRYT | 73 |
| WP_001040106 | MNKP-YSIGLDIGTNSVGWSIITTDDYKVPAKKMRVLGNTDKEYIKKNLIGALLEDGGNTA--SDRRLKRTARRYT | 73 |
| WP_001040107 | MNKP-YSIGLDIGTNSVGWSIITTDDYKVPAKKMRVLGNTDKEYIKKNLIGALLFDGGNTA--SDRRLKRTARRYT | 73 |
| WP_001040108 | MNKP-YSIGLDIGTNSVGWSIITTDDYKVPAKKMRVLGNTDKEYIKKNLIGALLFDGGNTA--SDRRLKRTARRYT | 73 |
| WP_001040109 | MNKP-YSIGLDIGTNSVGWSIITTDDYKVPAKKMRVLGNTDKEYIKKNLIGALLFDGGNTA--SDRRLKRTARRYT | 73 |
| WP_001040110 | MNKP-YSIGLDIGTNSVGWSIITTDDYKVPAKKMRVLGNTDKEYIKKNLIGALLFDGGNTA--ADRRLKRTARRYT | 73 |
| WP_015058523 | MNKP-YSIGLDIGTNSVGWSIITTDDYKVPAKKMRVLGNTDKEYIKKNLIGALLFDGGNTA--ADRRLKRTARRYT | 73 |
| WP_017643850 | MNKP-YSIGLDIGTNSVGWSIITTDDYKVPAKKMRVLGNTDKEYIKKNLIGALLFDGGNTA--ADRRLKRTARRYT | 73 |
| WP_017647151 | MNKP-YSIGLDIGTNSVGYSVVTDDYKVPAKKMRVLGNTDKEYIKKNLIGALLFDGGNTA--SDRRLKRTSRRYT | 73 |
| WP_017648376 | MNKP-YSIGLDIGTNSVGYSVVTDDYKVPAKKMRVLGNTDKEYIKKNLIGALLFDGGNTA--ADRRLKRTARRYT | 73 |
| WP_017649527 | MNKP-YSIGLDIGTNSVGWSIITTDDYKVPAKKMRVLGNTDKEYIKKNLIGALLFDGGNTA--ADRRLKRTARRYT | 73 |
| WP_017771611 | MNKP-YSIGLDIGTNSVGWSIITTDDYKVPAKKMRVLGNTDKEYIKKNLIGALLFDGGNTA--ADRRLKRTARRYT | 73 |
| WP_017771984 | MNKP-YSIGLDIGTNSVGWSIITTDDYKVPAKKMRVLGNTDKEYIKKNLIGALLFDGGNTA--ADRRLKRTARRYT | 73 |

-continued

| | | |
|---|---|---|
| CFQ25032 | 1 MNKP-YSIGLDIGTNSVGWSIITDDYKVPAKKMRVLGNTDKEYIKKNLIGALLFDGGNTA--ADRRLKRTARRRYT | 73 |
| CFV16040 | 1 MNKP-YSIGLDIGTNSVGWSIITDDYKVPAKKMRVLGNTDKEYIKKNLIGALLFDGGNTA--ADRRLKRTARRRYT | 73 |
| KLJ37842 | 1 MNKP-YSIGLDIGTNSVGWSIITDDYKVPAKKMRVLGNTDKEYIKKNLIGALLFDGGNTA--ADRRLKRTARRRYT | 73 |
| KLJ72361 | 1 MNKP-YSIGLDIGTNSVGWSIITDDYKVPAKKMRVLGNTDKEYIKKNLIGALLFDGGNTA--ADRRLKRTARRRYT | 73 |
| KLL20707 | 1 MNKP-YSIGLDIGTNSVGWSIITDDYKVPAKKMRVLGNTDKEYIKKNLIGALLFDGGNTA--ADRRLKRTARRRYT | 73 |
| KLL42645 | 1 MNKP-YSIGLDIGTNSVGYSVVTDDYKVPAKKMRVLGNTDKEYIKKNLIGALLFDGGNTA--SDRRLKRTARRRYT | 73 |
| WP_047207273 | 1 MNKP-YSIGLDIGTNSVGWSIITDDYKVPAKKMRVLGNTDKEYIKKNLIGALLFDGGNTA--ADRRLKRTARRRYT | 73 |
| WP_047209694 | 1 MNKP-YSIGLDIGTNSVGWSIITDDYKVPAKKMRVLGNTDKEYIKKNLIGALLFDGRNTA--ADRRLKRTARRRYT | 73 |
| WP_050198062 | 1 MNKP-YSIGLDIGTNSVGWSIITDDYKVPAKKMRVLGNTDKEYIKKNLIGALLFDGGNTA--ADRRLKRTARRRYT | 73 |
| WP_050201642 | 1 MNKP-YSIGLDIGTNSVGWSIITDDYKVPAKKMRVLGNTDKEYIKKNLIGALLFDGGNTA--ADRRLKRTARRRYT | 73 |
| WP_050204027 | 1 MNKP-YSIGLDIGTNSVGYSVVTDDYKVPAKKMRVLGNTDKEYIKKNLIGALLFDGGNTA--SDRRLKRTARRRYT | 73 |
| WP_050881965 | 1 MNKP-YSIGLDIGTNSVGWSIITDDYKVPAKKMRVLGNTDKEYIKKNLIGALLFDGGNTA--ADRRLKRTARRRYT | 73 |
| WP_050886065 | 1 MNKP-YSIGLDIGTNSVGWSIITDDYKVPAKKMRVLGNTDKEYIKKNLIGALLFDGGNTA--ADRRLKRTARRRYT | 73 |
| AHN30376 | 1 MNKP-YSIGLDIGTNSVGWSIITDDYKVPAKKMRVLGNTDKEYIKKNLIGALLFDGGNTA--ADRRLKRTARRRYT | 73 |
| EAO78426 | 1 MNKP-YSIGXDIGTNSVGWSIITDDYKVPAKKMRVLGNTDKEYIKKNLIGALLFDGGNTA--ADRRLKRTARRRYT | 73 |
| CCW42055 | 1 MNKP-YSIGLDIGTNSVGWSIITDDYKVPAKKMRVLGNTDKEYIKKNLIGALLFDGGNTA--ADRRLKRIARRRYT | 73 |
| WP_003041502 | 1 MNQK-YSIGLDIGTNSVGWAVITDDYKVPAKKMKVLGNTDKQSIKKNLIGALLFDSGETA--EATRLKRTARRRYT | 73 |
| WP_003043819 | 1 MKKE-YSIGLDIGTNSVGRAVITDDYKVPAKKMKVLGNTDKQSIKKNLIGALLFDSGETA--EATRLKRTARRRYT | 74 |
| WP_066269658 | 1 MGKP-YSIGLDIGTNSVGWAVVTDDYKVPAKKMKVLGNTDKQSIKKNLIGALLFDSGETA--EATRLKRTARRRYT | 73 |
| WP_048800889 | 1 MTQK-YSIGLDIGTNSVGWAIVTDDYKVPAKKMKILGNTNKQYIKKNLIGALLFDSGETA--KATRLKRTARRRYT | 74 |
| WP_012767106 | 1 MDKK-YSIGLDIGTNSVGWAVITDDYKVPAKKMKFKVLGNTDKKSIKKNLIGALLFDSGETA--EATRLKRTARRRYT | 73 |
| WP_014612333 | 1 MDKK-YSIGLDIGTNSVGWAVITDDYKVPAKKMKFKVLGNTDKKSIKKNLIGALLFDSGETA--EATRLKRTARRRYT | 73 |
| WP_015017095 | 1 MDKK-YSIGLDIGTNSVGWAVITDDYKVPAKKMKFKVLGNTDKRHSIKKNLIGALLFDSGETA--EATRLKRTARRRYT | 73 |
| WP_015057649 | 1 MDKK-YSIGLDIGTNSVGWAVITDDYKVPSKKFKVLGNTDKRHSIKKNLIGALLFDSGETA--EATRLKRTARRRYT | 73 |
| WP_048327215 | 1 MDKK-YSIGLDIGTNSVGWAVITDDYKVPSKKFKVLGNTDKRHSIKKNLIGALLFDSGETA--EATRLKRTARRRYT | 73 |
| WP_049519324 | 1 MDKK-YSIGLDIGTNSVGWAVITDDYKVPSKKFKVLGNTNRKSIKKNLMGALLFDSGETA--EATRLKRTARRRYT | 73 |
| WP_012515931 | 1 MKKP-YTIALDIGTNSVGWAVVTDDYKRVPTKKMKVLGNTERKTIKKNLIGALLFDSGDTA--EGTRLKRTARPRYT | 73 |
| WP_021320964 | 1 MKKP-YTIALDIGTNSVGWAVVTDDYKRVPTKKMKVLGNTERKTIKKNLIGALLFDSGDTA--EGTRLKRAARRRYT | 73 |
| WP_037581760 | 1 M-EKtYSIGLDIGTNSVGWAVITDDYKVPAKKMKVLGNTDKKYIKKNLIGALLFDSGETA--EATRLKRTARRRYT | 73 |
| WP_004232481 | 1 MTKnYSIGLDIGTNSVGWAVITDDYKVPAKKMKVLGNTDKKYIKKNLIGALLFDSGETA--EATRLKRTARRRYT | 74 |
| WP_009854540 | 1 MTEKnYSIGLDIGTNSVGWAVITDDYKVPAKKMKVLGNTDKKYIKKNLIGALLFDSGETA--EATRLKRTARRRYT | 74 |
| WP_012962174 | 1 MTKnYSIGLDIGTNSVGWAVITDDYKVPAKKMKVLGNTDKKYIKKNLIGALLFDNGETA--EATRLKRTARRRYT | 74 |
| WP_039695303 | 1 M-EKsYSIGLDIGTNSVGWAVITDDYKVPAKKMKVLGNTDKKYIKKNLIGALLFDSGETA--EVTRLKRTARRRYT | 73 |
| WP_014334983 | 1 MRKP-YSIGLDIGTNSVGWAVITDDYKVPSKKMRIQGTTDRTSIKKNLIGALLFDNGETA--EATRLKRTTRRRYT | 73 |
| WP_003099269 | 1 MRKP-YSIGLDIGTNSVGWAVITDDYKVPSKKMRIQGTTDRTSIKKNLIGALLFDNGETA--EATRLKRTARRRYT | 73 |
| AHY15608 | 1 MKKP-YSIGLDIGTNSVGWAVITDDYKVPSKKMRIQGTTDRTSIKKNLIGALLFDNGETA--EATRLKRTTRRRYT | 73 |
| AHY17476 | 1 ------------------------------------------------------------------------- | |
| ESR09100 | 1 MRKP-YSIGLDIGTNSVGWAVITDDYKVPSKKMKVLGNTDKSHIKKNLIGALLFDSGETA--EDRRLKRTARRRYT | 73 |
| AGM98575 | 1 MKKP-YSIGLDIGTNSVGWAVITDDYKVPSKKMKVLGNTDKSHIKKNLIGALLFDSGETA--EDRRLKRTARRRYT | 73 |
| ALF27331 | 1 MKKP-YSIGLDIGTNSVGWAVITDDYKVPAKKMKVLGNTDKSHIKKNLIGALLFDSGETAv--ERRLNRTTSRRYD | 73 |
| WP_018372492 | 1 MKKP-YSIGLDIGTNSVGWAVMEDYKVPSKKMKVLGNTDKQSHIKKNLIGALLFDSGETAv--ERRLNRTTSRRYD | 73 |
| WP_045618028 | 1 NNKP-YSIGLDIGTNSVGWAVITDDYKVPSKKMKVLGNTDKHFIKKNLIGALLFDEGTTA--EARRLKRTARRRYT | 74 |
| WP_045635197 | 1 K-KG-YSIGLDIGTNSVGWAVITDDYKVPSKKKHFIKKNLIGALLFDEGTTA--EARRLKRTARRRYT | 73 |
| WP_002263549 | 1 MKKP-YSIGLDIGTNSVGRAVITDDYKVPAKKMKVLGNTDKRFIKKNLIGALLFDNGETA--EDRRLKRTARRRYT | 73 |
| WP_002263887 | 1 MKKP-YSIGLDIGTNSVGRAVITDDYKVPAKKMKVLGNTDKSHIEKNLIGALLFDNGETA--EDRRLKRTARRRYT | 73 |
| WP_002264920 | 1 MKKP-YSIGLDIGTNSVGRAVITDDYKVPAKKMKVLGNTDKSHIEKNLIGALLFDNGETA--EDRRLKRTARRRYT | 73 |
| WP_002269043 | 1 MKKP-YSIGLDIGTNSVGRAVITDDYKVPAKKMKVLGNTDKSHIKKNLIGALLFDNGETA--EDRRLKRTARRRYT | 73 |
| WP_002269448 | 1 MKKP-YSIGLDIGTNSVGRAVITDDYKVPAKKMKVLGNTDKSHIKKNLIGALLFDNGETA--EDRRLKRTARRRYT | 73 |
| WP_002271977 | 1 MKKP-YSIGLDIGTNSVGRAVITDDYKVPAKKMKVLGNTDKSHIKKNLIGALLFDSGNTA--EDRRLKRTARRRYT | 73 |

-continued

| | | | |
|---|---|---|---|
| WP_002272766 | 1 | MKKP-YSIGLDIGTNSVGWAVVTDDYKVPAKKMKVLGNTDKSHIKKNLLGALLFDSGNTA--EDRRLKRTARRRYT | 73 |
| WP_002273241 | 1 | MKKP-YSIGLDIGTNSVGWAVVTDDYKVPAKKMKVLGNTDKSHIKKNLLGALLFDSGNTA--EDRRLKRTARRRYT | 73 |
| WP_002275430 | 1 | MKKP-YSIGLDIGTNSVGWAVVTDDYKVPAKKMKVLGNTDKSHIKKNLLGALLFDSGNTA--ADRRLKRTARRRYT | 73 |
| WP_002276448 | 1 | MKKP-YSIGLDIGTNSVGWAVVTDDYKVPAKKMKVLGNTDKSHIKKNLLGALLFDSGNTA--ADRRLKRTARRRYT | 73 |
| WP_002277050 | 1 | MKKS-YSIGLDIGTNSVGWAVVTDDYKVSAKKMKVLGNTDKSHIKKNLLGALLFDSGNTA--EDRRLKRTARRRYT | 73 |
| WP_002773364 | 1 | MKKP-YSIGLDIGTNSVGWAVVTDDYKVPAKKMKVLGNTDKSHIKKNLLGALLFDSGNTA--EDRRLKRTARRRYT | 73 |
| WP_002279025 | 1 | MKKP-YSIGLDIGTNSVGWAVVTDDYKVPAKKMKVLGNTDKSHIEKNLLGALLFDSGNTA--EDRRLKRTARRRYT | 73 |
| WP_002279859 | 1 | MKKP-YSIGLDIGTNSVGWAVVTDDYKVPAKKMKVLGNTDKSHIKKNLLGALLFDSGNTA--EDRRLKRTARRRYT | 73 |
| WP_002280230 | 1 | MKKP-YSIGLDIGTNSVGWAVVTDDYKVPAKKMKVLGNTDKSHIKKNLLGALLFDSGNTA--ADRRLKRTARRRYT | 73 |
| WP_002281696 | 1 | MKKP-YSIGLDIGTNSVGWAVVTDDYKVPAKKMKVLGNTDKSHIKKNLLGALLFDSGNTA--EDRRLKRTARRRYT | 73 |
| WP_002282247 | 1 | MKKP-YSIGLDIGTNSVGWAVVTDDYKVPAKKMKVLGNTDKSHIKKNLLGALLFDSGNTA--EDRRLKRTARRRYT | 73 |
| WP_002282906 | 1 | MKKP-YSIGLDIGTNSVGVVTDDYKVPAKKMKVLGNTDKSHIEKNLLGALLFDSGNTA--EDRRLKRTARRRYT | 73 |
| WP_002283846 | 1 | MKKP-YSIGLDIGTNSVGWAVVTDDYKVPAKKMKVLGNTDKSHIKKNLLGALLFDSGNTA--EDRRLKRTARRRYT | 73 |
| WP_002287255 | 1 | MKKP-YSIGLDIGTNSVGWAVVTDDYKVPAKKMKVLGNTDKSHIKKNLLGALLFDSGNTA--EDRRLKRTARRRYT | 73 |
| WP_002288990 | 1 | MKKP-YSIGLDIGTNSVGWAVVTDDYKVPAKKMKVLGNTDKSHIKKNLLGALLFDSGNTA--EDRRLKRTARRRYT | 73 |
| WP_002289641 | 1 | MKKP-YSIGLDIGTNSVGWAVVTDDYKVPAKKMKVLGNTDKSHIKKNLLGALLFDSGNTA--EDRRLKRTTRRRYT | 73 |
| WP_002290427 | 1 | MKKP-YSIGLDIGTNSVGWAVVTDDYKVPAKKMKVLGNTDKSHIKKNLLGALLFDSGNTA--EDRRLKRTARRRYT | 73 |
| WP_002295753 | 1 | MKKP-YSIGLDIGTNSVGWAVVTDDYKVPAKKMKVLGNTDKSHIKKNLLGALLFDSGNTA--EDRRLKRTARRRYT | 73 |
| WP_002296423 | 1 | MKKP-YSIGLDIGTNSVGWAVVTDDYKVPAKKMKVLGNTDKSHIKKNLLGALLFDSGNTA--ADRRLKRTARRRYT | 73 |
| WP_002304487 | 1 | MKKP-YSIGLDIGTNSVGWAVVTDDYKVPAKKMKVLGNTDKSHIKKNLLGALLFDSGNTA--EDRRLKRTARRRYT | 73 |
| WP_002305844 | 1 | MKKP-YSIGLDIGTNSVGWAVVTDDYKVPAKKMKVLGNTDKSHIEKNLLGALLFDSGNTA--EDRRLKRTARRRYT | 73 |
| WP_002307203 | 1 | MKKP-YSIGLDIGTNSVGWAVVTDDYKVPAKKMKVLGNTDKSHIKKNLLGALLFDSGNTA--EDRRLKRTARRRYT | 73 |
| WP_002310390 | 1 | MKKP-YSIGLDIGTNSVGWAVVTDDYKVPAKKMKVLGNTDKSHIKKNLLGALLFDSGNTA--EDRRLKRTARRRYT | 73 |
| WP_002352408 | 1 | MKKP-YSIGLDIGTNSVGWAVVTDDYKVPAKKMKVLGNTDKSHIKKNLLGALLFDSGNTA--EDRRLKRTARRRYT | 73 |
| WP_012997688 | 1 | MKKP-YSIGLDIGTNSVGWAVVTDDYKVPAKKMKVLGNTDKSHIKKNLLGALLFDSGNTA--EDRRLKRTARRRYT | 73 |
| WP_014677909 | 1 | MKKP-YSIGLDIGTNSVGWAVVTDDYKVPDKKMKVLGNTDKSHIKKNLLGALLFDSGNTA--ADRRLKRTARRRYT | 73 |
| WP_019312892 | 1 | MKKP-YSIGLDIGTNSVGWAVVTDDYKVPAKKMKVLGNTDKSHIKKNLLGALLFDSGNTA--EDRRLKRTARRRYT | 73 |
| WP_019313659 | 1 | MKKP-YSIGLDIGTNSVGWAVVTDDYKVPAKKMKVLGNTDKSHIEKNLLGALLFDSGNTA--EDRRLKRTARRRYT | 73 |
| WP_019314093 | 1 | MKKP-YSIGLDIGTNSVGWAVVTDDYKVPAKKMKVLGNTDKSHIKKNLLGALLFDSGNTA--EDRRLKRTARRRYT | 73 |
| WP_019315370 | 1 | MKKP-YSIGLDIGTNSVGWAVVTDDYKVPAKKMKVLGNTDKSHIKKNLLGALLFDSGNTA--ADRRLKRTARRRYT | 73 |
| WP_019803776 | 1 | MKKP-YSIGLDIGTNSVGWAVVTDDYKVPAKKMKVLGNTDKSHIKKNLLGALLFDSGNTA--EDRRLKRTARRRYT | 73 |
| WP_019805234 | 1 | MKKP-YSIGLDIGTNSVGWAVVTDDYKVPAKKMKVLGNTDKSHIEKNLLGALLFDSGNTA--EDRRLKRTARRRYT | 73 |
| WP_024783594 | 1 | MKKP-YSIGLDIGTNSVGWAVVTDDYKVPAKKMKVLGNTDKSHIKKNLLGALLFDSGNTA--EDRRLKRTARRRYT | 73 |
| WP_024784288 | 1 | MKKP-YSIGLDIGTNSVGWAVVTDDYKVPAKKMKVLGNTDKSHIKKNLLGALLFDSGNTA--EDRRLKRTARRRYT | 73 |
| WP_024784666 | 1 | MKKP-YSIGLDIGTNSVGWAVVTDDYKVPAKKMKVLGNTDKSHIKKNLLGALLFDSGNTA--ADRRLKRTARRRYT | 73 |
| WP_024784894 | 1 | MKKP-YSIGLDIGTNSVGWAVVTDDYKVPAKKMKVLGNTDKSHIKKNLLGALLFDSGNTA--ADRRLKRTARRRYT | 73 |
| WP_024786433 | 1 | MKKP-YSIGLDIGTNSVGWAVVTDDYKVPAKKMKVLGNTDKSHIKKNLLGALLFDSGNTA--ADRRLKRTARRRYT | 73 |
| WP_049473442 | 1 | MKKP-YSIGLDIGTNSVGWAVVTDDYKVPAKKMKVLGNTDKSHIKKNLLGALLFDSGNTA--EDRRLKRTARRRYT | 73 |
| WP_049474547 | 1 | MKKP-YSIGLDIGTNSVGWAVVTDDYKVPAKKMKVLGNTDKSHIKKNLLGALLFDSGNTA--ADRRLKRTARRRYT | 73 |
| EMC03581 | 1 | MDL------IGTNSVGWAVVTDDYKVPAKKMKVLGNTDKSHIKKNLLGALLFDSGNTA--ADRRLKRTARRRYT | 66 |
| WP_000428612 | 1 | ENKN-YSIGLDIGTNSVGWAVVTDDYKVPAKKMKVLGNTDKRFIKKNLLGALLFDEGTTA--EARRLKRTARRRYT | 74 |
| WP_000428613 | 1 | ENKN-YSIGLDIGTNSVGWAVVTDDYKVPSKKMKVLGNTDKSHIKKNLLGALLFDEGTTA--EARRLKRTARRRYT | 74 |
| WP_049523028 | 1 | K-KP-YSIGLDIGTNSVGWAVITDDYKVPAKKMKVLGNTNKESIKKNLLGALLFDAGNTA--EARRLKRTARRRYT | 73 |
| WP_003107102 | 1 | -----MKVLGNTDRQTVKKNMIGTLLFDSGETA--EARRLKRTTRRRYT | 42 |
| WP_054279288 | 1 | -KKS-YSIGLDIGTNSVGWVIITDDYKVPAKKMKVLGNTSRQSIKKNMIGALLFDEGGPA--ASTRVKRTTRRRYT | 75 |
| WP_049531101 | 1 | SNKP-YSIGLDIGTNSVGWAVIITDDYKVPSKKMKVLGNTDKHFIKKNLLGALLFDEGTTA--EDRRLKRTARRRYT | 74 |
| WP_049538452 | 1 | SNKP-YSIGLDIGTNSVGWAVIITDDYKVPSKKMKVLGNTDKHFIKKNLLGALLFDEGTTA--EDRRLKRTARRRYT | 74 |
| WP_049549711 | 1 | --YS-YSIGLDIGTNSVGWAVINEDYKVPAKKMTVFGNTDRKTIKKNLLGTVLFDSGETA--QARRLKRTNRRRYT | 75 |
| EFR44625 | 1 | -------MLGTVLFDSGETA--QARRLKRTNRRRYT | 27 |
| WP_002897477 | 1 | K-KP-YSIGLDIGTNSVGWAVVTDDYKVPSKKMKVLGNTDKHFIKKNLLGTLLFDDGNTA--ESRRLKRTARRRYT | 73 |
| WP_002906454 | 1 | K-KP-YSIGLDIGTNSVGWAVITDDYKVPSKKMKVLGNTDKHFIKKNLLGALLFDEGTTA--EDRRLKRTSRRRYT | 73 |
| WP_009729476 | 1 | ENKN-YSIGLDIGTNSVGSVITDDYKVPSKKMKVLGNTDKHFIKKNLLGALLFDEGTTA--EARRLKRTARRRYT | 74 |

-continued

```
CQR24647          1 MKKP-YSIGLDIGTNSVGWSVVTDDYKVPAKKMKVLGNTDKEYIKKNLIGALLFDSGETA--EATRMKRTARRYT  73
WP_000066813      1 SNKS-YSIGLDIGTNSVGWAVITDDYKVPSKKMKVLGNTDKHFIKKNLIGALLFDEGTTA--EDRRLKRTARRYT  74
WP_009754323      1 NNNN-YSIGLDIGTNSVGWAVITDDYKVPSKKMKMVLGNTDKRFIKKNLLGALLFDEGTTA--EDRRLKRTARRYT  74
WP_044674937      1 MKKK-YAIGIDIGTNSVGWAVITDEYKVPSKKMKVFGNTEKRYIKKNLLGTLLFDEGNTA--ENRRLKRTARRYT  73
WP_044676715      1 MKKK-YAIGIDIGTNSVGWSVVTDDYKVPSKKMKVFGNTEKRYIKKNLLGTLLFDEGNTA--ENRRLKRTARRYT  73
WP_044680361      1 MKKK-YAIGIDIGTNSVGWSVVTDDYKVPSKKMKVFGNTEKRYIKKNLLGTLLFDEGNTA--ENRRLKRTARRYT  73
WP_044681799      1 MKKK-YAIGIDIGTNSVGWSVVTDDYKVPSKKMKVFGNTEKRYIKKNLLGTLLFDEGNTA--ENRRLKRTARRYT  73
WP_049533112      1 MDQK-YSIGLDIGTNSVGWAVITDDYKVPAKKMKVLGNTDKQSIKKNLLGALLFDSGETA--EATLKRTARRYT  73
WP_029090905      1 ------------------------------MWGVSLFEAGKTA--AERRGYRSTRRRLN  27
WP_065066696      1 I-VD-YCIGLDLGTGSVGWAVVDMNHRLMKRN-------------GKHLWGSR.LFSNAEFTA--ANRRASRSIRRRYN  60
AIT42264          1 MDKK-YSIGLDIGTNSVGWAVITDEYKVPSKKFKVLGNTDRHSIKKKNLLGALLFDEGTTA--EATLKRTARRYT  73
WP_034440723      1 -MKN-YTIGLDIGTNSVGWAVIKDDLTLVRKKIKISGNTDKKEVKKNLWGSFLFEQGDTA--QDTRVKRIARRYE  72
AKQ21048          1 MDKK-YSIGLDIGTNSVGWAVITDEYKVPSKKFKVLGNTDRHSIKKKNLIGALLFDSGETA--EATRLKRTARRYT  73
WP_004636532      1 MQKN-YTIGLDIGTNSVGWAVMKDDYTLIRKRMKVLGNTDIKKLKKNFWGVRLFDEGETA--KETRLKRGTRRRYQ  73
WP_002364836      1 MKKD-YVIGLDIGTNSVGWAVMTEDYQLVKKKMPIYGNTEKKKIKKNFWGVRLFEEGHTA--EDRRLKRTARRIS  73
WP_016631044      1 ----------------------------MRLFEEGHTA--EDRRLKRTARRIS  24
EMS75795          1 ------------------------------------------------------------  
WP_002373311      1 MKKD-YVIGLDIGTNSVGWAVMTEDYQLVKKKMPIYGNTEKKKIKKNFWGVRLFEEGHTA--EDRRLKRTARRIS  73
WP_002378009      1 MKKD-YVIGLDIGTNSVGWAVMTEDYQLVKKKMPIYGNTEKKKIKKNFWGVRLFEEGHTA--EDRRLKRTARRIS  73
WP_002407324      1 MKKD-YVIGLDIGTNSVGWAVMTEDYQLVKKKMPIYGNTEKKKIKKNFWGVRLFEEGHTA--EDRRLKRTARRIS  73
WP_002413717      1 MDKK-YSIGLDIGTNSVGWAVITDEYKVPSKKFKVLGNTDRHSIKKKNLIGALLFDSGETA--EATRLKRTARRYT  73
WP_010775580      1 MKKD-YTIGLDIGTNSVGWAVMKDDYTLIRKRMKVLGNTDIKKLKKNFWGVRLFDEGETA--KETRLKRGTRRRYQ  73
WP_010818269      1 MKKD-YVIGLDIGTNSVGWAVMTEDYQLVKKKMPIYGNTEKKKIKKNFWGVRLFEEGHTA--EDRRLKRTARRIS  73
WP_010824395      1 MKKD-YVIGLDIGSNSVGWAVMTEDYQLVKKKMPIYGNTEKKKIKKNFWGVRLFEEGHTA--EDRRLKRTARRIS  73
WP_016622645      1 MKKD-YVIGLDIGTNSVGWAVMTEDYQLVKKKMPIYGNTEKKKIKKNFWGVRLFEEGHTA--EDRRLKRTARRIS  73
WP_033624816      1 MKKD-YVIGLDIGTNSVGWAVMTEDYQLVKKKMPIYGNTEKKKIKKNFWGVRLFEEGHTA--EDRRLKRTARRIS  73
WP_002625576      1 MKKD-YVIGLDIGTNSVGWAVMTEDYQLVKKKMPIYGNTEKKKIKKNFWGVRLFEEGHTA--EDRRLKRTARRIS  73
WP_002407324      1 MKKD-YVIGLDIGTNSVGWAVMTEDYQLVKKKMPIYGNTEKKKIKKNFWGVRLFEEGHTA--EDRRLKRTARRIS  73
WP_033789179      1 MKKD-YVIGLDIGTNSVGWAVMTEDYQLVKKKMPIYGNTEKKKIKKNFWGVRLFEEGHTA--EDRRLKRTARRIS  73
WP_002310644      1 MKKE-YTIGLDIGTNSVGWSVLTDDYRLVSKKMKVAGNTEKSSTKKNFWGVRLFDEGQTA--EARRSKRTARRLA  73
WP_002312694      1 MKKE-YTIGLDIGTNSVGWSVLTDDYRLVSKKMKVAGNTEKSSTKKNFWGVRLFDEGQTA--EARRSKRTARRLA  73
WP_002314015      1 MKKE-YTIGLDIGTNSVGWSVLTDDYRLVSKKMKVAGNTEKSSTKKNFWGVRLFDEGQTA--EARRSKRTARRLA  73
WP_002320716      1 MKKE-YTIGLDIGTNSVGWSVLTDDYRLVSKKMKVAGNTEKSSTKKNFWGVRLFDEGQTA--EARRSKRTARRLA  73
WP_002330729      1 MKKE-YTIGLDIGTNSVGWSVLTDDYRLVSKKMKVAGNTEKSSTKKNFWGVRLFDEGQTA--EARRSKRTARRLA  73
WP_002335161      1 MKKE-YTIGLDIGTNSVGWSVLTDDYRLVSKKMKVAGNTEKSSTKKNFWGVRLFDEGQTA--EARRSKRTARRLA  73
WP_002345439      1 MKKE-YTIGLDIGTNSVGWSVLTDDYRLQLMKRKMSVHGNTEKKKIKKKNFWGVRLFDEGARLA--EFRRTKRTNRRRLA  73
WP_034867970      1 MTKD-YTIGLDIGTNSVGWSVLTDDYRLQLMKRKMSVHGNTEKKKIKKKNFWGVRLFDEGARLA--EFRRTKRTNRRRLA  73
WP_047937432      1 MKKE-YTIGLDIGTNSVGWSVLTDDYRLVSKKMKVAGNTEKSSTKKNFWGVRLFDEGQTA--EARRSKRTARRLA  73
WP_010720994      1 MTKD-YTIGLDIGTNSVGWSVLTDDYRLQLMKRKMSVHGNTEKKKIKKKNFWGVRLFDEGARLA--EFRRTKRTNRRRLA  73
WP_010737004      1 MTKD-YTIGLDIGTNSVGWSVLTDDYRLQLMKRKMSVHGNTEKKKIKKKNFWGVARLFDEGARLA--EFRRTKRTNRRRLA  73
WP_044700478      1 MTKD-YTIGLDIGTNSVGWSVLTDDYRLQLMKRKMSVHGNTEKKKIKKKNFWGVARLFDEGARLA--EFRRTKRTNRRRLA  73
WP_072009003      1 MKND-YTIGLDIGTNSVGYSVVTDDYKVISKKMNVFGNTEKKSSIKKKNFWGVRLFESGQTA--QEARMKRTSRRRIA  73
WP_023519017      1 MEKE-YTIGLDIGTNSVGWAVLTDDYRLVARKMSIQGDSNRKKINKKMKVYGNTETKYLKKNLVKKNYLKKRNFWGVRLFDEGETA--QPFRRIKRTNRRRIA  73
WP_010770040      1 MGKE-YTIGLDIGTNSVGWAVLQEDLDLVRRKMKVYGNTEKNYLKKKNFWGVRLFDEGMTA--ADRRLKRTTRRRYS  73
WP_048604708      1 MNKA-YTLGLDIGTNSVGWAVVTDDYRLMAKKMPVHSKMEKKKMKMKNFWGARLFDEGQTA--EERRNKRATRRRLR  73
WP_010750235      1 MSRP-YNIGLDIGTSSIGWSVAVTNDYDLLNIK-------------GKYGYGVRLFDEGAQTA--AERRSFRTTRRRLK  61
AII16583          1 ADKK-YSIGLDIGTNSVGWAVITDEYKVPSKKFKVLGNTDRHSIKKKNLIGALLFDSGETA--EATLKRTARRYT  112
WP_029073316      1 NNNKI-YNIGLDIGDASVGWAVVDEHYNLLKRH-------------GKHMWGSRLFTQANTA--VERRSSRSTRRRYN  65
WP_031589969      1 NNNI-YNIGLDIGDASVGWAVVTDDYDEHYNLLKRN-------------GKHMWGSRLFTQANTA--VERRSSRSTRRRYN  65
KDA45870          1 LKKD-YSLGLDIGTNSVGHAVVTDGTSKKTIKKNMLGVLLFNEGQTA--ADTRLKRGARRYT  74
WP_039099354      1 ----------------------------GKYGYGVRLFDEGAQTA--AERRSFRTTRRRLK  61
AKP02966          1 KEQP-YNIGLDIGTGSVGWAVTNDYDLLNIK-------------KKNLWGVRLFEGAQTA--KETRLNRSTRRRYR  64
WP_010991369      1 MKKP-YTIGLDIGTNSVGWAVLTDQYDLVRKKMKIAGDSEKKQIKKKNFWGVRLFDEGQTA--ADRMARTARRIE  73
WP_033838504      1 MKKP-YTIGLDIGTNSVGWAVLTDQYDLVRKMKIAGDSEKKQIKKKNFWGVRLFDEGQTA--ADRRMARTARRIE  73
```

-continued

```
EHN60060         1                                                                    MKKP-YTIGLDIGTNSVGWAVLTDQYDLVRKKMKIAGDSEKKQIKKNFWGVRLFDEGQTA--ADRRMARTARRRIE      76
EFR89594         1                                                                                                                                                 
WP_038409211     1                                                                    MRKP-YTIGLDIGTNSVGWAVLTDQYNLVRKRMKVAGSAEKKQIKKNFWGVRLFDEGEVA--AGRRMNRTTRRRIE      73
EFR95520         1                                                                                                                                                 
WP_003723650     1                                                                    MKNP-YTIGLDIGTNSVGWAVLTDQYDLVRKKMKVAGNSDKKQIKKNFWGVRLFDDGQTA--VDRRMNRTARRRIE      73
WP_003727705     1                                                                    MKNP-YTIGLDIGTNSVGWAVLTDQYDLVRKKMKVAGNSDKKQIKKNFWGVRLFDDGQTA--VDRRMNRTARRRIE      73
WP_003730785     1                                                                    MKNP-YTIGLDIGTNSVGWAVLTDQYDLVRKKMKVAGNSDKKQIKKNFWGVRLFDDGQTA--VDRRMNRTARRRIE      73
WP_003733029     1                                                                    MKKP-YTIGLDIGTNSVGWAVLTDQYDLVRKKMKISGDSEKKKQIKKNFWGVRLFEKGETA--AKRRMSRTARRRIE      73
WP_003739838     1                                                                    MKNP-YTIGLDIGTNSVGWAVLTDQYDLVRKKMKVAGNSDKKQIKKNFWGVRLFDEGETA--ADRRMNRTARRRIE      73
WP_014601172     1                                                                    MKNP-YTIGLDIGTNSVGWAVLTNQYDLVRKKMKVAGNSDKKQIKKNFWGVRLFDDGQTA--VDRRMNRTARRRIE      73
WP_023548323     1                                                                    MKNP-YTIGLDIGTNSVGWAVLTNQYDLVRKKMKVAGNSDKKQIKKNFWGVRLFDDGQTA--VDRRMNRTARRRIE      73
WP_031665337     1                                                                    MKNP-YTIGLDIGTNSVGWAVLTDQYDLVRKRMKVAGNSDKKQIKKNFWGVRLFDDGQTA--VDRRMNRTARRRIE      73
WP_031669209     1                                                                    MKKP-YTIGLDIGTNSVGWAVLTDQYDLVRKKMKISGDSEKKQIKKNFWGVRLFEKGETA--AKRRMSRTARRRIE      73
WP_033920898     1                                                                    MKNP-YTIGLDIGTNSVGWAVLTDQYDLVRKKMKVAGNSDKKQIKKNFWGVRLFDDGQTA--VDRRMNRTARRRIE      73
AKI42028         1                                                                    MKNP-YTIGLDIGTNSVGWAVLTNQYDLVRKKMKVAGNSDKKQIKKNFWGVRLFDDGQTA--VDRRMNRTARRRIE      73
AKI50529         1                                                                    MKKP-YTIGLDIGTNSVGWAVLTDQYDLVRKKMKVAGNSDKKQIKKNFWGVRLFDDGQTA--VDRRMNRTARRRIE      76
EFR83390         1                                                                                                                                                 
WP_046323366     1                                                                    MKKP-YTIGLDIGTNSVGWAALTDQYLVRKKMKVAGNSEKKQIKKNLWGVRLVDEGKTA--AHRRVNRTTRRRIE       73
AKE81011         1                                                             ADKK-YSIGLDIGTNSVGWAVITDEYKVPSKKFKVLGNTDRHSIKKNLIGALLFDSGETA--EATRLKRTARRRYT      89
CUO82355         1                                                                         I-VD-YSIGLDLGTGSVGNAETA--ATRRSSRSIRRRYN                                64
WP_033162887     1                                                                       KDIR-YSIGLDIGTNSVGWAVVDMNHRLMKRN--------------GKHLWGSRLFSNAETA--ATRRSSRSIRRRYN    65
AGZ01981         1                                                           ADKK-YSIGLDIGTNSVGWAVITDEYKVPSKKFKVLGNTDRHSIKKNLIGALLFDSGETA--EATRLKRTARRRYT     106
AKA60242         1                                                                    MDKK-YSIGLDIGTNSVGWAVITDEYKVPSKKFKVLGNTDRHSIKKNLIGALLFDSGETA--EATRLKRTARRRYT      73
AKS40380         1                                                                    MDKK-YSIGLAIGTNSVGWAVITDEYKVPSKKFKVLGNTDRHSIKKNLIGALLFDSGETA--EATRLKRTARRRYT      77
4UN5_B          74   RRKNRICYLQEIFSNEMAKVDDSFFHRLEE-SFLV--EEDKK---H ERHPIFGNIV-DEVAYHEKYPTIYHLRKKLV  143
WP_010922251    74   RRKNRICYLQEIFSNEMAKVDDSFFHRLEE-SFLV--EEDKK---H ERHPIFGNIV-DEVAYHEKYPTIYHLRKKLV  143

WP_039695303    75   RRKNRLRYLQEIFANEIAKVDESFQRLDE-SFLT--DDDKT---F DSHPIEGNKA-EEDAYHQKEPTIYHLRKHLA   144
WP_045635197    74   RRKNRLRYLQEIFSEEMSKVDDSFFHRLDD-SFLI--PEDKR---E SKYPIFATLT-EEKEYHKQFPTIYHLRKQLA   143
5AXW_A          62   RRRHRIQRVKKLLFD-------------YNLLTDhSELs------------G ---NPYEARVK---------GLSQKLS                                                       104
WP_009880683    74                                                                                                                                                 
WP_010922251    74   RRKNRICYLQEIFSNEMAKVDDSFFHRLEE-SFLV--EEDKK---H ERHPIFGNIV-DEVAYHEKYPTIYHLRKKLV  143
WP_011054416    74   RRKNRICYLQEIFSNEMAKVDDSFFHRLEE-SFLV--EEDKK---H ERHPIFGNIV-DEVAYHEKYPTIYHLRKKLA  143
WP_011284745    74   RRKNRICYLQEIFSNEMAKVDDSFFHRLEE-SFLV--EEDKK---H ERHPIFGNIV-DEVAYHEKYPTIYHLRKKLA  143
WP_011285506    74   RRKNRICYLQEIFSNEMAKVDDSFFHRLEE-SFLV--EEDKK---H ERHPIFGNIV-DEVAYHEKYPTIYHLRKKLA  143
WP_011527619    74   RRKNRICYLQEIFSNEMAKVDDSFFHRLEE-SFLV--EEDKK---H ERHPIFGNIV-DEVAYHEKYPTIYHLRKKLV  143
WP_012560673    74   RRKNRICYLQEIFSNEMAKVDDSFFHRLEE-SFLV--EEDKK---H ERHPIFGNIV-DEVAYHEKYPTIYHLRKKLV  143
WP_014407541    74   RRKNRICYLQEIFSNEMAKVDDSFFHRLEE-SFLV--EEDKK---H ERHPIFGNIV-DEVAYHEKYPTIYHLRKKLA  143
WP_020905136    74   RRKNRICYLQEIFSNEMAKVDDSFFHRLEE-SFLV--EEDKK---H ERHPIFGNIV-DEVAYHEKYPTIYHLRKKLA  143
WP_023080005    74   RRKNRICYLQEIFSNEMAKVDDSFFHRLEE-SFLV--EEDKK---H ERHPIFGNIV-DEVAYHEKYPTIYHLRKKLA  143
WP_023610282    74   RRKNRICYLQEIFSNEMAKVDDSFFHRLEE-SFLV--EEDKK---H ERHPIFGNIV-DEVAYHEKYPTIYHLRKKLA  143
WP_030125963    74   RRKNRICYLQEIFSNEMAKVDDSFFHRLEE-SFLV--EEDKK---H ERHPIFGNIV-DEVAYHEKYPTIYHLRKKLA  143
WP_030126706    74   RRKNRICYLQEIFSNEMAKVDDSFFHRLEE-SFLV--EEDKK---H ERHPIFGNIV-DEVAYHEKYPTIYHLRKKLA  143
WP_031488318    74   RRKNRICYLQEIFSNEIAKVDDSFFHRLEE-SFLV--EEDKK---H ERHPIFGNIV-DEVAYHEKYPTIYHLRKKLA  143
WP_032460140    74   RRKNRICYLQEIFSNEIAKVDDSFFHRLEE-SFLV--EEDKK---H ERHPIFGNIV-DEVAYHEKYPTIYHLRKKLV  143
WP_032461047    74   RRKNRICYLQEIFSNEMAKVDDSFFHRLEE-SFLV--EEDKK---H ERHPIFGNIV-DEVAYHEKYPTIYHLRKKLA  143
WP_032462016    74   RRKNRICYLQEIFSNEMAKVDDSFFHRLEE-SFLV--EEDKK---H ERHPIFGNIV-DEVAYHEKYPTIYHLRKKLA  143
WP_032462936    74   RRKNRICYLQEIFSNEMAKVDDSFFHRLEE-SFLV--EEDKK---H ERHPIFGNIV-DEVAYHEKYPTIYHLRKKLA  143
WP_032464890    74   RRKNRICYLQEIFSNEMAKVDDSFFHRLEE-SFLV--EEDKK---H ERHPIFGNIV-DEVAYHEKYPTIYHLRKKLA  143
WP_033888930    74                                                                                                                                                 
WP_038431314    74   RRKNRICYLQEIFSNEMAKVDDSFFHRLEE-SFLV--EEDKK---H ERHPIFGNIV-DEVAYHEKYPTIYHLRKKLA  143
WP_038432938    74   RRKNRICYLQEIFSNEMAKVDDSFFHRLEE-SFLV--EEDKK---H ERHPIFGNIV-DEVAYHEKYPTIYHLRKKLA  143
WP_038434062    74   RRKNRICYLQEIFSNEMAKVDDSFFHRLEE-SFLV--EEDKK---H ERHPIFGNIV-DEVAYHEKYPTIYHLRKKLA  143
```

```
-continued

BAQ51233            1  ----------MAKVDDSFFHRLEE-SFLV--EEDKK---H ERHPIFGNIV-DEVAYHEKYPTIYHLRKKLV                        54
KGE60162               ---------------------------------------- ------------------------------
KGE60856               ---------------------------------------- ------------------------------
WP_002989955       74  RRRNRICYLQEIFSNEMAKVDDSFFHRLEE-SFLV--EEDKK---H ERHPIFGNIV-DEVAYHEKYPTIYHLRKKLV                    143
WP_003030002       74  RRRNRLRYLQEIFAEEMNKVDENFFQRLDD-SFLV--DEDKR---G ERHPIFGNIA-AEVKYHDDFPTIYHLRKHLA                    143
WP_003065552       75  RRRNRLRYIQEIFAEEMTKVDESFFQRLDE-SFLRwdDDNKK---L GRYPIEGNKA-DVVKYHQEEPTIYHLRKELA                    146
WP_001040076       74  RRRNRILYLQEIFAEEMSKVDDSFFHRLED-SFLV--EEDKR---G SKYPIFATLQ-EEKYHEKFPTIYHLRKELA                     143
WP_001040078       74  RRRNRILYLQEIFAEEMSKVDDSFFHRLED-SFLV--EEDKR---G SKYPIFATLQ-EEKDYHEKFSTIYHLRKELA                    143
WP_001040080       74  RRRNRILYLQEIFAEEMSKVDDSFFHRLED-SFLV--EEDKR---G SKYPIFATLQ-EEKDYHEKFPTIYHLRKELA                    143
WP_001040081       74  RRRNRILYLQEIFAEEMSKVDDSFFHRLED-SFLV--EEDKR---G SKYPIFATLQ-EEKDYHEKSTIYHLRKELA                     143
WP_001040083       74  RRRNRILYLQEIFAEEMSKVDDSFFHRLED-SFLV--EEDKR---G SKYPIFATLQ-EEKDYHEKFSTIYHLRKELA                    143
WP_001040085       74  RRRNRILYLQEIFAEEMSKVDDSFFHRLED-SFLV--EEDKR---G SKYPIFATLQ-EEKDYHEKSTIYHLRKELA                     143
WP_001040087       74  RRRNRILYLQEIFAEEMSKVDDSFFHRLED-SFLV--EEDKR---G SKYPIFATLQ-EEKDYHEKFSTIYHLRKELA                    143
WP_001040088       74  RRRNRILYLQEIFAEEMSKVDDSFFHRLED-SFLV--EEDKR---G SKYYHEKFPTIYHLRKELA                                143
WP_001040089       74  RRRNRILYLQEIFAEEMSKVDDSFFHRLED-SFLV--EEDKR---G SKYPIFATLQ-EEKDYHEKFSTIYHLRKELA                    143
WP_001040090       74  RRRNRILYLQEIFAEEMSKVDDSFFHRLED-SFLV--EEDKR---G SKYPIFATLQ-EEKDYHEKFPTIYHLRKELA                    143
WP_001040091       74  RRRNRILYLQEIFAEEMSKVDDSFFHRLED-SFLV--EEDKR---G SKYPIFATLQ-EEKDYHEKFPTIYHLRKELA                    143
WP_001040092       74  RRRNRILYLQEIFAEEMSKVDDSFFHRLED-SFLV--EEDKR---G SKYPIFATMQ-EEKYYHEKFPTIYHLRKELA                    143
WP_001040094       74  RRRNRILYLQEIFAEEMSKVDDSFFHRLED-SFLV--EEDKR---G SKYPIFATMQ-EEKDYHEKFPTIYHLRKELA                    143
WP_001040095       74  RRRNRILYLQEIFAEEMSKVDDSFFHRLED-SFLV--EEDKR---G SKYPIFATLQ-EEKYYHEKFPTIYHLRKELA                    143
WP_001040096       74  RRRNRILYLQEIFAEEMSKVDDSFFHRLED-SFLV--EEDKR---G SKYPIFATLQ-EEKDYHEKFPTIYHLRKELA                    143
WP_001040097       74  RRRNRILYLQEIFAEEMSKVDDSFFHRLED-SFLV--EEDKR---G SKYPIFATMQ-EEKYYHEKFPTIYHLRKELA                    143
WP_001040098       74  RRRNRILYLQEIFAEEMSKVDDSFFHRLED-SFLV--EEDKR---G SKYPIFATLQ-EEKDYHEKFPTIYHLRKELA                    143
WP_001040099       74  RRRNRILYLQEIFAEEMSKVDDSFFHRLED-SFLV--EEDKR---G SKYPIFATLQ-EEKDYHEKFPTIYHLRKELA                    143
WP_001040100       74  RRRNRILYLQEIFAEEMSKVDDSFFHRLED-SFLV--EEDKR---G SKYPIFATLQ-EEKDYHEKFPTIYHLRKELA                    143
WP_001040104       74  RRRNRILYLQEIFAEEMSKVDDSFFHRLED-SFLV--EEDKR---G SKYXIFATLQ-EEKDYHEKFSTIYHLRKELA                    143
WP_001040105       74  RRRNRILYLQEIFAEEMSKVDDSFFHRLED-SFLV--EEDKR---G SKYPIFATLQ-EEKDYHEKFPTIYHLRKELA                    143
WP_001040106       74  CRRNRILYLQEIFAEEMSKVDDSFFHRLED-SFLV--EEDKR---G SKYPIFATLQ-EEKDYHEKFPTIYHLRKELA                    143
WP_001040107       74  RRRNRILYLQEIFAEEMSKVDDSFFHRLED-SFLV--EEDKR---G SKYPIFATLQ-EEKDYHEKFPTIYHLRKELA                    143
WP_001040108       74  RRRNRILYLQEIFAEEMSKVDDSFFHRLED-SFLV--EDDKR---G SKYPIFATMQ-EEKDYHEKFPTIYHLRKELA                    143
WP_001040109       74  RRRNRILYLQEIFAEEMSKVDDSFFHRLED-SFLV--EEDKR---G SKYPIFATLQ-EEKDYHEKFPTIYHLRKELA                    143
WP_001040110       74  RRRNRILYLQEIFAEEMSKVDDSFFHRLED-SFLV--EEDKR---G SKYPIFATLQ-EEKDYHEKFPTIYHLRKELA                    143
WP_015058523       74  RRRNRILYLQEIFAEEMSKVDDSFFHRLED-SFLV--EEDKR---G SKYPIFATLQ-EEKDYHEKFPTIYHLRKELA                    143
WP_017643650       74  RRRNRILYLQEIFAEEMSKVDDSFFHRLED-SFLV--EEDKR---G SKYPIFATLQ-EEKDYHEKFPTIYHLRKELA                    143
WP_017647151       74  RRRNRILYLQEIFAEEMSKVDDSFFHRLED-SFLV--EEDKR---G SKYPIFATLQ-EEKDYHEKFPTIYHLRKELA                    143
WP_017648376       74  RRRNRILYLQEIFAEEMSKVDDSFFHRLED-SFLV--EEDKR---G SKYPIFATLQ-EEKDYHEKFPTIYHLRKELA                    143
WP_017649527       74  RRRNRILYLQEIFAEEMSKVDDSFFHRLED-SFLV--EEDKR---G SKYPIFATLQ-EEKDYHEKFPTIYHLRKELA                    143
WP_017771611       74  RRRNRILYLQEIFAEEMSKVDDSFFHRLED-SFLV--EEDKR---G SKYPIFATLQ-EEKDYHEKFPTIYHLRKELA                    143
WP_017771984       74  RRRNRILYLQEIFAEEMSKVDDSFFHRLED-SFLV--EEDKR---G SKYPIFATLQ-EEKDYHEKFSTIYHLRKELA                    143
CFQ25032           74  RRRNRILYLQEIFAEEMSKVDDSFFHRLED-SFLV--EEDKR---G SKYPIFATLQ-EEKDYHEKFPTIYHLRKELA                    143
CFV16040           74  RRRNRILYLQEIFAEEMSKVDDSFFHRLED-SFLV--EEDKR---G SKYPIFATLQ-EEKDYHEKFPTIYHLRKELA                    143
KLJ37842           74  RRRNRILYLQEIFAEEMSKVDDSFFHRLED-SFLV--EEDKR---G SKYPIFATLQ-EEKDYHEKFPTIYHLRKELA                    143
KLJ72361           74  RRRNRILYLQEIFAEEMSKVDDSFFHRLED-SFLV--EEDKR---G SKYPIFATLQ-EEKDYHEKFSTIYHLRKELA                    143
KLL20707           74  RRRNRILYLQEIFAEEMSKVDDSFFHRLED-SFLV--EEDKR---G SKYPIFATLQ-EEKDYHEKFPTIYHLRKELA                    143
KLL42645           74  RRRNRILYLQEIFAEEMSKVDDSFFHRLED-SFLV--EEDKR---G SKYPIFATLQ-EEKDYHEKFPTIYHLRKELA                    143
WP_047207273       74  RRRNRILYLQEIFAEEMSKVDDSFFHRLED-SFLV--EEDKR---G SKYPIFATLQ-EEKYYHEKFPTIYHLRKELA                    143
WP_047209694       74  RRRNRILYLQEIFAEEMSKVDDSFFHRLED-SFLV--EEDKR---G SKYPIFATLQ-EEKDYHEKFSTIYHLRKELA                    143
WP_050198062       74  RRRNRILYLQEIFAEEMSKVDDSFFHRLED-SFLV--EEDKR---G SKYPIFATLQ-EEKDYHEKFPTIYHLRKELA                    143
WP_050201642       74  RRRNRILYLQEIFAEEMSKVDDSFFHRLED-SFLV--EEDKR---G SKYPIFATLQ-EEKDYHEKFSTIYHLRKELA                    143
WP_050204027       74  RRRNRILYLQEIFAEEMSKVDDSFFHRLED-SFLV--EEDKR---G SKYPIFATLQ-EEKDYHEKFPTIYHLRKELA                    143
WP_050881965       74  RRRNRILYLQEIFAEEMSKVDDSFFHRLED-SFLV--EEDKR---G SKYPIFATMQ-EEKDYHEKFPTIYHLRKELA                    143
WP_050886065       74  RRRNRILYLQEIFAEEMSKVDDSFFHRLED-SFLV--EEDKR---G SKYPIFATMQ-EEKDYHEKFPTIYHLRKELA                    143
AHN30376           74  RRRNRILYLQEIFAEEMSKVDDSFFHRLED-SFLV--EEDKR---G SKYPIFATMQ-EEKDYHEKEPTIYHLRKELA                    143
```

-continued

| | | | | |
|---|---|---|---|---|
| EAO78426 | 74 | RRRNRIRLYLQEIFAEEMSKVDDSFFHRLED-SFLV--EEDKR---G | SKYPIFATLQ-EEKDYHEKFSTIYHLRKELA | 143 |
| CCW42055 | 74 | RRRNRIRLYLQEIFAEKMSKVDDSFFHRLED-SFLV--EEDKR---G | RRYPIFATLQ-EEKDYHEKEPTIYHLRKELA | 143 |
| WP_003041502 | 74 | RRRNRLRLYLQEIFAEEMMQVDESFFQRLDD-SFLV--DEDKR---G | ERHPIEGNIA-AEVKYHDEEPTIYHLRKHLA | 143 |
| WP_037593752 | 75 | RRRNRLRLYLQEIFTEMNKVDENFFQRLDD-SFLV--EEDKR---G | SKYPIEGNIA-AEVKYHKKEKTIYHLREELA | 144 |
| WP_049516684 | 75 | RRRNRLRLYLQEIFAEEMMQVDESFFQRLDD-SFLV--EEDKQ---G | SRYPIEGNIA-AEVKEYHKKEKTIYHLREELA | 144 |
| GAD46167 | 75 | RRRNRLRLYLQDIFTEEMNKVDENFFQRLDE-SELT--DNDKN---F | DSHPIEGNKA-EEDAYHQKEPTIYHLRKHLA | 144 |
| WP_018363470 | 74 | RRRNRLRLYLQDIFTEEMAKVDDSFFQRLDE-SELT--DNDKN---F | DSHPIEGNKA-EEDAYHQKEPTIYHLRKHLA | 143 |
| WP_003043819 | 74 | RRRNRIRYLQEIFANEMAKLDDSFFQRLEE-SFLV--EEDKK---N | ERHPIFGNLA-DEVAYHRNYPTIYHLRKKLA | 143 |
| WP_006269658 | 74 | RRRNRLRYLQEIFTGEMNKVDENFFQRLDD-SFLV--DEDKR---G | EHHPIFGNLA-AEVKYHDDEPTIYHLRRHLA | 143 |
| WP_048800889 | 74 | RRRNRLRYLQEIFIEEMNKVDENFFQRLDD-SFLV--TEDKR---G | SKYPIEGILK-EEKEYYKEFETIYHLRKRLA | 143 |
| WP_012767106 | 74 | RRRNRLRYLQEIFSSEMNKVDDSFFHRLEE-SFLV--EEDKK---H | ERHPIFGNIV-DEVAYHEKYPTIYHLRKKLA | 143 |
| WP_014612333 | 74 | RRRNRIRYLQEIFSSEMSKVDDSFFHRLEE-SFLV--EEDKK---H | ERHPIFGNIV-DEVAYHEKYPTIYHLRKKLA | 143 |
| WP_015017095 | 74 | RRRNRIRYLQEIFSSEMSKVDDSFFHRLEE-SFLV--EEDKK---H | ERHPIFGNIV-DEVAYHEKYPTIYHLRKKLA | 143 |
| WP_015057649 | 74 | RRRNRIRYLQEIFSSEMSKVDDSFFHRLEE-SFLV--EEDKK---H | ERHPIFGNIV-DEVAYHEKYPTIYHLRKKLA | 143 |
| WP_048327215 | 74 | RRRNRIRYLQEIFSSEMSKVDDSFFHRLEE-SFLV--EEDKK---H | ERHPIFGNIV-DEVAYHEKYPTIYHLRKKLA | 143 |
| WP_049519324 | 74 | RRRNRIRYLQEIFSSEMSKVDDSFFHRLEE-SFLV--EEDKK---H | ERHPIFGNIV-DEVAYHEKYPTIYHLRKKLA | 143 |
| WP_012515931 | 74 | RRRNRLRYLKEIFTEEMAKVDDGFFQRLED-SFYV--LEDKE---G | NKHPIFANLA-DEVAYHKKYPTIYHLRKELV | 143 |
| WP_021320964 | 74 | RRRNRLRYLKEIFTEEMAKVDDGFFQRLED-SFYV--LEDKE---G | NKHPIFANLA-DEVAYHKKYPTIYHLRKELV | 143 |
| WP_037581760 | 74 | RRRNRLRFLKEIFTEEMAKVDDGFFQRLED-SFYV--LEDKE---G | NKHPIFANLA-EEDTYHQEFPTIYHLRKHLA | 143 |
| WP_004232481 | 74 | RRRNRLRYLQEIFAKEMAKVDESFFYRLDE-SELT--DDDKT---F | DSHPIEGNKA-EEDTYHQEFPTIYHLRKHLA | 143 |
| WP_009854540 | 75 | RRRNRLRYLQEIFAEEMTKVDESFFYRLDE-SELT--TDEKD---F | ERHPIEGNKA-EEDAVHQKEPTIYHLRNYLA | 144 |
| WP_012962174 | 75 | RRRNRLRYLQEIFAEEMAKVDESFFYRLDE-SELT--DDDKD---F | ERHPIFGNKA-DEIKYHQEFPTIYHLRKHLA | 144 |
| WP_039695303 | 75 | RRRNRLRYLQEIFANEIAKVDESFFQRLDE-SELT--DDDKT---F | DSHPIEGNKA-EEDAYHQKEPTIYHLRKYLA | 144 |
| WP_014334983 | 74 | RRRNRLRYLQEIFAKEMTKVDESFFHRLED-SFLI--PEDKR---F | SKYPIFATLE-EEKEYHKQFPTIYHLRKQLA | 143 |
| WP_003099269 | 74 | RRKYIKELQKIFSSEMNELDIAFFPRLSE-SFLV--SDDKE---F | ENHPIFGNLK-DEITYNDYPTIYHLRQTLA | 143 |
| AHY17476 | 74 | RRKYIKELQKIFSSEMNELDIAFFPRLSE-SFLV--SDDKE---F | ENHPIFGNLK-DEITYNDYPTIYHLRQTLA | 143 |
| ESR09100 | | -------------------------------- | ------------------------------ | |
| AGM98575 | 74 | RRKYIKELQKIFSSEMNELDIAFFPRLSE-SFLV--SDDKE---F | ENHPIEGNLE-EEVKYHENEPTIYHLRQYLA | 143 |
| ALF27331 | 74 | RRRNRILYLQEIFSEEMGKVDDSFFHRLED-SFLV--TEDKR---G | ERHPIEGNLE-EEVKYHENEPTIYHLRKTLA | 143 |
| WP_018372492 | 74 | RRRNRIRYLQHIFAEEMRADENFFHRLKE-SFPV--EEDKT---Y | ERHPIEGTLE-EEKNYHKNYPTIYHLRKTLA | 143 |
| WP_045618028 | 75 | RRRNRLRYLQEIFSEEMSKVDDSFFHRLDD-SFLI--PEDKR---G | SKYPIFATLE-EEKEYHKQFPTIYHLRKHLA | 144 |
| WP_045635197 | 74 | RRRNRLRYLQEIFSEEMSKVDDSFFHRLDD-SFLI--PEDKR---E | SKYPIFATLT-EEKEYHKQFPTIYHLRKQLA | 143 |
| WP_002263549 | 74 | RRRNRILYLQEIFSEEMGKVDDSFFHRLED-SFLV--TEDKR---G | ERHPIEGNLE-EEVKYHENEPTIYHLRQYLA | 143 |
| WP_002263887 | 74 | RRRNRILYLQEIFSEEMGKVDDSFFHRLED-SFLV--TEDKR---G | ERHPIEGNLE-EEVKYHENEPTIYHLRQYLA | 143 |
| WP_002264920 | 74 | RRRNRILYLQEIFSEEMGKVDDSFFHRLED-SFLV--TEDKR---F | DSYPIEGNKA-EEDAYHQKEPTIYHLRKHLA | 143 |
| WP_002269043 | 74 | RRRNRILYLQEIFSEEMGKVDDSFFHRLED-SFLV--DDDKN---F | ERHPIEGNLE-EEVKYHENEPTIYHLRQYLA | 143 |
| WP_002269448 | 74 | RRRNRILYLQEIFSEEMGKVDDSFFHRLED-SELV--TEDKR---G | ERHPIEGNLE-EEVKYHENEPTIYHLRQYLA | 143 |
| WP_002271977 | 74 | RRRNRILYLQEIFSEEMGKVDDSFFEHRLED-SELV--TEDKR---G | ERHPIEGNLE-EEVKYHENEPTIYHLRQYLA | 143 |
| WP_002272766 | 74 | RRRNRILYLQEIFSEEMGKVDDSFFEHRLED-SELV--TEDKR---G | ERHPIEGNLE-EEVKYHENEPTIYHLRQYLA | 143 |
| WP_002273241 | 74 | RRRNRILYLQEIFSEEMGKVDDSFFEHRLED-SELV--TEDKR---G | ERHPIEGNLE-EEVKYHENEPTIYHLRQYLA | 143 |
| WP_002275430 | 74 | RRRNRILYLQEIFSEEMGKVDDSFFEHRLED-SELT--TEDKR---G | SKYPIFATLE-EEKNYHKNYPTIYHLRKTLA | 143 |
| WP_002276448 | 74 | RRRNRILYLQEIFSEEMGKVDDSFFEHRLED-SELT--DDDKN---F | DSHPIEGNLE-EEVKYHENEPTIYHLRKHLA | 143 |
| WP_002277050 | 74 | RRRNRILYLQEIFAEEMSKVDDSFFEHRLED-SELV--TEDKN---G | ERHPIEGNLE-EEVKYHENEPTIYHLRQYLA | 143 |
| WP_002277364 | 74 | RRRNRILYLQEIFAEEMSKVDDSFFEHRLED-SELV--TEDKN---G | ERHPIEGNLE-EEVKYHENEPTIYHLRQYLA | 143 |
| WP_002279025 | 74 | RRRNRILYLQEIFAEEMSKVDDSFFEHRLED-FELV--TEDKN---G | ERHPIEGNLE-EEVKYHENEPTIYHLRQYLA | 143 |
| WP_002279859 | 74 | RRRNRILYLQEIFSEEMGKVDDSFFEHRLED-SELT--DDDKN---F | DSHPIEGNKA-EEDAYHQKEPTIYHLRKHLA | 143 |
| WP_002280230 | 74 | RRRNRILYLQEIFAEEMSKVDDSFFEHRLED-SELV--TEDKN---G | ERHPIEGNLE-EEVKYHENEPTIYHLRQYLA | 143 |
| WP_002281696 | 74 | RRRNRILYLQEIFAEEMSKVDDSFFEHRLED-SELV--TEDKR---G | ERHPIEGNLE-EEVKYHENEPTIYHLRQYLA | 143 |
| WP_002282247 | 74 | RRRNRILYLQEIFAEEMSKVDDSFFEHRLED-SELT--DDDKN---F | DSHPIEGNKA-EEDAYHQKEPTIYHLRKHLA | 143 |
| WP_002282906 | 74 | RRRNRILYLQEIFAEEMSKVDDSFFEHRLED-SELV--TEDKR---G | ERHPIEGNLE-EEVKYHENEPTIYHLRQYLA | 143 |
| WP_002283846 | 74 | RRRNRILYLQEIFAEEMSKVDDSFFEHRLED-SELV--TEDKR---G | ERHPIEGNLE-EEVKYHENEPTIYHLRQYLA | 143 |
| WP_002287255 | 74 | RRRNRILYLQEIFAEEMSKVDDSFFEHRLED-SELV--TEDKR---G | ERHPIEGNLE-EEVKYHENEPTIYHLRQYLA | 143 |

```
WP_002288990   74  RRRNRILYLQEIFSEEMGKVDDSFEHRLED-SELV--TEDKR---G ERHPIEGNLE-EEVKYHENEPTIYHLRQYLA 143
WP_002289641   74  RRRNRILYLQEIFSEEMGKVDDSFEHRLED-SELV--TEDKR---G ERHPIEGNLE-EEVKYHENEPTIYHLRQYLA 143
WP_002290427   74  RRRNRILYLQEIFSEEMGKVDDSFEHRLED-SELV--TEDKR---G ERHPIEGNLE-EEVKYHENEPTIYHLRQYLA 143
WP_002295753   74  RRRNRILYLQEIFSEEMGKVNDSFEHRLED-SELV--TEDKR---G ERHPIEGNLE-EEVKYHENEPTIYHLRQYLA 143
WP_002296423   74  RRRNRILYLQEIFSEEMGKVDDSFEHRLED-SFLV--EEDKR---G ERHPIEGNLE-EEVKYHENEPTIYHLRQYLA 143
WP_002304487   74  RRRNRILYLQEIFAEEMMQVDESFQRLDD-SFLV--TEDKR---G SRYPIEGILK-EEKKYHKEEKTIYHLREKLA 143
WP_002305844   74  RRRNRILYLQEIFSEEMDKVDDSFEHRLED-SELV--TEDKR---G ERHPIEGNLE-EEVKYHENEPTIYHLRQYLA 143
WP_002307203   74  RRRNRILYLQEIFSEEMGKVDDSFEHRLED-SELV--TEDKR---G ERHPIEGNLE-EEVKYHENEPTIYHLRQYLA 143
WP_002310390   74  RRRNRILYLQEIFSEEMGKVDDSFEHRLED-SELV--TEDKR---G ERHPIEGNLE-EEVKYHENEPTIYHLRQYLA 143
WP_002352408   74  RRRNRILYLQEIFAEEMSKVDDSFEHRLED-SELV--TEDKR---G ERHPIEGNLE-EEVKYHENEPTIYHLRQYLA 143
WP_012997688   74  RRRNRILYLQEIFAEEMSKVDDSFEHRLED-SELV--TEDKR---G ERHPIEGNLE-EEVKYHENEPTIYHLRQYLA 143
WP_014677909   74  RRRNRILYLQEIFSEEMGKVDDSFEHRLED-SELV--TEDKR---G ERHPIEGNLE-EEVKYHENEPTIYHLRQYLA 143
WP_019312892   74  RRRNRILYLQEIFAEEMSKVDDSFEHRLED-SELV--TEDKR---G ERHPIEGNLE-EEVKYHENEPTIYHLRQYLA 143
WP_019313659   74  RRRNRILYLQEIFSEEMGKVDDSFEHRLED-SELV--TEDKR---G ERHPIEGNLE-EEVKYHENEPTIYHLRQYLA 143
WP_019314093   74  RRRNRILYLQEIFAEEMSKVDDSFEHRLED-SELV--TEDKR---G ERHPIEGNLE-EEVKYHENEPTIYHLRQYLA 143
WP_019315370   74  RRRNRILYLQEIFSEEMGKVDDSFEHRLED-SELV--TEDKR---G ECHPIEGNLE-EEVKYHENEPTIYHLRQYLA 143
WP_019803776   74  RRRNRILYLQEIFSEEMGKVDDSFEHRLED-SELV--TEDKR---G ERHPIEGNLE-EEVKYHENEPTIYHLRQYLA 143
WP_019805234   74  RRRNRILYLQEIFSEEMGKVDDSFEHRLED-SELV--TEDKR---G ERHPIEGNLE-EEVKYHENEPTIYHLRQYLA 143
WP_024783594   74  RRRNRILYLQEIFAEEMSKVDDSFEHRLED-SFLT--DDDKR---F DSHPIEGNKA-EEDAYHQKEPTIYHLRKHLA 143
WP_024784288   74  RRRNRILYLQEIFAEEMSKVDDSFEHRLDE-SFLT--DDDKN---F DSHPIEGNKA-EEDAYHOKEPTIYHLRKHLA 143
WP_024784666   74  RRRNRILYLQEIFAEEMSKVDDSFEHRLED-SELV--TEDKR---G ERHPIEGNLE-EEVKYHENEPTIYHLRQYLA 143
WP_024784894   74  RRRNRILYLQEIFSEEMGKVDDSFEHRLED-SFLT--DDDKN---F DSHPIEGNKA-BEDAYHQKEPTIYHLRKHLA 143
WP_024788433   74  RRRNRILYLQEIFAEEMSKVDDSFEHRLDE-SFLT--DDDKN---F DSHPIEGNKA-EEDAYHQKEPTIYHLRQYLA 143
WP_049523028   74  RRRNRILYLQEIFAAEMNKVDESFEHRLED-SFLV--TEDKR---G ERHPIEGNLE-EEVKYHENEPTIYHLRQYLA 143
WP_003107102   43  RRINRIKYLQSIFDDEMSKIDSAPFQRIKD-SFLV--PDDKN---D DRHPIFGNIK-DEVDYHKNYPTIYHLRKKLA 112
WP_054279288   76  RRKNRLCYLRDIFESEMHTIDKHFFLRLED-SFLH--KSDKR---Y EAHPIEGTLQ-EEKAYHDNYPTIYHLRKALA 145
WP_049531101   75  RRKNRLRYLQEIFSOEISKVDNSFFHRLED-SFLI--PEDKR---G SKYPIFATLI-EEKEYHKQFPTIYHLRKQLA 144
WP_049538452   75  RRKNRLRYLQEIFAEEMNKVDDSSFFHRLED-SFLV--PEDKR---G SKYPIFATLA-EEKEYHKNFPTIYHLRKQLA 144
WP_049549711   76  RRRYRLCQLQNIFATEMVKVDDIFFQRLSE-SFFY--YQDKA---F DKHPIFGNSK-EERAYHKTYPTIYHLRKDLA 145
WP_007896501   28  RRRYRLCQLQNIFATEMVKVDDIFFQRLSE-SFFY--YQDKA---F DKHPIFGNSK-EERAYHKTYPTIYHLRKDLA 97
EFR44625       74  RRRNRLRYLQEIFTSMNEIEDESFHRLED-SFLI--PEDKR---G SKYPIFATLQ-EEKEYHKQFPTIYHLRKQLA 143
WP_002897477   74  RRRNRLRYLQEIFSEEISKLLDSSFFHRLED-SFLI--PEDKR---G SKYPIFATLE-EEKEYHKKFPTIYHLRKHLA 143
WP_002906454   75  RRKNRLRYLQEIFSEEIGKVDSSFFHRLED-SFLI--PEDKR---G SKYPIFATLA-EEKKYHKQFPTIYHLRKHLA 144
WP_009729476   74  RRRNRLRYLQEIFSPELNQVDESFHRLED-SFLV a--EDKR---G ERHVIFGNIA-DEVKYHKEFPTIYHLRKHLA 143
CQR24647       75  RRKNRLRYLQEIFSOEISKVDSSFFHRLED-SFLV--PEDKR---G SKYPIFATLV-EEKEYYKQFPTIYHLRKQLA 144
WP_000066813   75  RRRNRLRYLQEIFAEEINKIDDSFFHRLED-SFFLV--PEDKR---G SKYPIFATLV-EEKEYHKKEPTIYHLRKHLA 144
WP_009754323   75  RRRNRLRYLQEIFAEEINKIDDSFFHRLED-SFFL1v--PEDKS---G SKYPIFATLQ-EEKEYHKKFPTIYHLRKHLA 144
WP_044674937   74  RRRNRILYLQEIFAEEINKIDDSFQRLDD-SFL1v--EDKQ---G SKHPIFGTLQ-EEKEYHKQFPTIYHLRKHLA 143
WP_044676715   74  RRRNRILYLQEIFAEEINKIDDSFQRLDD-SFL1v--EDKQ---G SKHPIFGTLQ-EEKEYHKQFPTIYHLRKHLA 143
WP_044680361   74  RRRNRILYLQEIFAEEINKIDDSFQRLDD-SFL1v--EDKQ---G SKHPIFGTLQ-EEKEYHKQFPTIYHLRKHLA 143
WP_044681799   74  RRRNRILYLQEIFAEEMNKVDENFQRLDD-SFLV--DEDKR---G SKHPIFGTLQ-EEKEYHKQFPTIYHLRKHLA 143
WP_049533112   74  HRKFPLRLLEDMFEKEILSKDPSFFIRLKE-AFLSpkDBQKQ---F --LFNDKDyTDADYFBQYKTYHLRYDLI 143
WP_029090905   28  KRRERIRLLRAILQDMVLEKDPTFFIRLEHtSFLD--EEDKAkyIG DNYNLFIDEDfNDYTYHKYPTIYHLRKALC 100
WP_006506696   61  RRKNRICYLQSNEMAKVDDSFFHRLEE-SFLV--EEDKK---H ERHPIFGNIV-DEVAYHEKYPTIYHLRKKLA 139
AIT42264       74  RRRPRIRELQKIFDKSMGEVDSNFFHRLDE-SFLV--EEDKE---Y SKYPIFSNEK-EDKNYDKYPTIYHLRKDLA 143
WP_034440723   73  RRRNRICYLQEIFSNEMAKVDDSFFHRLEE-SFLV--EEDKK---H ERHPIFGNIV-DEVAYHEKYPTIYHLRKKLV 142
AKQ21048       74  RRRNRLIYLQDIFQQPMLAIDENFFHRLDD-SFFV--PDDKS---Y DRHPIFGSLE-EEVAYHNTYPTIYHLRKHLA 143
WP_004636532   74  RRRNRLIYLQDIFQQPMLAIDENFFHRLDD-SFFV--PDDKS---Y DRHPIFGSLE-EEVAYHNTYPTIYHLRKHLA 143
```

```
WP_002364836   74  RRRNRLRYLQAFFEEAMIDLDENFFARLQE-SFLV--PEDKK---W HRHPIFAKLE-DEVAYHETYPTIYHLRKKLA  143
WP_016631044   25  RRRNRLRYLQAFFEEAMIDLDENFFARLQE-SFLV--PEDKK---W HRHPIFAKLE-DEVAYHETYPTIYHLRKKLA   94
EMS75795           -------------------------------------------- ------------------------------
WP_002373311   74  RRRNRLRYLQAFFEEAMTALDENFFARLQE-SFLV--PEDKK---W HRHPIFAKLE-DEVAYHETYPTIYHLRKKLA  143
WP_002378009   74  RRRNRLRYLQAFFEEAMTALDENFFARLQE-SFLV--PEDKK---W HRHPIFAKLE-DEVAYHETYPTIYHLRKKLA  143
WP_002407324   74  RRRNRLRYLQAFFEEAMTALDENFFARLQE-SFLV--PEDKK---W HRHPIFAKLE-DEVAYHETYPTIYHLRKKLA  143
WP_002413717   74  RRRNRLRYLQAFFEEAMIDLDENFFARLQE-SFLV--PEDKK---W HRHPIFAKLE-DEVAYHETYPTIYHLRKKLA  143
WP_010775580   74  RRRNRLRYLQAFFEEAMIDLDENFFARLQE-SFLV--PEDKK---W HRHPIFAKLE-DEVAYHETYPTIYHLRKKLA  143
WP_010818269   74  RRRNRLRYLQAFFEEAMIDLDENFFARLQE-SFLV--PEDKK---W HRHPIFAKLE-DEVAYHETYPTIYHLRKKLA  143
WP_010824395   74  RRRNRLRYLQAFFEEAMTALDENFFARLQE-SFLV--PEDKK---W HRHPIFAKLE-DEVAYHETYPTIYHLRKKLA  143
WP_016622645   74  RRRNRLRYLQAFFEEAMTALDENFFARLQE-SFLV--PEDKK---W HRHPIFAKLE-DEVAYHETYPTIYHLRKKLA  143
WP_033624816   74  RRRNRLRYLQAFFEEAMTALDENFFARLQE-SFLV--PEDKK---W HRHPIFAKLE-DEVAYHETYPTIYHLRKKLA  143
WP_033625576   74  RRRNRLRYLQAFFEEAMTALDENFFARLQE-SFLV--PEDKK---W HRHPIFAKLE-DEVAYHETYPTIYHLRKKLA  143
WP_033789179   74  RRRNRLRYLQAFFEEAMTALDENFFARLQE-SFLV--PEDKK---W HRHPIFAKLE-DEVAYHETYPTIYHLRKKLA  143
WP_002310644   74  RRRQRILELQKIFAPEILKIDEHFFARLNE-SFLV--LDEKK---Q SRHPVFATIK-QEKSYHQTYPTIYHLRQALA  143
WP_002112694   74  RRRQRILELQKIFAPEILKIDEHFFARLNE-SFLV--PDEKK---Q SRHPVFATIK-QEKSYHQTYPTIYHLRQALA  143
WP_002114015   74  RRRQRILELQKIFAPEILKIDEHFFARLNE-SFLV--LDEKK---Q SRHPVFATIK-QEKSYHQTYPTIYHLRQALA  143
WP_002320716   74  RRRQRILELQKIFAPEILKIDEHFFARLNE-SFLV--LDEKK---Q SRHPVFATIK-QEKSYHQTYPTIYHLRQALA  143
WP_002330729   74  RRRQRILELQKIFAPEILKIDEHFFARLNE-SFLV--LDEKK---Q SRHPVFATIK-QEKSYHQTYPTIYHLRQALA  143
WP_002335161   74  RRRQRILELQKIFAPEILKIDEHFFARLNE-SFLV--LDEKK---Q SRHPVFATIK-QEKSYHQTYPTIYHLRQALA  143
WP_002345439   74  RRKYRLSKLQDLFAEELCKQDDCFFVRLEE-SFLV--PEEKQ---Y KPASIPPTLE-EEKEYYQKYPTIYHLRQKLV  143
WP_034867970   74  RRKYRLSKLQDLFAEELCKQDDCFFVRLEE-SFLV--PEEKQ---Y KPASIPPTLE-EEKEYYQKYPTIYHLRQKLV  143
WP_047937432   74  RRKYRLSKLQDLFAEELCKQDDCFFVRLEE-SFLV--PEEKQ---Y KPASIFPTLE-BEKEYYQKYPTIYHLRQKLV  143
WP_010720994   74  RRKYRLSKLQDLFAEELCKQDDCFFVRLEE-SFLV--PEEKQ---Y KPASIFPTLE-EEKEYYQKYPTIYHLRQKLV  143
WP_010737004   74  RRKYRLSKLQDLFAEELCKQDDCFFVRLEE-SFLV--PEEKQ---Y KPASIFPTLE-EEKEYYQKYPTIYHLRQKLV  143
WP_034700478   74  RRKYRLSKLQDLFAEELCKQDDCFFVRLEE-SFLV--PEEKQ---Y KPASIFPTLE-EEKEYYQKYPTIYHLRQKLV  143
WP_007209003   74  RRRNRICYLQEIFQPEMNHLDNNFFYRLNE-SFLVa--DDAK---Y DKHPFGILD-EEIHFBEQFPPTIYHLRKYLA  143
WP_010991369   74  RRRQRVLALQDIFAEEIHKDPNFFARLEE-GDRV--EADKR---F AKFFVFAILS-EEKNYHRQYPTIYHLRHDLA  143
WP_010770040   74  RRRORISYLQFFQEEMNRIDPNFFNRLDE-SFLI--EEDKL---S ERHPIFGTIE-EEVAYHKNYATIYHLRKELA  143
WP_048604708   74  RRKYRILELQFFSEEILKKDSHFFARLDE-SFLV--PEDKQ---H ERHPIFGNIV-EEKAYYQNYPTIYHLRQKLA  143
WP_010750235   74  RRKYRILELQFFSEEILKKDSHFFARLDE-SFLV--EEDKK---H ERHPIFGNIV-EEKAYYQNYPTIYHLRQKLA  182
AII6583       113  KRRERIRLLRGIMEDMVLDVDPIFFIRLANvSFLD--QEDKKdy1K ARPPIFGNIV-EEKAYYQNYPTIYHLRKKLV  144
WP_029073316   66  KRRERIRLLREIMEDMVLDVDPIFFIRLANvSFLD--QEDKKdy1K SNYNLFIDKDFNDKTYDKYPTIYHLRKHLC  144
WP_031589969   66  RRKWRLGLLREIFEPYITPVDDIFFLRKKQ-SNLS--PKDQR---K SNYNLFIDKDFNDKTYDKYPTIYHLRKHLC  144
KDA45870       75  RRKNRINWLNEIFSELANTDPSFIIRLQN-SWVSkkDDPRK---R DVYIFGKRE-BELLYHDTHKTIYHLRSELA  144
WP_039099354   62  RRKWRLGLLREIFEPYITPVDDIFFLRKKQ-SNLS--PKDQR---K -QTSLENDRT--DRAFYDDYPTIYHLRYKLM  132
AKP02966       65  RRKNRINWLNEIFSELANTDPSFIIRLQN-SWVSkkDDPRK---R DKYNLFIDNPy-TDKEYYREFPTIFHLREI  137
WP_010991369   74  RRRNRISYLQGIFAEEMSKTDANFFCRLSD-SFYV--DNEKR---N SRHPFFATIE-EEVEYHKNYPTIYHLREELV  143
WP_033838504   74  RRRNRISYLQGIFAEEMSKTDANFFCRLSD-SFYV--DNEKR---N SRHPFFATIE-EEVEYHKNYPTIYHLREELV  143
EHN60060       77  RRRNRISYLQGIFAEEMSKTDANFFCRLSD-SFYV--DNEKR---N SRHPFFATIE-EEVEYHKNYPTIYHLREELV  146
EFR89594           ------------------------------------------- -------------------------------
WP_038409211   74  RRRNRISYLQGIFAAEMAEVDANFFYRLED-SFYI--ESEKR---H SRHPFFATIE-EEVAYHEEYKTIYHLREKLV  143
EFR95520           ------------------------------------------- -------------------------------
WP_003723650   74  RRRNRISYLQEIFAVEMANIDANFFCRLND-SFYV--DSEKR---N SRHPFFATIE-EEVAYHDNYRTIYHLREELV  143
WP_003727705   74  RRRNRISYLQEIFAVEMANIDANFFCRLND-SFYV--DSEKR---N SRHPFFATIE-EEVAYHNYRTIYHLREELV   143
WP_003730785   74  RRRNRISYLQEIFAVEMANIDANFFCRLND-SFYV--DSEKR---N SRHPFFATIE-EEVAYHNYRTIYHLREELV   143
WP_003733029   74  RRRNRISYLQEIFAIQMNEVDDNFFNRLKE-SFYA--ESDKK---Y NRHPFFGTVE-EEVAYKDFPTIYHLRKELI  143
WP_003739838   74  RRRNRISYLQEIFALEMANIDANFFCRLND-SFYV--DSEKR---N SRHPFFATIE-EEVAYHKNYRTIYHLREELV  143
WP_014601172   74  RRRNRISYLQEIFAVEMANIDANFFCRLND-SFYV--DSEKR---N SRHPFFATIE-EEVAYHKNYRTIYHLREELV  143
WP_023548323   74  RRRNRISYLQEIFAVEMANIDANFFCRLND-SFYV--DSEKR---N SRHPFFATIE-EEVAYHKNYRTIYHLREELV  143
WP_031665337   74  RRRNRISYLQEIFAVEMANIDANFFCRLND-SFYA--ESDKK---Y NRHPFEGTVE-EEVAYYKDEPTIYHLRKEII  143
WP_031669209   74  RRRNRISYLQEIFAIQMNEVDDNFFNRLKE-SFYV--DSEKR---N NRHPFEGTVE-EEVAYHKNYRTIYHLREELV  143
WP_033920898   74  RRRNRISYLQEIFAVEMANIDANFFCRLND-SFYV--DSEKR---N SRHPFFATIE-EEVAYHKNYRTIYHLREELV  143
```

-continued

```
AKI42028          77  RRRNRISYLQEIFAVEMANIDANFFCRLND-SFYV--DSEKR---N SRHPFEATIE-EEVAYHKNYRTIYHLREELV                146
AKI50529          77  RRRNRISYLQEIFAVEMANIDANFFCRLND-SFYV--DSEKR---N SRHPFEATIE-EEVAYHKNYRTIYHLREELV                146
EFR83390              ----------------------------------------------- ------------------------------                
WP_046323366      74  RRRNRISYLQEIFTAEMFEVDANFYRLED-SFYI--ESEKR---Q SRHPFEATIE-EEVAYHENYRTIYHLREKLV                143
AKE81011          90  RRKNRICYLQEIFSNEMAKVDDSFPHRLEE-SFLV--EEDKK---H ERHPIFGNIV-DEVAYHEKYPTIYHLRKKLV                159
CUO82355          65  RRRERIRLLRDLLGDMVLEKDPTPFIRLEHtSFLD--EEDKAkyIG DNYNLFIDEDfNDYTYYHKYPTIYHLRKALC                143
WP_033162887      66  KRRERIRLLLRDLLGDMVEVDPIPFIRLLNvSFLD--EEDKQknIG DNYNLFIEKDfNDKTYDKYPTIYHLREELC                144
AGZ01981         107  RRKNRICYLQEIFSNEMAKVDDSFPHRLEE-SFLV--EEDKK---H ERHPIFGNIV-DEVAYHEKYPTIYHLRKKLV                176
AKA60242          74  RRKNRICYLQEIFSNEMAKVDDSFPHRLEE-SFLV--EEDKK---H ERHPIFGNIV-DEVAYHEKYPTIYHLRKKLV                143
AKS40380          74  RRKNRICYLQEIFSNEMAKVDDSFPHRLEE-SFLV--EEDKK---H ERHPIFGNIV-DEVAYHEKYPTIYHLRKKLV                143
4UN5_B            78  RRKNRICYLQEIFSNEMAKVDDSFPHRLEE-SFLV--EEDKK---H ERHPIFGNIV-DEVAYHEKYPTIYHLRKKLV                147
WP_010922251     144  DSTDKADLRLIYLALAHMIKFRGHFLIEGD-LNPDNSDVDKL--FIQLVQTYNQL--FEEN-- INASGVDAK---AI                211

WP_039695303     145  DSSEKADLRLIVYLALAHMIKFRGHFLIEGE-LNAENTDVQKI--FADFVGVYNRT--FDDS-H LSEITVDVA---SI               212
WP_045635197     144  DSKEKTDLRLIYLALAHMIKYRGHFLYEEA-FDIKNNDIQKI--FNEFISIYDNT--FEGS-S LSGQNAQVE---AI                211
5AXW_A           105  EEEFSA-----ALLHLAKRRG----VHNV--------NEVE-------EDT---GN--                                    134

WP_009880683          ----------------------------------------------- ------------------------------                
WP_010922251     144  DSTDKADLRLIYLALAHMIKFRGHFLIEGD-LNPDNSDVDKL--FIQLVQTYNQL--FEEN-- INASGVDAK---AI                211
WP_011054416     144  DSTDKVDLRLIYLALAHMIKFRGHFLIEGD-LNPDNSDVDKL--FIQLVQTYNQL--FEEN-- INASRVDAK---AI                211
WP_011284745     144  DSTDKADLRLIYLALAHMIKFRGHFLIEGD-LNPDNSDVDKL--FIQLVQTYNQL--FEEN-- INASGVDAK---AI                211
WP_011285506     144  DSTDKADLRLIYLALAHMIKFRGHFLIEGD-LNPDNSDVDKL--FIQLVQTYNQL--FEEN-- INASGVDAK---AI                211
WP_011277619     144  DSTDKADLRLIYLALAHMIKFRGHFLIEGD-LNPDNSDVDKL--FIQLVQTYNQL--FEEN-- INASGVDAK---AI                211
WP_012560673     144  DSTDKADLRLIYLALAHMIKFRGHFLIEGD-LNPDNSDVDKL--FIQLVQTYNQL--FEEN-- INASRVDAK---AI                211
WP_014407541     144  DSTDKADLRLIYLALAHMIKFRGHFLIEGD-LNPDNSDVDKL--FIQLVQTYNQL--FEEN-- INASRVDAK---AI                211
WP_020905136     144  DSTDKADLRLIYLALAHMIKFRGHFLIEGD-LNPDNSDVDKL--FIQLVQTYNQL--FEEN-- INASRVDAK---AI                211
WP_023080005     144  DSTDKADLRLIYLALAHMIKFRGHFLIEGD-LNPDNSDVDKL--FIQLVQTYNQL--FEEN-- INASRVDAK---AI                211
WP_023610282     144  DSTDKADLRLIYLALAHMIKFRGHFLIEGD-LNPDNSDVDKL--FIQLVQTYNQL--FEEN-- INASRVDAK---AI                211
WP_030125963     144  DSTDKADLRLIYLALAHMIKFRGHFLIEGD-LNPDNSDVDKL--FIQLVQTYNQL--FEEN-- INASRVDAK---AI                211
WP_030126706     144  DSTDKADLRLIYLALAHMIKFRGHFLIEGD-LNPDNSDVDKL--FIQLVQTYNQL--FEEN-- INASRVDAK---AI                211
WP_031488318     144  DSTDKADLRLIYLALAHMIKFRGHFLIEGD-LNPDNSDVDKL--FIQLVQTYNQL--FEEN-- INASRVDAK---AI                211
WP_032460140     144  DSTDKADLRLIYLALAHMIKFRGHFLIEGD-LNPDNSDVDKL--FIQLVQTYNQL--FEEN-- INASRVDAK---AI                211
WP_032461047     144  DSTDKADLRLIYLALAHMIKFRGHFLIEGD-LNPDNSDVDKL--FIQLVQTYNQL--FEEN-- INASRVDAK---AI                211
WP_032462016     144  DSTDKADLRLIYLALAHMIKFRGHFLIEGD-LNPDNSDVDKL--FIQLVQTYNQL--FEEN-- INANGVDAK---AI                211
WP_032462936     144  DSTDKADLRLIYLALAHMIKFRGHFLIEGD-LNPDNSDVDKL--FIQLVQTYNQL--FEEN-- INASRVDAK---AI                211
WP_032464890     144  DSTDKADLRLIYLALAHMIKFRGHFLIEGD-LNPDNSDVDKL--FIQLVQTYNQL--FEEN-- INASRVDAK---AI                211
WP_033888930       1  -----------------------------------PDNSDVDKL--FIQLVQTYNQL--FEEN-- INASGVDAK---AI              36
WP_038431314     144  DSTDKADLRLIYLALAHMIKFRGHFLIEGD-LNPDNSDVDKL--FIQLVQTYNQL--FEEN-- INASGVDAK---AI                211
WP_038432938     144  DSTDKADLRLIYLALAHMIKFRGHFLIEGD-LNPDNSDVDKL--FIQLVQTYNQL--FEEN-- INASRVDAK---AI                211
WP_038434062     144  DSTDKADLRLIYLALAHMIKFRGHFLIEGD-LNPDNSDVDKL--FIQLVQTYNQL--FEEN-- INASGVDAK---AI                211
BAQ51233          55  DSTDKADLRLIYLALAHMIKFRGHFLIEGD-LNPDNSDVDKL--FIQLVQTYNQL--FEEN-- INASGVDAK---AI                122

KGE60162              ----------------------------------------------- ------------------------------                
KGE60856              ----------------------------------------------- ------------------------------                
WP_002989955     144  DSTDKADLRLIYLALAHIIKFRGHFLIEGD-LNPDNSDVDKL--FIQLVQTYNQL--FEEN-- INASGVDAK---AI                211
WP_003030002     144  DISQKADLRLIYLALAHIIKFRGHFLIEGQ-LKAENTNVQAL--FKDFVEVYDKT--VEES-H LSEMTVDAL---SI                211
WP_003065552     147  DSSEKADLRLIVYLALAHIIKFRGHFLIEGG-LNPDNSDVDKL--FADFVGVYDRT--FDDS-H LSEITVDAA---SI               214
WP_001040076     144  DKKEKADLRLIYIALAHIIKFRGHFLIEDD-rFDVRNIDIQKQ--YQAFLEIFDTT--FENN-D LLSQDVDVE---AI               212
WP_001040078     144  DKQEKADLRLIYIALAHIIKFRGHFLIEDD-rFDVRNIDIQKQ--YQAFLEIFDTT--FENN-H LLSQNVDVE---AI               212
WP_001040080     144  DKKEKADLRLIYIALAHIIKFRGHFLIEDDsFDVRNIDISKQ---YQDFLEIFNIT--FENN-D LLSQNVDVE---AI               212
WP_001040081     144  DKKEKADLRLIYIALAHIIKFRGHFLIEDDsFDVRNIDISKQ---YQDFLEIFNIT--FENN-D LLSQNVDVE---AI               212
WP_001040083     144  DKKEKADLRLIYIALAHIIKFRGHFLIEDDsFDVRNIDISKQ---YQDFLEIFNIT--FENN-D LLSQNVDVE---AI               212
WP_001040085     144  DKKEKADLRLIYIALAHIIKFRGHFLIEDDsFDVRNIDISKQ---YQDFLEIFNIT--FENN-D LLSQNVDVE---AI               212
WP_001040087     144  DKKEKADLRLIYIALAHIIKFRGHFLIEDDsFDVRNIDISKQ---YQDFLEIFNIT--FENN-D LLSQNVDVE---AI               212
WP_001040088     144  DKKEKADLRLIYIALAHIIKFRGHFLIEDDsFDVRNIDISKQ---YQDFLEIFNIT--FENN-D LLSQNVDVE---AI               212
```

```
-continued

WP_001040089  144  DKKEKADLRLIYIALAHIIKFRGHFLIEDDsFDVRNIDISKQ--YQDFLEIFNIT--FENN-D  LLSQNVDVE---AI  212
WP_001040090  144  DKKEKADLRLIYIALAHIIKFRGHFLIEDDsFDVRNIDISKQ--YQDFLEIFNIT--FENN-D  LLSQNVDVE---AI  212
WP_001040091  144  DKKEKADLRLIYIALAHIIKFRGHFLIEDDsFDVRNIDISKQ--YQDFLEIFNIT--FENN-D  LLSQNVDVE---AI  212
WP_001040092  144  DKKEKADLRLIVYLALAHIIKFRGHFLIEDDsFDVRNIDISKQ--YQDFLEIFDTS--FENN-D  LLSQNVDVE---AI  212
WP_001040094  144  DKKEKADLRLIYIALAHIIKFRGHFLIEDDrFDVRNIDIQKQ--YQAFLEIFDTT--FENN-D  LLSQNVDVE---AI  212
WP_001040095  144  DKKEKADLRLIYIALAHIIKFRGHFLIEDDrFDVRNIDIQKQ--YQAFLEIFDTT--FENN-D  LLSQNVDVE---AI  212
WP_001040096  144  DKKEKADLRLIYIALAHIIKFRGHFLIEDDrFDVRNIDIQKQ--YQAFLEIFDTT--FENN-D  LLSQNVDVE---AI  212
WP_001040097  144  DKKEKADLRLIYIALAHIIKFRGHFLIEDDrFDVRNIDIQKQ--YQAFLEIFDTT--FENN-D  LLSQNVDVE---AI  212
WP_001040098  144  DKKEKADLRLIYIALAHIIKFRGHFLIEDDrFDVRNIDIQKQ--YQAFLEIFDTT--FENN-D  LLSQNVDVE---AI  212
WP_001040099  144  DKKEKADLRLIYIALAHIIKFRGHFLIEDDrFDVRNIDIQKQ--YQAFLEIFDTT--FENN-D  LLSQNVDVE---AI  212
WP_001040100  144  DKKEKADLRLIYIALAHIIKFRGHFLIEDDrFDVRNIDIQKQ--YQAFLEIFDTT--FENN-D  LLSQNVDVE---AI  212
WP_001040104  144  DKKEKADLRLIVYLALAHIIKFRGHFLIEDDsFDVRNIDISKQ--YQDFLEIFNIT--FENN-D  LLSQNVDVE---GI  212
WP_001040105  144  DKKEKADLRLIVYLALAHIIKFRGHFLIEDDsFDVRNIDIQRQ--YQAFLEIFDTT--FENN-H  LLSQNVDVE---GI  212
WP_001040106  144  DKKEKANLRLIVYLALAHIIKFRGHFLIEDDsFDVRNIDIQRQ--YQAFLEIFDTT--FENN-H  LLSQNIDVE---GI  212
WP_001040107  144  DKKEKADLRLIVYLALAHIIKFRGHFLIEDDrFDVRNIDIQRQ--YQAFLEIFDTT--FENN-D  LLSQNVDVE---GI  212
WP_001040108  144  DKKEKADLRLIVYLALAHIIKFRGHFLIEDDrFDVRNIDIQRQ--YQAFLEIFDTT--FENN-D  LLSQNVDVE---GI  212
WP_001040109  144  DKKEKANLRLIVYLALAHIIKFRGHFLIEDDrFDVRNIDIQRQ--YQAFLEIFDTT--FENN-H  LLSQNVDVE---GI  212
WP_001040110  144  DKKEKADLRLIYIALAHIIKFRGHFLIEDDsFDVRNIDIQKQ--YQAFLEIFDTS--FENN-H  LLSQNVDVE---GI  212
WP_015058523  144  DKKEKADLRLIYIALAHIIKFRGHFLIEDDsFDVRNIDIQRQ--YQAFLEIFDTT--FENN-D  LLSQNVDVE---GI  212
WP_017643650  144  DKKEKADLRLIYIALAHIIKFRGHFLIEDDsFDVRNIDIQRQ--YQAFLEIFDTT--FENN-D  LLSQNVDVE---AI  212
WP_017647151  144  DKKEKADLRLIFYLALAHIIKFRGHFLIEDDsFDVRNIDIQRQ--YQDFLEIFDTT--FENN-D  LLSQNIDIE---GI  212
WP_017648376  144  DKKEKADLRLIYIALAHIIKFRGHFLIEDDsFDVRNIDIQRQ--YQDFLEIFDTT--FENN-D  LLSQNIDVE---GI  212
WP_017649527  144  DKKEKADLRLIYIALAHIIKFRGHFLIEDDsFDVRNIDISKQ--YQAFLEIFDTT--FENN-D  LLSQNVDVE---AI  212
WP_017771611  144  DKKEKADLRLIYIALAHIIKFRGHFLIEDDsFDVRNIDISKQ--YQDFLEIFNIT--FENN-D  LLSQNVDVE---GI  212
WP_017771984  144  DKKEKADLRLIYIALAHIIKFRGHFLIEDDsFDVRNIDIQKQ--YQDFLEIFNIT--FENN-D  LLSQNVDVE---AI  212
CFQ25032      144  DKKEKADLRLIYIALAHIIKFRGHFLIEDDsFDVRNIDISKQ--YQDFLEIFNIT--FENN-D  LLSQNVDVE---AI  212
CFV16040      144  DKKEKADLRLIYIALAHIIKFRGHFLIEDDsFDVRNIDIQKQ--YQAFLEIFDTT--FENN-D  LLSQNVDVE---GI  212
KLJ37842      144  DKKEKADLRLIYIALAHIIKFRGHFLIEDDsFDVRNIDISKQ--YQDFLEIFNIT--FENN-D  LLSQNVDVE---GI  212
KLJ72361      144  DKKEKADLRLIYIALAHIIKFRGHFLIEDDsFDVRNIDIQRQ--YQAFLEIFDTT--FENN-D  LLSQNVDVE---GI  212
KLL20707      144  DKKEKADLRLIYIALAHIIKFRGHFLIEDDsFDVRNIDISKQ--YQDFLEIFNIT--FENN-D  LLSQNVDVE---AI  212
KLL42645      144  DKKEKANLRLIVYLALAHIIKFRGHFLIEDDsFDVRNIDIQRQ--YQAFLEIFDTT--FENN-H  LLSQNVDVE---GI  212
WP_047207273  144  DKKEKADLRLIYIALAHIIKFRGHFLIEDDsFDVRNIDIQRQ--YQAFLEIFDTT--FENN-D  LLSQNVDVE---GI  212
WP_047209694  144  DKKEKADLRLIVYLALAHIIKFRGHFLIEDDsFDVRNIDIQKQ--YQDFLEIFNIT--FENN-D  LLSQNVDVE---GI  212
WP_050198062  144  DKKEKADLRLIYIALAHIIKFRGHFLIEDDsFDVRNIDIQKQ--YQAFLEIFDTT--FENN-D  LLSQNVDVE---AI  212
WP_050201642  144  DKKEKADLRLIYIALAHIIKFRGHFLIEDDsFDVRNIDISKQ--YQDFLEIFNIT--FENN-D  LLSQNVDVE---AI  212
WP_050204027  144  DKKEKANLRLIVYLALAHIIKFRGHFLIEDDsFDVRNIDIQRQ--YQAFLEIFDTT--FENN-H  LLSQNVDVE---GI  212
WP_050881965  144  DKKEKADLRLIYIALAHIIKFRGHFLIEDDsFDVRNIDISKQ--YQDFLEIFNIT--FENN-D  LLSQNVDVE---AI  212
WP_050886065  144  DKKEKADLRLIYIALAHIIKFRGHFLIEDDsFDVRNTDISKQ--YQAFLEIEDTS--FENN-H  LLSQNVDVE---GI  212
AHN30376      144  DKKEKADLRLIYIALAHIIKFRGHFLIEDDrEDVRNTDISKQ--YQAFLEIENTT--FENN-D  LLSQNVDVE---AI  212
EAO78426      144  DKKEKADLRLIVYLALAHIIKFRGHFLIEGQ-LKAENTNVQAL--FKDFVEVYDKT--VEES-H  LSEITVDAL---SI  211
CCW42055      145  DISQKADLRLIVYLALAHMIKFRGHFLIEGD-LKAENTDVQAL--FKDFVEEYDKT--IEES-H  LSEITVDAL---SI  212
WP_003041502  144  DISQKADLRLIVYLALAHMIKFRGHFLIEGD-LKAENTDVQAL--FKDFVEVYDKT--VEES-H  LSEMTVDAL---SI  211
WP_037593752  144  NSKEKADLRLIVYLALAHMIKFRGHFLIEGQ-LKAENTNVQAL--FKDFVEEYDKT--IEES-H  LSEITVDAL---SI  211
WP_049516684  145  DISQKADLRLIVYLALAHMIKFRGHFLIEGD-LKAENTDVQTL--FKDFVEEYDKT--IEES-H  LSEITVDAL---SI  212
GAD46167      145  NSKEKADLRLIVYLALAHMIKFRGHFLIEGD-LKAENTDVQAL--FTDEVGVYDRT--FDDS-H  LSEITVDAA---SI  212
WP_018363470  144  DSTEKADLRLIYLALAHMIKFRGHFLIEGE-LNAENTDVQKL--FYQLIQTYNQL--FEES-H  LDEIEVDAK---GI  211
WP_003043819  144  DSPEKADLRLIYLALAHMIKFRGHFLIEGK-LNAENSDVAKL--FYQLIQTYNQL--FEES-H  LDEIEVDAK---GI  211
WP_066269658  144  DTSKKADLRLIYLALAHMIKFRGHFLIEGD-LKAENTDVQAL--FKDFVEEYDKT--IEES-H  LDEIEVDAK---SI  211
WP_048800889  144  DSTGKVDLRLIVYLALAHMIKFRGHFLIEGD-LKAENTDVQTL--ENDEVEVYDKT--IEES-H  LAEITVDAL---SI  211
WP_012767106  144  DSTDKADLRLIYLALAHMIKFRGHFLIEGD-LNPDNSDMDKL--FIQLVQTYNQL--FEEN--  INASRVDAK---AI  211
WP_014612333  144  DSTDKADLRLIYLALAHMIKFRGHFLIEGD-LNPDNSDMDKL--FIQLVQTYNQL--FEEK--  INASGVDAK---AI  211
WP_015017095  144  DSTDKADLRLIYLALAHMIKFRGHFLIEGD-LNPDNSDMDKL--FIQLVQTYNQL--FEEN--  INASRVDAK---AI  211
WP_015057649  144  DSTDKADLRLIYLALAHMIKFRGHFLIEGD-LNPDNSDMDKL--FIQLVQTYNQL--FEEN--  INASRVDAK---AI  211
```

```
WP_048327215  144  DSTDKADLRLIYLALAHMIKFRGHFLIEGD-LNPDNSDMDKL-FIQLVQTYNQL--FEEN--INASRVDAK---AI  211
WP_049519324  144  DSTDKADLRLIYLALAHMIKFRGHFLIEGD-LNPDNSDVDKL-FIQLVQTYNQL--FEEN--INASRVDAK---AI  211
WP_012515931  144  DNPQKADLRLIYLAVAHIIKFRGHFLIEGT-LSSKNNNLQKS-FDHLVDTYNLL--FEEQ--LLTEGINAK---EL  211
WP_021320964  144  DNPQKADLRLIYLAVAHIIKFRGHFLIEGT-LSSKNNNLQKS-FDHLVDTYNLL--FEEQ--LLTEGINAK---EL  211
WP_037581760  144  DNPQKADLRLIYLALAHMIKFRGHFLIEQ--LNAENTDVQKI-FADFVGVYDRT--FDDS-H-LSEITVDAA---SI  211
WP_004232481  144  DSPEKVDLRLIVYLALAHMIKFRGHFLIEQ--LNAENTDVQKI-FADFVGVYDRT--FDDS-H-LSEITVDAA---SI  211
WP_009854540  145  DSSEKADLRLIYLALAHMIKFRGHFLIEGK-LNAENTDVQKL-FTDEVGVYDRT--FDDS-H-LSEITVDVA---ST  212
WP_012962174  145  DSHEKADLRLIVYLALAHMIKFRGHFLIEGE-LNAENTDVQKL-FEAFVEVYDRT--FDDS-N-LSEITVDAS---SI  212
WP_039695303  145  DSSEKADLRLIYLALAHMIKYRGHFLIEGE-LNAENTDVQKI-FADFVGVYNRT--FDDS-H-LSEIEVDAS---SI  212
WP_014334983  144  DSQEKADLRLIYLALAHMIKFRGHFLIEGD-LDSENTDVHVL-ENVEVETYDKI--VDES-H-VETASIDAE---KI  211
WP_003099269  144  DSDQKADLRLIYLALAHMIKFRGHFLIEGN-LDSENTDVHVL-FLNLVNIYNNL--FEED---VETASIDAE---KI  211
AHY15608      144  DSDQKADLRLIYLALAHIIKFRGHFLIEGN-LDSENTDVHVL-FLNLVNIYNNL--FEED---VETASIDAE---KI  211
AHY17476      144  DSDQKADLRLIYLALAHIIKFRGHFLIEGN-LDSENTDVHVL-FLNLVNIYNNL--FEED---VETASIDAE---KI  211
ESR09100      144  ----------------------------------------------------------------------------  ---
AGM98575      144  DSDQKADLRLIVYLALAHIIKFRGHFLIEGN-LDSENTDVHVL-FLNLVNIYNNL--FEED---VETASIDAE---KI  211
ALF27331      144  DNPEKTDLRLIVYLALAHIIKFRGHFLIEGK-FDTRNNDVQRL-FQEFLAVYDNT--FENS-S-LQEQNVQVE---EI  211
WP_018372492  144  DTPDKMDIRLIYLALAHIIKFRGHFLIEGD-LDIENIGIQDS-FKSFIEEYNTQ--FGTK---LDSTTKVE---AI  209
WP_045610828  145  DSKEKADFRLIVYLALAHIIKYRGHFLYEBS-FDIKNNDIQKI-FNEFISIYDNT--EEGS-S-LNGQNAQVE---AI  212
WP_045635197  144  DSKEKTDLRLIYLALAHMIKYRGHFLYEEA-FDIKNNDIQKI-FNEFISIYDNT--FENS-S-LSGQNAQVE---EI  211
WP_002263549  144  DNPEKVDLRLIVYLALAHMIKFRGHFLIEGK-FDTRNNDVQRL-FQEFLAVYDNT--FENS-S-LQEQNVQVE---EI  211
WP_002263887  144  DSTEKADLRLIVYLALAHMIKFRGHFLIEGE-LNAENTDVQKI-FADFVGVYDRT--FDDS-H-LSEITVDAS---SI  211
WP_002264920  144  DSTEKTDLRLIVYLALAHIIKFRGHFLIEGK-FDTRNNDVQRL-FQEFLAVYDNT--FENS-S-LQEQNVQVE---EI  211
WP_002269043  144  DNPEKVDLRLIVYLALAHIIKFRGHFLIEGK-FDTRNNDVQRL-FQEFLAVYDNT--FENS-S-LQEQNVQVE---EI  211
WP_002269448  144  DNPEKVDLRLIVYLALAHIIKFRGHFLIEGK-FDTRNNDVQRL-FQEFLAVYDNT--FENS-S-LQEQNVQVE---EI  211
WP_002271977  144  DNPEKVDLRLIVYLALAHIIKFRGHFLIEGE-FDTRNNDVQRL-FQEFLAVYDNT--FENS-S-LQEQNVQVE---EI  211
WP_002272766  144  DNPEKVDLRLIVYLALAHIIKFRGHFLIEGK-FDTRNNDVQRL-FQEFLAVYDNT--FENS-S-LQEQNVQVE---EI  211
WP_002273241  144  DNPEKVDLRLIVYLALAHIIKFRGHFLIEGK-FDTRNNDVQRL-FQEFLAVYDNT--FENS-S-LQEQNVQVE---EI  211
WP_002275430  144  DNPEKVDLRLIVYLALAHIIKFRGHFLIEGE-FDTRNNDVQRL-FQEFLAVYDNT--FENS-S-LQEQNVQVE---EI  211
WP_002276448  144  DNPEKVDLRLIVYLALAHIIKFRGHFLIEGK-FDTRNNDVQRL-FQEFLAVYDNT--FENS-S-LQEQNVQVE---EI  211
WP_002277050  144  DSTEKADLRLIVYLALAHMIKFRGHFLIEGE-LNAENTDVQKI-FADFVGVYDRT--FDDS-H-LSEITVDAS---SI  211
WP_002277364  144  DNPEKVDLRLIVYLALAHIIKFRGHFLIEGK-FDTRNNDVQRL-FQEFLAVYDNT--FENS-S-LQEQNVQVE---EI  211
WP_002279025  144  DNPEKVDLRLIVYLALAHIIKFRGHFLIEGE-FDTRNNDVQRL-FQEFLAVYDNT--FDDS-H-LQEQNVQVE---EI  211
WP_002279859  144  DSTEKADLRIVYLALAHIIKFRGHFLIEGE-LNAENTDVQKI-FADFVGVYDRT--FDDS-H-LSEITVDAS---SI  211
WP_002280230  144  DNPEKVDLRLIVYLALAHIIKFRGHFLIEGE-FDTRNNDVQRL-FQEFLAVYDNT--FENS-S-LQEQNVQVE---EI  211
WP_002281696  144  DNPEKVDLRLIVYLALAHIIKFRGHFLIEGE-FDTRNNDVQRL-FQEFLAVYDNT--FENS-S-LSEITVDAS---SI  211
WP_002282247  144  DSTEKADLRIVYSLAHMIKFRGHFLIEGE-LNAENTDVQKI-FADFVGVYDRT--FDDS-H-LSEITVDAS---SI  211
WP_002282906  144  DNPEKVDLRLIVYLALAHIIKFRGHFLIEGK-FDTRNNDVQKL-FQEFLAVYDNT--FENS-S-LQEQNVQVE---EI  211
WP_002283846  144  DNPEKVDLRLIVYLALAHIIKFRGHFLIEGE-FDTRNNDVQRL-FQEFLAVYDNT--FDDS-H-LQEQNVQVE---EI  211
WP_002287255  144  DNPEKTDLRLIVYLALAHIIKFRGHFLIEGK-FDTRNNDVQRL-FQEFLAVYDNT--FENS-S-LQEQNVQVE---EI  211
WP_002288990  144  DNPEKTDLRLIVYLALAHIIKFRGHFLIEGK-FDTRNNDVQRL-FQEFLAVYDNT--FENS-S-LQEQNVQVE---EI  211
WP_002289641  144  DNPEKTDLRLIVYLALAHIIKFRGHFLIEGK-FDTRNNDVQRL-FQEFLAVYDNT--FENS-S-LQEQNVQVE---EI  211
WP_002290427  144  DNPEKTDLRLIVYLALAHIIKFRGHFLIEGQ-FDTRNNDVQKL-FQEFLAVYDNT--VEES-H-LSEMTVDAL---SI  211
WP_002295753  144  DNPEKTDLRLIVYSLAHMIKFRGHFLIEGQ-LKAENTNVQAL-FKDFVEVYDKT--VEES-H-LSEMTVDAL---SI  211
WP_002296423  144  DNPEKTDLRLIVYLALAHIIKFRGHFLIEGK-FDTRNNDVQRL-FQEFLAVYDNT--FENS-S-LQEQNVQVE---EI  211
WP_003044487  144  NSTEKADLRLIVYSLAHMIKFRGHFLIEGQ-LKAENTNVQAL-FKDFVEVYDKT--VEES-H-LSEMTVDAL---SI  211
WP_002305844  144  DNPEKTDLRLIVYLALAHIIKFRGHFLIEGK-FDTRNNDVQRL-FQEFLAVYDNT--FENS-S-LQEQNVQVE---EI  211
WP_002307203  144  DNPEKVDLRLIVYLALAHIIKFRGHFLIEGK-FDTRNNDVQRL-FQEFLAVYDNT--FENS-S-LQEQNVQVE---EI  211
WP_002310390  144  DNPEKVDLRLIVYLALAHIIKFRGHFLIEGK-FDTRNNDVQRL-FQEFLAVYDNT--FENS-S-LQEQNVQVE---EI  211
WP_002352408  144  DNPEKVDLRLIVYLALAHIIKFRGHFLIEGK-FDTRNNDVQRL-FQEFLAVYDNT--FENS-S-LQEQNVQVE---EI  211
WP_012997688  144  DNPEKVDLRLIVYLALAHIIKFRGHFLIEGK-FDTRNNDVQRL-FQEFLAVYDNT--FENS-S-LQEQNVQVE---EI  211
WP_014677909  144  DNPEKVDLRLIVYLALAHIIKFRGHFLIEGK-FDTRNNDVQRL-FQEFLAVYDNT--FENS-S-LQEQNVQVE---EI  211
WP_019312892  144  DNPEKVDLRLIVYLALAHIIKFRGHFLIEGK-FDTRNNDVQRL-FQEFLAVYDNT--FENS-S-LQEQNVQVE---EI  211
WP_019313659  144  DNPEKVDLRLIVYLALAHIIKFRGHFLIEGK-FDTRNNDVQRL-FQEFLAVYDNT--FENS-S-LQEQNVQVE---EI  211
```

```
WP_019314093  144  DNPEKVDLRLIVYLALAHIIKFRGHFLIEGK-FDTRNNDVQKL--FQEFLAVYDNT--FENS-S  LQEQNVQVE---EI  211
WP_019315370  144  DNPEKTDLRLIVYLALAHIIKFRGHFLIEGK-FDTRNNDVQKL--FQEFLAVYDNT--FENS-S  LQEQNVQVE---EI  211
WP_019803776  144  DNPEKVDLRLIVYLALAHIIKFRGHFLIEGK-FDTRNNDVQRL--FQEFLAVYDNT--FENS-S  LQEQNVQVE---EI  211
WP_019805234  144  DNPEKTDLRLIVYLALAHIIKFRGHFLIEGK-FDTRNNDVQRL--FQEFLAVYDNT--FENS-S  LQEQNVQVE---EI  211
WP_024783594  144  DNPEKVDLRLIVYLALAHIIKFRGHFLIEGK-FADFVGVYDRT--FDDS-H            LSEITVDAS---SI  211
WP_024784288  144  DSTEKADLRLIVYLALAHIIKFRGHFLIEGE-LNAENTDVQKL--FQEFLAVYDNT--FENS-S  LQEQNVQVE---EI  211
WP_024784666  144  DNPEKVDLRLIVYLALAHIIKFRGHFLIEGK-FDTRNNDVQRL--FQEFLAVYDNT--FENS-S  LQEQNVQVE---EI  211
WP_024784894  144  DNPEKTDLRLIVYLALAHIIKFRGHFLIEGE-LNAENTDVQKL--FADFVGVYDRT--FDDS-H  LSEITVDAS---SI  211
WP_024786433  144  DSTEKADLRLIVYLALAHIIKFRGHFLIEGE-LNAENTDVQKL--FADFVGVYDRT--FDDS-H  LSEITVDAS---SI  211
WP_049473442  144  DNPEKVDLRLIVYLALAHIIKFRGHFLIEGK-FDTRNNDVQRL--FQEFLAVYDNT--FENS-S  LQEQNVQVE---EI  211
WP_049474547  144  DNPEKTDLRLIVYLALAHIIKFRGHFLIEGK-FDTRNNDVQRL--FQEFLAVYDNT--FENS-S  LQEQNVQVE---EI  211
EMC03581      137  DNPEKVDLRLIVYLALAHIIKFRGHFLIEGK-FDTRNNDVQKL--FQEFLAVYDNT--FENS-S  LQEQNVQVE---EI  204
WP_000428612  145  DSKEKTDLRLIYLALAHMIKYRGHFLYEDT-FDIKNNDIQKI--FNEFISIYNNT--FEGN-S  LSGQNAQVE---AI  212
WP_000428613  145  DSKEKTDLRLIYLALAHMIKYRGHFLYEDT-FDIKNNDIQKI--FSEFISIYDNT--FEGS-S  LSKGNAQVE---AI  212
WP_049523028  144  DSKEKTDLRLIYLALAHIIKERGHFLYEDS-FDIKNNDIQKI--FNEFTILYDNT--FEES-S  LSKGNAQVE---EI  211
WP_003107102  113  DSDEKADLRLIYLALAHIIKYRGHFLYEGA-LDSQNTDVNAL--FLKLVDTYNLM--FEDD--  IDTQTIDAT---VI  180
WP_054279288  146  DNTEKADLRLIYLALAHMIKYRGHFLIEGA-LSAANTDVQQL--VHALVDAYNIM--FEED--  LDIEAIDVK---AI  213
WP_049531101  145  DSKEKADLRLIYLTLAHMIKYRGHFLYEES-FDIKNNDIQKI--FNEFISIYDNT--FEGS-S  LSGQNAQVE---AI  212
WP_049538452  145  DSKEKADLRLIYLALAHMIKYRGHFLYEEA-FDIKNNDIQKI--FNEFINIYDNT--FEGS-S  LSGQNEQVE---AI  212
WP_049549711  145  DSKEKADLRLIYLYLAHMIKYRGHFLYEEA-FDIKNNDIQKI--FNEFISIYDNT--FEGS-S  LSGQNAQVE---TI  212
WP_007896501  146  DRDQKADLRLIYLALSHIIKFRGHFLIEGK-LNSENTDVQKL--FIALVIYNLL--FEEE-   IAGETCDAK---AL  213
EFR44625       98  DRDQKADLRLIYLALSHIIKFRGHFLIEGK-LNSENTDVQKL--FIALVIYNLL--FEEE-   IAGETCDAK---AL  165
WP_002897477  144  DSKEKSDVRLIYLALAHMIKYRGHFLYEET-FNEFINIYDNT--FEGS-S              LSGQNAQVE---AI  211
WP_002906454  145  DSKEKTDLRLIYLALAHMIKYRGHFLIEGD-FDIKNNDIQKI--FNEFISIYDNT--FEGS-S  LSGQNAQVE---AI  212
WP_009729476  145  DSKEKTDLRLIYLALAHMIKYRGHFLYEEA-FDIKNNDIQKI--FNEFISIYNNT--FEGN-S  LSGQNVQVE---AI  212
CQR24647      144  DSSEKADLRIVYLALAHIIKYRGHFLIDEP-IDIRNMNSQNL--FKEFLLAFDGI--QVDC-Y  LASKHTDIS---GI  211
WP_000066813  145  DSKEKTDLRLIYLALAHMIKYRGHFLYEES-FDIKNNDIQKI--FSEFISIYDNT--FEGK-S  LSGQNAQVE---AI  212
WP_009754323  145  DSKEKADLRLIYLALAHITKYRGHFLIEGK-FDIKNNDIQKI--FNEFINIYDNT--FEGS-S  LSGQNAQVE---AI  212
WP_044674937  144  DSSQKADIRLIYLALAHMIKYRGHFLFEGD-LKSENKDVQHL--FNDFVEMFDKT--VEGS-Y  LSENLPNVA---DV  211
WP_044676715  144  DSSQKADIRLIYLALAHMIKYRGHFLFEGD-LKSENKDVQHL--FNDFVEMFDKT--VEGS-Y  LSENLPNVA---DV  211
WP_044680361  144  DSSQKADIRLIYLALAHMIKYRGHFLIEGD-LKSENKDVQHL--FNDFVEMFDKT--VEGS-Y  LSENLPNVA---DV  211
WP_044681799  144  DSSQKADIRLIYLALAHMIKFRGHFLIEGD-LKMDGISIES--FNDFVEMFDKT--VEGS-Y  LSENLPNVA---DV  211
WP_049533112  101  DISQKADLRIVYLALAHIIKYRGHFLIEGQ-LKAENTNVQAL--FKDFVEVYDKT--VEES-H  LSEMTVDAL---SI  211
WP_029090905  140  SQHRQFDIREVYLAIHHLIKYRGHFIYEDQtFTIDGNQLQHH--IKAIITMINSTl--NR-    IIPETIDINvfeKI  171
WP_006506696  144  ESTEKADPRLIYLALHHIVKYRGNFLYEGQkFNMDASNIEDK--LsDIFTQfTSFnniPYEdD  -KKNLEIL---EI   210
AIT42264      140  DSTDKADLRLIYLALAHMIKFRGHFLIEGD-LNPDNSDVDKL--FIQLVQTYNQL--FEEN-   INASGVDAK---AI  211
WP_034440723  143  DSNQKADLRLIYLALAHMIKFRGHFLIEGD-LKMDGISISES--FQEFIDSYNEVcaLEDE-N  NDELLTQIE---VI  217
AKQ21048      144  DSTDKADLRLIYLALAHMIKYRGHFLIEGD-LNPDNSDVDKL--FIQLVQTYNQL--FEEN-   INASGVDAK---AI  211
WP_004636532  144  DNPEKADLRLIVYTALAHIIKYRGHFLIEGK-LNTENTSISET--FEQFLDTYSDI--FKEQ-   LVGDISKVE---EI  210
WP_002364836  144  DSSEQADLRLIIKYRGHFLIEGK-LSTENISVKEQ-FQQFMIIYNQT--FVNGES            PLPESVLIE---EE  217
WP_016631044   95  DSSEQADLRLIYLALAHIVKYRGHFLIEGK-LSTENISVKEQ--FQQFMIIYNQT--FVNGES  PLPESVLIE---EE  168
EMS75795              ---                                                             PLPESVLIE---EE  217
WP_002373311  144  DSSEQADLRLIYLALAHIVKYRGHFLIEGK-LSTENISVKEQ--FQQFMIIYNQT--FVNGES  PLPESVLIE---EE  217
WP_002378009  144  DSSEQADLRLIYLALAHIVKYRGHFLIEGK-LSTENISVKEQ--FQQFMIIYNQT--FVNGES  PLPESVLIE---EE  217
WP_002407324  144  DSSEQADLRLIYLALAHIVKYRGHFLIEGK-LSTENISVKEQ--FQQFMIIYNQT--FVNGES  PLPESVLIE---EE  217
WP_002413717  144  DSSEQADLRLIYLALAHIVKYRGHFLIEGK-LSTENISVKEQ--FQQFMIIYNQT--FVNGES  PLPESVLIE---EE  217
WP_010775580  144  DSSEQADLRLIYLALAHIVKYRGHFLIEGK-LSTENISVKEQ--FQQFMIIYNQT--FVNGES  PLPESVLIE---EE  217
WP_010818269  144  DSSEQADLRLIYLALAHIVKYRGHFLIEGK-LSTENISVKEQ--FQQFMIIYNQT--FVNGES  PLPESVLIE---EE  217
WP_010824395  144  DSSEQADLRLIYLALAHIVKYRGHFLIEGK-LSTENISVKEQ--FQQFMIIYNQT--FVNGES  PLPESVLIE---EE  217
WP_016622645  144  DSSEQADLRLIYLALAHIVKYRGHFLIEGK-LSTENISVKEQ--FQQFMIIYNQT--FVNGES  PLPESVLIE---EE  217
WP_033624816  144  DSSEQADLRLIYLALAHIVKYRGHFLIEGK-LSTENISVKEK--FQQFMIIYNQT--FVNGeG  PLPESVLIE---EE  217
WP_033625576  144  DSSEQADLRLIYLALAHIVKYRGHFLIEGK-LSTENISVKDQ--FQQFMIIYNQT--FVNGES  PLPESVLIE---EE  217
WP_033789179  144  DSSEQADLRLIYLALAHIVKYRGHFLIEGK-LSTENISVKEQ--FQQFMIIYNQT--FVNGES  PLPESVLIE---EE  217
```

-continued

```
WP_002310644   144  DSSEKADIRLVYLAMAHLLKYRGHFLIEGE-LNTENSSVIET--FRQFLSTYNQQ--FSEA-D  KLDEAVDCS---FV  216
WP_002312694   144  DSSEKADIRLVYLAMAHLLKYRGHFLIEGE-LNTENSSVIET--FRQFLSTYNQQ--FSEA-G  KLDEAVDCS---FV  216
WP_002314015   144  DSSEKADIRLVYLAMAHLLKYRGHFLIEGE-LNTENSSVIET--FRQFLSTYNQQ--FSEA-D  KLDEAVDCS---FV  216
WP_002320716   144  DSSEKADIRLVYLAMAHLLKYRGHFLIEGE-LNTENSSVIET--FRQFLSTYNQQ--FSEA-D  KLDEAVDCS---FV  216
WP_002330729   144  DSSEKADIRLVYLAMAHLLKYRGHFLIEGE-LNTENSSVIET--FRQFLSTYNQQ--FSEA-D  KLDEAVDCS---FV  216
WP_002335161   144  DSSEKADIRLVYLAMAHLLKYRGHFLIEGE-LNTENSSVIET--FRQFLSTYNQQ--FSEA-D  KLDEAVDCS---FV  216
WP_002345439   144  DSSEKADIRLVYLAMAHLLKYRGHFLIEGE-LNTENSSVIET--FRQFLSTYNQQ--FSEA-D  KLDEAVDCS---FV  216
WP_034867970   144  DSTEKEDLRLVYLAMAHLLKYRGHFLFEGD-LDTENTSIEES--FRVFLEQYSKQ---SDQP-  -LIVHQPVL---TI  209
WP_047937432   144  DSSEKADIRLVYLAMAHLLKYRGHFLIEGE-LNTENSSVIET--FRQFLSTYNQQ--FSEA-D  KLDEAVDCS---FV  216
WP_010720994   144  DSTEKGDLRLVYLALAHLLKYRGHFLFEGD-LDTENTSIEES--FRVFLEQYGKQ---SDQP-  -LIVHQPVL---TI  209
WP_010737004   144  DSTEKEDLRLVYLALAHLLKYRGHFLFEGD-LDTENTSIEES--FRVFLEQYSKQ---SDQP-  -LIVHQPVL---TI  209
WP_034700478   144  DSTEKEDLRLVYLALAHLLKYRGHFLFEGD-LDTENTSIEES--FRVFLEQYGKO---SDQP-  -LIVHQPVL---TI  209
WP_007209003   144  DGDEKADLRLVYLAIAHILKFRGNFLIEGE-LNTENNSVIELs--KVFVQLYNQTl-SELE--  FIDESIDFS---EV  214
WP_023519017   144  NSKEQADIRLVYLAIAHCLKYRGHFLFEGE-LDTENTSVIEN--YQQFLQAYQQF--FPEP--  -IGDLDDAV---PI  209
WP_023351917   144  DISEQADLRLVYLALAHIIKYRGHFLIEGE-LNTENSSVSET--FRIFIQVYNQI--FRENe-  PLAVPDNIE--EL  212
WP_048604708   144  DAEEKADLRLVYLALAHIIKYRGHFLIEGR-LSTENTSTEET--FKTFLQKYNQT--FN----  PVDETISIG---SI  208
WP_010750235   144  DSTEKADLRLVYLALAHIIKYRGHFLFEGE-LDTENTSVEET--FKEFIDIYNEQ--FEEG--  -IIFYKDIP---LI  209
AII16583       183  DSTDKADLRLIYLALAHMIKFRGHFLIEGD-LNPDNSDVDKL--FIQLVQTYNQL--FEEN--  INASGVDAK---AI  250
WP_029073316   145  ESKEKEDPRLIYLALHHIVKYRGNFLYEGQkFSMDVSNIEDK--MIDVLRQFNEInlFEYVeD  --KKIDEVL---NV  215
WP_031589969   145  ESSEKEDPRLIYLALHHIVKYRGNFLYEGQkFSMDVSNIEDK--MIDVLRQFNEInlFEYVeD  --KKIDEVL---NV  215
KDA45870       145  NNDRPADLRLVYLAMHHIVKYRGHFLNEAPvSSEKSSEINLVahFDRLNTIFADL-FSESgF  ---KLDVA---DI  209
WP_039099354   133  TEKRQFDIREIYLAMHHIVKYRGHFLNEAPvSSEKSSEINLVahFDRLNTIFADL-FSESgF  -TDKLAEVK---AL  206
AKP02966       138  INKNKADIRLVYLALHNILKYRGNFTYEHQkFNISTLNSNLS--KELIELNQQLikYDIS--  FPDNCDWNhisDI  208
WP_010991369   144  NSSEKADLRLVYLALAHIIKFRGNFLIEGA-LDTQNTSVDGI--YKQFIQTYNQV--FASGiE  KLEDNKDVA---KI  217
WP_033838504   144  NSSEKADLRLVYLALAHIIKFRGNFLIEGA-LDTQNTSVDGI--YKQFIQTYNQV--FASGiE  KLEDNKDVA---KI  217
EHN60060       147  NSSEKADLRLVYLALAHIIKFRGNFLIEGA-LDTQNTSVDGI--YKQFIQTYNQV--FASGiE  KLEDNKDVA---KI  220
WP_038409211   144  NSSKADLRLVYLALAHMIKFRGHFLIEGM-LDTKNTSVDEV--FKQFIQTYNQI--FASDiE  RLEENKEVA---EI  217
EFR89594                                                                                                
EFR95520                                                                                                
WP_003723650   144  NSSEKADLRLVYLALAHIIKYRGHFLIEGA-LDTKNTSVDEV--YKQFIETYNQV--FMSNiE  KVEENIEVA---NI  217
WP_003727705   144  NSSEKADLRLVYLALAHIIKFRGHFLIEGA-LDTKNTSVDEV--YKQFIQTYNQV--FMSNiE  KVEENTEVA---SI  217
WP_003730785   144  NSSEKADLRLVYLALAHIIKYRGHFLIEGA-LDTKNTSVDEV--YKQFIQTYNQV--FMSNiE  KVEENTEVA---NI  217
WP_003733029   144  DSQKKADLRLVYLALAHIIKFRGHFLIEGA-LDTKNISIDEM--FKQFIQTYNQV--FANDiE  KTEKNQEVA---QI  217
WP_003739838   144  NSSEKADLRLVYLALAHIIKFRGNFLIEGA-LDTKNISIDEM--FKQFIQTYNQV--FISNiE  KMEENTTVA---DI  217
WP_014601172   144  NSSEKADLRLVYLALAHIIKFRGHFLIEGA-LDTKNTSVDGV--YEQFILTYNQV--FMSNiE  KVEENIEVA---NI  217
WP_023548323   144  NSSEKADLRLVYLALAHIIKFRGHFLIEGA-LDTKNTSVDGV--YEQFIQTYNQV--FMSNiE  KVEENIEVA---NI  217
WP_031665337   144  NSSEKADLRLVYLALAHIIKFRGHFLIEGA-LDTKNTSVDGV--YEQFIQTYNQV--FMSNiE  KVEENIEVA---NI  217
WP_031669209   144  DSQKKADLRLVYLALAHIIKFRGHFLIEGA-LDTKNISIDEM--FKQFLQIYNQV--FANDiE  KTEKNQEVA---QI  217
WP_033920898   144  NSSEKADLRLVYLALAHIIKFRGHFLIEGA-LDTKNTSVDGV--YEQFIQTYNQV--FMSNiE  KVEENIEVA---NI  217
AKI42028       147  NSSEKADLRLVYLALAHIIKFRGHFLIEGA-LDTKNTSVDGV--YEQFIQTYNQV--FMSNiE  KVEENIEVA---NI  220
AKI50529       147  NSSEKADLRLVYLALAHIIKFRGHFLIEGA-LDTKNTSVDGV--YEQFIQTYNQV--FMSNiE  KVEENIEVA---NI  220
EFR83390                                                                                                
WP_046323366   144  NSSDKADLRLVYLALAHMIKFRGHFLIEGD-LNPDNSDVDKL--FKQFIKTYNQV--FASDiE  RIEENNEVA---KI  217
AKE81011       160  DSTDKADLRLIYLALAHMIKFRGHFLIEGD-LNPDNSDVDKL--FIQLVQTYNQL--FEEN--  INASGVDAK---AI  227
CUO82355       144  ESTEKADPRLIYLALHHIVKYRGHFLYEGQkFNMDASNIEDK--LSDVFTQFADFnnIPYEdD  --KKNLEIL---EI  214
WP_033162887   145  ENKEKADPRLIYLALHHIVKYRGNFLYEGQsFTMDNSDIEER--LNSAIEKFMSIneFDNRiV  --SDINSMI---AV  215
AGZ01981       177  DSTDKADLRLIYLALAHMIKFRGHFLIEGD-LNPDNSDVDKL--FIQLVQTYNQL--FEEN--  INASGVDAK---AI  244
AKA60242       144  DSTDKADLRLIYLALAHMIKFRGHFLIEGD-LNPDNSDVDKL--FIQLVQTYNQL--FEEN--  INASGVDAK---AI  211
```

-continued

```
AKS40380       144 DSTDKADLRLIYLALAHMIKFRGHFLIEGD-LNPDNSDVDKL--FIQLVQTYNQL--FEEN-- INASGVDAK---AI 211
4UN5_B         148 DSTDKADLRLIYLALAHMIKFRGHFLIEGD-LNPDNSDVDKL--FIQLVQTYNQL--FEEN-- INASGVDAK---AI 215
WP_010922251   212 LSAR-LSKSRRLENLIAQ-L-PG EKKNGLEGNLIALSLGLIPNEKSNF-DLAED-E---KLQ--LSKDTYDDDLDN 277

WP_039695303   213 LTEK-ISKSRRLENLIKY-Y-PT EKKNTLEGNLIALALGLQPNEKTNE-KLSED-A---KLQ--FSKDTYEEDLEE 278
WP_045635197   213 FTDK-ISKSAKRERVLKL-F-PD EKSTGLFSEFLKLIVGNQADFKKHF-DLEDK-A---PLQ--FSKDTYDEDLEN 277
WP_011284745   213 LSTK------EQLSRN-S--K  -------------------------  --------LEEKyVa-ELQ------- 157
5AXW_A         135
WP_009880683   -   -------------------------- -------------------------- ----------------------- -
WP_010922251   212 LSAR-LSKSRRLENLIAQ-L-PG EKKNGLEGNLIALSLGLIPNEKSNF-DLAED-A---KLQ--LSKDTYDDDLDN 277
WP_011054416   212 LSAR-LSKSRRLENLIAQ-L-PG EKRNGLEGNLIALSLGLIPNEKSNF-DLAED-A---KLQ--LSKDTYDDDLDN 277
WP_011284745   212 LSAR-LSKSRRLENLIAQ-L-PG EKKNGLEGNLIALSLGLIPNEKSNF-DLAED-A---KLQ--LSKDTYDDDLDN 277
WP_011285506   212 LSAR-LSKSRRLENLIAQ-L-PG EKKNGLEGNLIALSLGLIPNEKSNF-DLAED-A---KLQ--LSKDTYDDDLDN 277
WP_011527619   212 LSAR-LSKSRRLENLIAQ-L-PG EKKNGLEGNLIALSLGLIPNEKSNF-DLAED-A---KLQ--LSKDTYDDDLDN 277
WP_012560673   212 LSAR-LSKSRRLENLIAQ-L-PG EKKNGLEGNLIALSLGLIPNEKSNF-DLAED-A---KLQ--LSKDTYDDDLDN 277
WP_014407541   212 LSAR-LSKSRRLENLIAQ-L-PG EKRNGLEGNLIALSLGLIPNEKSNF-DLAED-A---KLQ--LSKDTYDDDLDN 277
WP_020905136   212 LSAR-LSKSRRLENLIAQ-L-PG EKRNGLEGNLIALSLGLIPNEKSNF-DLAED-A---KLQ--LSKDTYDDDLDN 277
WP_023080005   212 LSAR-LSKSRRLENLIAQ-L-PG EKKNGLEGNLIALSLGLIPNEKSNF-DLAED-A---KLQ--LSKDTYDDDLDN 277
WP_023610282   212 LSAR-LSKSRRLENLIAQ-L-PG EKKNGLEGNLIALSLGLIPNEKSNF-DLAED-A---KLQ--LSKDTYDDDLDN 277
WP_030125963   212 LSAR-LSKSRRLENLIAQ-L-PG EKKNGLEGNLIALSLGLIPNEKSNF-DLAED-A---KLQ--LSKDTYDDDLDN 277
WP_030126706   212 LSAR-LSKSRRLENLIAQ-L-PG EKKNGLEGNLIALSLGLIPNEKSNF-DLAED-A---KLQ--LSKDTYDDDLDN 277
WP_031488318   212 LSAR-LSKSRRLENLIAQ-L-PG EKKNGLEGNLIALSLGLIPNEKSNF-DLAED-A---KLQ--LSKDTYDDDLDN 277
WP_032460140   212 LSAR-LSKSRRLENLIAQ-L-PG EKRNGLEGNLIALSLGLIPNEKSNF-DLAED-A---KLQ--LSKDTYDDDLDN 277
WP_032461047   212 LSAR-LSKSRRLENLIAQ-L-PG EKKNGLEGNLIALSLGLIPNEKSNF-DLAED-A---KLQ--LSKDTYDDDLDN 277
WP_032462016   212 LSAR-LSKSRRLENLIAQ-L-PG EKKNGLEGNLIALLLGLIPNEKSNF-DLAED-A---KLQ--LSKDTYDDDLDN 277
WP_032462936   212 LSAR-LSKSRRLENLIAQ-L-PG EKKNGLEGNLIALSLGLIPNEKSNF-DLAED-A---KLQ--LSKDTYDDDLDN 277
WP_032464890   37  LSAR-LSKSRRLENLIAQ-L-PG EKRNGLEGNLIALSLGLIPNEKSNF-DLAED-A---KLQ--LSKDTYDDDLDN 102
WP_033888930   212 LSAR-LSKSRRLENLIAQ-L-PG EKRNGLEGNLIALSLGLIPNEKSNF-DLAED-A---KLQ--LSKDTYDDDLDN 277
WP_038431314   212 LSAR-LSKSRRLENLIAQ-L-PG EKKNGLEGNLIALSLGLIPNEKSNF-DLAED-T---KLQ--LSKDTYDDDLDN 277
WP_038432938   212 LSAR-LSKSRRLENLIAQ-L-PG EKKNGLEGNLIALSLGLIPNEKSNF-DLAED-A---KLQ--LSKDTYDDDLDN 277
WP_038434062   123 LSAR-LSKSRRLENLIAQ-L-PG EKKNGLEGNLIALSLGLIPNEKSNF-DLAED-A---KLQ--LSKDTYDDDLDN 188
BAQ51233       -   -------------------------- -------------------------- ----------------------- -
KGE60162       -   -------------------------- -------------------------- ----------------------- -
KGE60856       212 LSAR-LSKSRRLENLIAQ-L-PG EKKNGLEGNLIALSLGLIPNEKSNF-DLAED-A---KLQ--LSKDTYDDDLDN 277
WP_002989955   212 LTEK-VSKSRRLENLIAH-Y-PA EKKNTLEGNLIALSLGLQPNEKTNE-QLSED-A---KLQ--FSKDTYEEDLEG 277
WP_003030002   215 LTEK-ISKSRRLENLIKY-Y-PT EKKNTLEGNLIALSLGLQPNEKMNF-KLSED-A---KLQ--FSKDSYEEDLGE 280
WP_003065552   213 LTDK-ISKSAKKDRILAQ-Y-PN QKSTGIFAEFIKLIVGNQADFKKHF-NLEDK-T---PLQ--FAKDSYDEDLEN 278
WP_001040076   213 LTDK-ISKSAKKDRILAQ-Y-PN QKSTGIFAEFIKLIVGNQADFKKYF-NLEDK-T---PLQ--FAKDSYDEDLEN 278
WP_001040078   213 LTDK-ISKSAKKDRILAQ-Y-PN QKSTGIFAEFIKLIVGNQADFKKYF-NLEDK-T---PLQ--FAKDSYDEDLEN 278
WP_001040080   213 LTDK-ISKSAKKDRILAQ-Y-PN QKSTGIFAEFIKLIVGNQADFKKYF-NLEDK-T---PLQ--FAKDSYDEDLEN 278
WP_001040081   213 LTDK-ISKSAKKDRILAQ-Y-PN QKSTGIFAEFIKLIVGNQADFKKYF-NLEDK-T---PLQ--FAKDSYDEDLEN 278
WP_001040083   213 LTDK-ISKSAKKDRILAQ-Y-PN QKSTGIFAEFIKLIVGNQADFKKYF-NLEDK-T---PLQ--FAKDSYDEDLEN 278
WP_001040085   213 LTDK-ISKSAKKDRILAQ-Y-PN QKSTGIFAEFIKLIVGNQADFKKYF-NLEDK-T---PLQ--FAKDSYDEDLEN 278
WP_001040087   213 LTDK-ISKSAKKDRILAQ-Y-PN QKSTGIFAEFIKLIVGNQADFKKYF-NLEDK-T---PLQ--FAKDSYDEDLEN 278
WP_001040088   213 LTDK-ISKSAKKDRILAQ-Y-PN QKSTGIFAEFIKLIVGNQADFKKYF-NLEDK-T---PLQ--FAKDSYDEDLEN 278
WP_001040089   213 LTDK-ISKSAKKDRILAQ-Y-PN QKSTGIFAEFIKLIVGNQADFKKYF-NLEDK-T---PLQ--FAKDSYDEDLEN 278
WP_001040090   213 LTDK-ISKSAKKDRILAQ-Y-PN QKSTGIFAEFIKLIVGNQADFKKYF-NLEDK-T---PLQ--FAKDSYDEDLEN 278
WP_001040091   213 LTDK-ISKSAKKDRILAQ-Y-PN QKSTGIFAEFIKLIVGNQADFKKYF-NLEDK-T---PLQ--FAKDSYDEDLEN 278
WP_001040092   213 LTDK-ISKSAKKDRILAQ-Y-PN QKSTGIFAEFIKLIVGNQADFKKYF-NLEDK-T---PLQ--FAKDSYDEDLEN 278
WP_001040094   213 LTDK-ISKSAKKDRILAQ-Y-PN QKSTGIFAEFIKLIVGNQADFKKHF-NLEDK-T---PLQ--FAKDSYDEDLEN 278
WP_001040095   213 LTDK-ISKSAKKDRILAR-Y-PN QKSTGIFAEFIKLIVGNQADFKKHF-NLEDK-T---PLQ--FAKDSYDEDLEN 278
WP_001040096   213 LTDK-ISKSAKKDRILAR-Y-PN QKSTGIFAEFIKLIVGNQADFKKHF-NLEDK-T---PLQ--FAKDSYDEDLEN 278
WP_001040097   213 LTDK-ISKSAKKDRILAR-Y-PN QKSTGIFAEFIKLIVGNQADFKKHF-NLEDK-T---PLQ--FAKDSYDEDLEN 278
WP_001040098   213 LTDK-ISKSAKKDRILAR-Y-PN QKSTGIFAEFIKLIVGNQADFKKHF-NLEDK-T---PLQ--FAKDSYDEDLEN 278
```

-continued

| | | | | |
|---|---|---|---|---|
| WP_001040099 | 213 | LTDK-ISKSAKKDRILAR-Y-PN | QKSTGIFAEFIKLIVGNQADFKKHF | -NLEDK-T---PLQ--FAKDSYDEDLEN | 278 |
| WP_001040100 | 213 | LTDK-ISKSAKKDRILAR-Y-PN | QKSTGIFAEFIKLIVGNQADFKKHF | -NLEDK-T---PLQ--FAKDSYDEDLEN | 278 |
| WP_001040104 | 213 | LTDK-ISKSAKKDRILAQ-Y-PN | QKSTGIFAEFIKLIVGNQADFKKYF | -NLEDK-T---PLQ--FAKDSYDEDLEN | 278 |
| WP_001040105 | 213 | LTDK-ISKSAKKDRILAQ-Y-PN | QKSTGIFAEFIKLIVGNQADFKKHF | -NLEDK-T---PLQ--FAKDSYDEDLEN | 278 |
| WP_001040106 | 213 | LTDK-ISKSAKKDRILAQ-Y-PN | QKSTGIFAEFIKLIVGNQADFKKHF | -NLEDK-T---PLQ--FAKDSYDEDLEN | 278 |
| WP_001040107 | 213 | LTDK-ISKSAKKDRILAQ-Y-PN | QKSTGIFAEFIKLIVGNQADFKKHF | -NLEDK-T---PLQ--FAKDSYDEDLEN | 278 |
| WP_001040108 | 213 | LTDK-ISKSAKKDRILAQ-Y-PN | QKSTGIFAEFIKLIVGNQADFKKHF | -NLEDK-T---PLQ--FAKDSYDEDLEN | 278 |
| WP_001040109 | 213 | LTDK-ISKSAKKDRILAQ-Y-PN | QKSTGIFAEFIKLIVGNQADFKKHF | -NLEDK-T---PLQ--FAKDSYDEDLEN | 278 |
| WP_001040110 | 213 | LTDK-ISKSAKKDRILAQ-Y-PN | QKSTGIFAEFIKLIVGNQADFKKHF | -NLEDK-T---PLQ--FAKDSYDEDLEN | 278 |
| WP_015058823 | 213 | LTDK-ISKSAKKDRILAR-Y-PN | QKSTGIFAEFIKLIVGNQADFKKHF | -NLEDK-T---PLQ--FAKDSYDEDLEN | 278 |
| WP_017643650 | 213 | LTDK-ISKSAKKDRILAQ-Y-PN | QKSTGIFAEFIKLIVGNQADFKKHF | -NLEDK-T---PLQ--FAKDSYDEDLEN | 278 |
| WP_017647151 | 213 | LTDK-ISKSAKKDRILAQ-Y-PN | QKSTGIFAEFIKLIVGNQADFKKYF | -NLEDK-T---PLQ--FAKDSYDEDLEN | 278 |
| WP_017648376 | 213 | LTDK-ISKSAKKDRILAQ-Y-PN | QKSTGIFAEFIKLIVGNQADFKKHF | -NLEDK-T---PLQ--FAKDSYDEDLEN | 278 |
| WP_017649527 | 213 | LTDK-ISKSAKKDRILAQ-Y-PN | QKSTGIFAEFIKLIVGNQADFKKHF | -NLEDK-T---PLQ--FAKDSYDEDLEN | 278 |
| WP_017771611 | 213 | LTDK-ISKSAKKDRILAR-Y-PN | QKSTGIFAEFIKLIVGNQADFKKYF | -NLEDK-T---PLQ--FAKDSYDEDLEN | 278 |
| WP_017771984 | 213 | LTDK-ISKSAKKDRILAQ-Y-PN | QKSTGIFAEFIKLIVGNQADFKKHF | -NLEDK-T---PLQ--FAKDSYDEDLEN | 278 |
| CFQ25032 | 213 | LTDK-ISKSAKKDRILAQ-Y-PN | QKSTGIFAEFIKLIVGNQADFKKYF | -NLEDK-T---PLQ--FAKDSYDEDLEN | 278 |
| CFV16040 | 213 | LTDK-ISKSAKKDRILAQ-Y-PN | QKSTGIFAEFIKLIVGNQADFKKHF | -NLEDK-T---PLQ--FAKDSYDEDLEN | 278 |
| KLJ37842 | 213 | LTDK-ISKSAKKDRILAQ-Y-PN | QKSTGIFAEFIKLIVGNQADFKKHF | -NLEDK-T---PLQ--FAKDSYDEDLEN | 278 |
| KLJ72361 | 213 | LTDK-ISKSAKKDRILAQ-Y-PN | QKSTGIFAEFIKLIVGNQADFKKHF | -NLEDK-T---PLQ--FAKDSYDEDLEN | 278 |
| KLL20707 | 213 | LTDK-ISKSAKKDRILAQ-Y-PN | QKSTGIFAEFIKLIVGNQADFKKHF | -NLEDK-T---PLQ--FAKDSYDEDLEN | 278 |
| KLL42645 | 213 | LTDK-ISKSAKKDRILAQ-Y-PN | QKSTGIFAEFIKLIVGNQADFKKHF | -NLEDK-T---PLQ--FAKDSYDEDLEN | 278 |
| WP_047207273 | 213 | LTDK-ISKSAKKDRILAR-Y-PN | QKSTGIFAEFIKLIVGNQADFKKHF | -NLEDK-T---PLQ--FAKDSYDEDLEN | 278 |
| WP_047209694 | 213 | LTDK-ISKSAKKDRILAQ-Y-PN | QKSTGIFAEFIKLIVGNQADFKKHF | -NLEDK-T---PLQ--FAKDSYDEDLEN | 278 |
| WP_050198062 | 213 | LTDK-ISKSAKKDRILAQ-Y-PN | QKSTGIFAEFIKLIVGNQADFKKHF | -NLEDK-T---PLQ--FAKDSYDEDLEN | 278 |
| WP_050201642 | 213 | LTDK-ISKSAKKDRILAQ-Y-PN | QKSTGIFAEFIKLIVGNQADFKKHF | -NLEDK-T---PLQ--FAKDSYDEDLEN | 278 |
| WP_050204027 | 213 | LTDK-ISKSAKKDRILAQ-Y-PN | QKSTGIFAEFIKLIVGNQADFKKHF | -NLEDK-T---PLQ--FAKDSYDEDLEN | 278 |
| WP_050881965 | 213 | LTDK-ISKSAKKDRILAQ-Y-PN | QKSTGIFAEFIKLIVGNQADFKKHF | -NLEDK-T---PLQ--FAKDSYDEDLEN | 278 |
| WP_050886065 | 213 | LTDK-ISKSAKKDRILAQ-Y-PN | QKSTGIFAEFIKLIVGNQADFKKHF | -NLEDK-T---PLQ--FAKDSYDEDLEN | 278 |
| AHN30376 | 213 | LTDK-ISKSAKKDRILAQ-Y-PN | QKSTGIFAEFIKLIVGNQADFKKHF | -NLEDK-T---PLQ--FAKDSYDEDLEN | 278 |
| EAO78426 | 213 | LTDK-ISKSAKKDRILAQ-Y-PN | QKSTGIFAEFIKLIVGNQADFKKHF | -NLEDK-T---PLQ--FAKDSYDEDLEN | 278 |
| CCW42055 | 213 | LTDK-ISKSAKKDRILAQ-Y-PD | QKSTGIFAEFIKLIVGNQADFKKHF | -NLEDK-T---PLQ--FAKDSYDEDLEN | 278 |
| WP_003041502 | 213 | LTEK-VSKSRRLENLIAH-Y-PA | EKKNTLEGNLIALFLGLGLQPNEKTNE | -QLSED-A---KLQ--FSKDTYEEDLEG | 278 |
| WP_037593752 | 213 | LTEK-VSKSRRLENLIAH-Y-PT | EKKNTLEGNLIALSLGLQPNEKTNE | -QLSED-A---KLQ--FSKDTYEEDLEG | 278 |
| WP_049516684 | 213 | LTEK-VSKSRRLENLIVEC-Y-PT | EKKNTLEGNLIALSLGLQPNEKTNE | -QLSED-A---KLQ--FSKDTYEEDLEG | 278 |
| GAD46167 | 212 | LTEK-VSKSRRLENLIAH-Y-PT | EKKNTLEGNLIALSLGLQPNEKTNE | -KLSED-A---KLQ--FSKDTYEEDLEG | 277 |
| WP_018363470 | 213 | LTEK-LSKSRRLEKLIAV-F-PN | EKKNGLFGNIIALALGLTPNEKSNF | -DLTED-A---KLQ--FSKDTYDDDLDE | 278 |
| WP_003043819 | 212 | LSAR-LSKSKRLENLIAH-Y-PT | EKKNTLEGNLIALSLDLHPNEKTNE | -QLSED-A---KLQ--FSKDTYEEDLEG | 277 |
| WP_006269658 | 212 | LTEK-VSKSRRLENLIAH-Y-PT | EKKNTLEGNLIALSLGLQPNEKTNE | -QLSED-A---KLQ--FSKDTYEEDLEG | 277 |
| WP_048800889 | 212 | LTEK-VSKSRRLENLIVKC-Y-PT | EKKNTLEGNLIALSLGLTPNEKSNF | -QLSED-A---KLQ--FSKDTYEEDLEG | 277 |
| WP_012767106 | 212 | LSAR-LSKSRRLENLIAQ-L-PG | EKRNGLEGNLIALSLGLTPNEKSNF | -DLAED-A---KLQ--FSKDTYDDDLDN | 277 |
| WP_014612333 | 212 | LSAR-LSKSRRLENLIAQ-L-PG | EKRNGLEGNLIALSLGLTPNEKSNF | -DLAED-A---KLQ--FSKDTYDDDLDN | 277 |
| WP_015017095 | 212 | LSAR-LSKSRRLENLIAQ-L-PG | EKRNGLEGNLIALSLGLTPNEKSNF | -DLAED-A---KLQ--FSKDTYDDDLDN | 277 |
| WP_015057649 | 212 | LSAR-LSKSRRLENLIAQ-L-PG | EKRNGLEGNLIALSLGLTPNEKSNF | -DLAED-A---KLQ--FSKDTYDDDLDN | 277 |
| WP_048272215 | 212 | LSAR-LSKSRRLENLIAQ-L-PG | EKRNGLEGNLIALSLGLTPNEKSNF | -DLAED-A---KLQ--FSKDTYDDDLDN | 277 |
| WP_049519324 | 212 | LSAR-LSKSRRLENLIAQ-L-PG | QKKTGLFGNIIALSLGLTPNEKANF | -GLSKD-V---KLQ--LAKDTYADDLDS | 277 |
| WP_012515931 | 212 | LSAA-LSKSRRLENLISL-I-PG | QKKTGLFGNIIALSLGLTPNEKANF | -GLSKD-V---KLQ--LAKDTYADDLDS | 277 |
| WP_021320964 | 212 | LSAA-LSKSRRLENLISL-I-PG | QKKTGLFGNIIALSLGLTPNEKANF | -GLSKD-V---KLQ--LAKDTYADDLDS | 277 |
| WP_037581760 | 212 | LSAA-LSKSRRLENLISL-I-PG | QKKTGLFGNIIALSLGLTPNEKANF | -GLSKD-V---KLQ--LAKDTYADDLDS | 277 |
| WP_004232481 | 213 | LTEK-ISKSRRLENLIKY-Y-PT | EKKNTLFGNIVALALGLQPNFKTNF | -KLSED-A---KLQ--LAKDTYADDLDS | 277 |
| WP_009854540 | 213 | LTEK-ISKSRRLENLIKH-Y-PT | EKKNTLEGNLIALALGLQPNEKMNF | -KLSED-A---KLQ--FSKDTYDEDLEE | 278 |
| WP_012962174 | 213 | LTEK-FSKSRRLENLIKY-Y-PT | EKKNTLFGNIVALALGLQPNFKTSF | -KLSED-A---KLQ--LAKDTYADDLDS | 277 |
| WP_039695303 | 213 | LTEK-ISKSRRLENLIKY-Y-PT | EKKNTLEGNLIALALGLQPNEKTNE | -KLSED-A---KLQ--FSKDTYEEDLEE | 278 |

| ID | | | | |
|---|---|---|---|---|
| WP_014334983 | 212 | LTEK-VSKSRRLENLIKQ-Y-PT | EKKNTLEGNLIALGLQPNEKTNE--KLSED-A---KLQ---FSKDTYEEDLEE | 277 |
| WP_003099269 | 212 | LTSK-TSKSRRLENLIAE-I-PN | QKRNMLFGNLVSLALGLTPNFKTNF--ELLED-A---KLQ---ISKDSYEEDLDN | 277 |
| AHY15608 | 212 | LTSK-TSKSRRLENLIAE-I-PN | QKRNMLFGNLVSLALGLTPNFKTNF--ELLED-A---KLQ---ISKDSYEEDLDN | 277 |
| AHY17476 | 212 | LTSK-TSKSRRLENLIAE-I-PN | QKRNMLFGNLVSLALGLTPNFKTNF--ELLED-A---KLQ---ISKDSYEEDLDN | 277 |
| ESR09100 | --- | --- | --- | --- |
| AGM98575 | 212 | LTSK-TSKSRRLENLIAE-I-PN | QKRNMLFGNLVSLALGLTPNFKTNF--ELLED-A---KLQ---ISKDSYEEDLDN | 277 |
| ALF27331 | 212 | LTDK-ISKSAKKDRVLKL-F-PN | EKSNGRFAEFLKLIVGNQADFKKHF--ELEEK-A---PLQ---FSKDTYEELEV | 277 |
| WP_018372492 | 210 | FTEN-SSKAKRVETILGL-F-PD | ETAAGNLDKFKFLMLGNQADFKKHF----DLEEK-----iTLQ---FSKDSYEEDLEL | 275 |
| WP_045618028 | 213 | FTDK-ISKSAKREVLKL-F-PD | EKSTGLFSEFLKLIVGNQADFKKHF--DLEDK-A---PLQ---FSKDTYDEDLEN | 278 |
| WP_045635197 | 212 | FTDK-ISKSAKREVLKL-F-PD | EKSTGLFSEFLKLIVGNQADFKKHF--DLEEK-A---PLQ---FSKDTYEELEN | 277 |
| WP_002263549 | 212 | LTDK-ISKSAKKDRVLKL-F-PN | EKSNGRFAEFLKLIVGNQADFKKHF--ELEEK-A---PLQ---FSKDTYEELEV | 277 |
| WP_002263887 | 212 | LTDK-ISKSAKKDRVLKL-F-PN | EKSNGRFAEFLKLIVGNQADFKKHF--ELEEK-A---PLQ---FSKDTYEELEV | 277 |
| WP_002264920 | 212 | LTDK-ISKSRRLEKLINN-Y-PK | EKKNTLFRNLVALSLGLQPNFKTNF--KLSED-A---KLQ---FSKDTYEEDLEE | 277 |
| WP_002269043 | 212 | LTDK-ISKSAKKDRVLKL-F-PN | EKSNGRFAEFLKLIVGNQADFKKHF--ELEEK-A---PLQ---FSKDTYEELEV | 277 |
| WP_002269448 | 212 | LTDK-ISKSAKKDRVLKL-F-PN | EKSNGRFAEFLKLIVGNQADFKKHF--ELEEK-A---PLQ---FSKDTYEELEV | 277 |
| WP_002271977 | 212 | LTDK-ISKSAKKDRVLKL-F-PN | EKSNGRFAEFLKLIVGNQADFKKHF--ELEEK-A---PLQ---FSKDTYEELEV | 277 |
| WP_002272766 | 212 | LTDK-ISKSRRLEKLINN-Y-PK | EKKNTLEGNLIALSLGLQPNEKTNE--KLSED-A---KLQ---FSKDTYEEDLEE | 277 |
| WP_002273241 | 212 | LTDK-ISKSAKKDRVLKL-F-PN | EKSNGRFAEFLKLIVGNQADFKKHF--ELEEK-A---PLQ---FSKDTYEELEV | 277 |
| WP_002273364 | 212 | LTDK-ISKSAKKDRVLKL-F-PN | EKSNGRFAEFLKLIVGNQADFKKHF--ELEEK-A---PLQ---FSKDTYEELEV | 277 |
| WP_002275430 | 212 | LTDK-ISKSRRLINN-Y-PK | EKKNTLEGNLIALSLGLQPNEKTNE--KLSED-A---KLQ---FSKDTYEEDLEE | 277 |
| WP_002276448 | 212 | LTDK-ISKSAKKDRVLKL-F-PN | EKSNGRFAEFLKLIVGNQADFKKHF--ELEEK-A---PLQ---FSKDTYEELEV | 277 |
| WP_002277050 | 212 | LTDK-ISKSRRLEKLINN-Y-PK | EKKNTLEGNLIALSLGLQPNEKTNE--KLSED-A---KLQ---FSKDTYEEDLEE | 277 |
| WP_002277364 | 212 | LTDK-ISKSAKKDRVLKL-F-PN | EKSNGRFAEFLKLIVGNQADFKKHF--ELEEK-A---PLQ---FSKDTYEELEV | 277 |
| WP_002279025 | 212 | LTDK-ISKSAKKDRVLKL-F-PN | EKSNGRFAEFLKLIVGNQADFKKHF--ELEEK-A---PLQ---FSKDTYEELEV | 277 |
| WP_002279859 | 212 | LTEK-ISKSRRLINN-Y-PK | EKKNTLEGNLIALSLGLQPNEKTNE--KLSED-A---KLQ---FSKDTYEEDLEE | 277 |
| WP_002280230 | 212 | LTEK-ISKSAKKDRVLKL-F-PN | EKSNGRFAEFLKLIVGNQADFKKHF--ELEEK-A---PLQ---FSKDTYEELEV | 277 |
| WP_002281696 | 212 | LTDK-ISKSRRLEKLINN-Y-PK | EKKNTLEGNLIALSLGLQPNEKTNE--KLSED-A---KLQ---FSKDTYEEDLEE | 277 |
| WP_002282247 | 212 | LTDK-ISKSAKKDRVLKL-F-PN | EKSNGRFAEFLKLIVGNQADFKKHF--ELEEK-A---PLQ---FSKDTYEELEV | 277 |
| WP_002282906 | 212 | LTDK-ISKSAKKDRVLKL-F-PN | EKSNGRFAEFLKLIVGNQADFKKHF--ELEEK-A---PLQ---FSKDTYEELEV | 277 |
| WP_002283846 | 212 | LTDK-ISKSAKKDRVLKL-F-PN | EKSNGRFAEFLKLIVGNQADFKKHF--ELEEK-A---PLQ---FSKDTYEELEV | 277 |
| WP_002287255 | 212 | LTDK-ISKSAKKDRVLKL-F-PN | EKSNGRFAEFLKLIVGNQADFKKHF--ELEEK-A---PLQ---FSKDIYEELEV | 277 |
| WP_002288990 | 212 | LTDK-ISKSAKKDRVLKL-F-PN | EKSNGCFAEFLKLIVGNQADFKKHF--ELEEK-A---PLQ---FSKDIYEELEV | 277 |
| WP_002289641 | 212 | LTDK-ISKSAKKDRVLKL-F-PN | EKSNGRFAEFLKLIVGNQADFKKHF--ELEEK-A---PLQ---FSKDIYEELEV | 277 |
| WP_002290427 | 212 | LTDK-ISKSAKKDRVLKL-F-PN | EKSNGRFAEFLKLIVGNQADFKKHF--ELEEK-A---PLQ---FSKDIYEELEV | 277 |
| WP_002295753 | 212 | LTEK-ISKSRRLEKLINN-Y-PK | EKKNTLEGNLIALSLGLQPNEKTNE--KLSED-A---KLQ---FSKDIYEELEV | 277 |
| WP_002296423 | 212 | LTDK-ISKSAKKDRVLKL-F-PN | EKSNGRFAEFLKLIVGNQADFKKHF--ELEEK-A---PLQ---FSKDIYEELEV | 277 |
| WP_002304487 | 212 | LTEK-VSKSRRLENLVEC-Y-PT | EKKNTLEGNLIALSLGLQPNEKTNE--QLSED-A---KLQ---FSKDTYEDLEG | 277 |
| WP_002305844 | 212 | LTDK-ISKSAKKDRVLKL-F-PN | EKSNGRFAEFLKLIVGNQADFKKHF--ELEEK-A---PLQ---FSKDIYEELEV | 277 |
| WP_002307203 | 212 | LTDK-ISKSAKKDRVLKL-F-PN | EKSNGRFAEFLKLIVGNQADFKKHF--ELEEK-A---PLQ---LSKDIYEELEV | 277 |
| WP_002310390 | 212 | LTDK-ISKSAKKDRVLKL-F-PN | EKSNGRFAEFLKLIVGNQADFKKHF--ELEEK-A---PLQ---FSKDIYEELEV | 277 |
| WP_002352408 | 212 | LTDK-ISKSAKKDRVLKL-F-PN | EKSNGRFAEFLKLIVGNQADFKKHF--ELEEK-A---PLQ---FSKDIYEELEV | 277 |
| WP_012997688 | 212 | LTDK-ISKSAKKDRVLKL-F-PN | EKSNGRFAEFLKLIVGNQADFKKHF--ELEEK-A---PLQ---FSKDIYEELEV | 277 |
| WP_014677909 | 212 | LTDK-ISKSAKKDRVLKL-F-PN | EKSNGRFAEFLKLIVGNQADFKKHF--ELEEK-A---PLQ---FSKDIYEELEV | 277 |
| WP_019312892 | 212 | LTDK-ISKSAKKDRVLKL-F-PN | EKSNGRFAEFLKLIIGNQADFKKHF--ELEEK-A---PLQ---FSKDIYEELEV | 277 |
| WP_019313659 | 212 | LTDK-ISKSAKKDRVLKL-F-PN | EKSNGRFAEFLKLIVGNQADFKKHF--ELEEK-A---PLQ---FSKDIYEELEV | 277 |
| WP_019314093 | 212 | LTDK-ISKSAKKDRVLKL-F-PN | EKSNGRFAEFLKLIVGNQADFKKHF--ELEEK-A---PLQ---LSKDIYEELEV | 277 |
| WP_019315370 | 212 | LTEK-ISKSRRLEKLINN-Y-PK | EKKNTLEGNLIALSLGLQPNEKTNE--KLSED-A---KLQ---FSKDIYEELEV | 277 |
| WP_019803776 | 212 | LTDK-ISKSAKKDRVLKL-F-PN | EKSNGRFAEFLKLIVGNQADFKKHF--ELEEK-V---PLQ---FSKDIYEELEV | 277 |
| WP_019805234 | 212 | LTDK-ISKSAKKDRVLKL-F-PN | EKSNGRFAEFLKLIVGNQADFKKHF--ELEEK-A---PLQ---FSKDIYEELEV | 277 |
| WP_024784288 | 212 | LTDK-ISKSAKKDRVLKL-F-PN | EKSNGRFAEFLKLIVGNQADFKKHF--ELEEK-A---PLQ---FSKDIYEELEV | 277 |
| WP_024784666 | 212 | LTEK-ISKSRRLEKLINN-Y-PK | EKSNGRFAEFLKLIVGNQADFKKHF--KLSED-A---KLQ---FSKDIYEEDLEE | 277 |
| WP_024784894 | 212 | LTDK-ISKSAKKDRVLKL-F-PN | EKSNGRFAEFLKLIVGNQADFKKHF--ELEEK-A---PLQ---FSKDIYEELEV | 277 |
| WP_024786433 | 212 | LTEK-ISKSRRLEKLINN-Y-PK | EKKNTLEGNLIALSLGLQPNEKTNE--KLSED-A---KLQ---FSKDTYEEDLEE | 277 |

-continued

```
WP_049473442   212 LTDK-ISKSAKKDRVLKL-F-PN EKSNGRFAEFLKLIVGNQADFKKHF--ELEEK-A---PLQ--FSKDTYEEDLEE     277
WP_049474547   212 LTDK-ISKSAKKDRVLKL-F-PN EKSNGRFAEFLKLIVGNQADFKKHF--ELEEK-A---PLQ--FSKDTYEEELEV     277
EMC03581       205 LTDK-ISKSAKKDRVLKL-F-PN EKSNGRFAEFLKLIVGNQADFKKHF--ELEEK-A---PLQ--FSKDTYEEELEV     270
WP_000428612   213 FTDK-ISKSAKRERVLKL-F-PD EKSTGLFSEFIKLIVGNQADFKKHF--DLGEK-A---PLQ--FSKDTYDEDLEN     278
WP_000428613   213 FTDK-ISKSAKRERVLKL-F-PD EKSTGLFSEFIKLIVGNQADFKKHF--DLGEK-A---PLQ--FSKDTYDEDLEN     278
WP_049523028   212 FTDK-ISKSAKRDRVLKL-F-PD EKSTGLFSEFIKLIVGNQADFKKHF--DLGEK-A---PLQ--FSKDTYDEDLES     277
WP_003107102   181 LTEK-MSKSRRLENLIAK-I-PN QKKNTLEGNLISLSLGLTPNFKANF--ELSED-A---KLQ--ISKESFEEDLDN     246
WP_054279288   214 LTEK-ISKTRRLENLISN-I-PG QKKNGLFGNLIALSLGLTPNEKSHF--NLPED-A---KLQ--LAKDTYDELNN     279
WP_049531101   213 FTDK-ISKSTKREVLKL-F-PD   EKSTGLFSEFIKLIVGNQADFKKHF--DLEEK-A---PLQ--FSKDTYDEDLEN     278
WP_049538452   213 FSDK-ISKSAKRERVLKL-F-PD EKSTGLFSEFIKLIVGNQADFKKHF--DLEEK-A---PLQ--FSKDTYDEDLEN     278
WP_049549711   213 FTDK-ISKSAKRERVLKL-F-PD EKSTGLFSEFIKLIVGNQADFKKHF--DLGEK-A---PLQ--FSKDTYDEDLEN     278
WP_007896501   214 LTAK-TSKSKRLESLISE-F-PG QKKNGLFGNLIALALGLRPNFKSNF--GLSED-A---KLQ--ITKDTYEELDN     279
EFR44625       166 LTAK-TSKSKRLESLISE-F-PG QKKNGLFGNLIALALGLRPNFKSNF--GLSED-A---KLQ--ITKDTYEEBLDN     231
WP_002897477   212 FTDK-ISKSAKRERVLKL-F-PD EKSTGLFSEFIKLIVGNQADFKKHF--DLEEK-A---PLQ--FSKDTYDEDLEN     277
WP_002906454   213 FTDK-ISKSTKREVLKL-F-SD   EKSTGLFSEFIKLIVGNQADFKKHF--DLEEK-A---PLQ--FSKDTYDEDLEN     278
WP_009729476   213 FTDK-ISKSAKRERVLKL-F-PD EKSTGLFSEFIKLIVGNQADFKKHF--DLEEK-A---PLQ--FSKDTYDEDLEN     278
CQR24647       212 ITAK-ISKSRKVEAVLEQ-F-PD QKKNSPEGNMVSLVEGLMPNEKSNF--ELDED-A---KLQ--FSRDSYDEDLEN     277
WP_000066813   213 FTDK-ISKSTKREVLKL-F-PD   EKSTGLFSEFIKLIVGNQADFKKHF--DLEEK-A---PLQ--FSKDTYDEDLEN     278
WP_009754323   213 FTGK-ISKSVKREHVLKL-F-PD EKSTGLFSEFIKLIVGNQADFKKHF--DLEEK-A---SLQ--FSKDTYDEDLEN     278
WP_044674937   212 LVEK-VSKSRRLENLIHY-F-PN EKKNGLFGNLIALALGLQPNFKTNF--ELAED-A---KIQ--FSKETYEEDLEG     277
WP_044676715   212 LVEK-VSKSRRLENLIHY-F-PN EKKNGLFGNFITLALGLQPNFKTNF--ELAEDD-A---KIQ--FSKETYEEDLEE     277
WP_044680361   212 LVEK-VSKSRRLENLIHY-F-PN EKKNGLFGNFLALALGLQPNFKTNF--ELAED-A---KIQ--FSKETYEEDLEE     277
WP_044681799   212 LVEK-VSKSRRLENLIHY-F-PN EKKNGLFGNFIALALGLQPNFKTNF--ELGEN-A---KIQ--FSKETYEEDLEE     277
WP_049533112   212 LTEK-VSKSRRLENLIAH-Y-PA EKKNTLFGNLIALSLGLQPNEKTNF--QLSED-A---KLQ--FSKDTYEEDLEG     277
WP_029090905   172 LLDRmNRSSKVKFlIEL---TG  KQDKPILLKELFNLIVGLKAKPASIFe--QENLAactiveTM-nMSTEQVQLDLLT  243
WP_006506696   211 LKKP-LSKKAKVDEVMTL-IaPE KDYKSAFKELVTGIAGNKMNVTKMI1cEPIKQ-Gds-EIK1kFSDSNYDDQFSE    283
AIT42264       212 LSAR-LSKKSRRLENLIAQ-L-PG -KRQSLFGIFIFLTLIVGNKANFQKIF--NLEDD----iKLD--LKEEDYDENLEE   277
AKQ21048       218 FKQD-ISRSKKLDQAIAL-F-QG EKKNGLFGNLIALSLGLTPNEKSNF--DLAED-A---KLQ--LSKDTYDDDLDN     283
WP_004636532   211 LSAR-LSKSRRLENLIAQ-L-PG ENKLGNFGRFMMLIVGNTSNFKPVF--DLDDE-Y---KLK--LSDETYEEDLDT     276
WP_002364836   218 LSSK-QSRSRKHEQIMAL-F-PN -KRQSLFGIFIFLTLIVGNKANFQKIF--NLEDD----iKLD--LKEEDYDENLEE     283
WP_016631044   169 LTEK-ASRTKKSEKVLQQ-F-PQ  -----------------------MDEE-A---KIQ--LSKESYEEBLES      234
EMS75795         1  -----------------------  -----------------------MDEE-A---KIQ--LSKESYEEBLES      20
WP_002373311   218 LTEK-ASRTKKSEKVLQQ-F-PQ EKANGLFGQFIKLMVGNKADFKKVF--GLEEB-A---KI---tYASESYEEDLEG     283
WP_002378009   218 LTEK-ASRTKKSEKVLQQ-F-PQ EKANGLFGQFIKLMVGNKADFKKVF--GLEEB-A---KI---tYASESYEEDLEG     283
WP_002407324   218 LTEK-ASRTKKSEKVLQQ-F-PQ EKANGLFGQFIKLMVGNKADFKKVF--GLEEB-A---KI---tYASESYEEDLEG     283
WP_002413717   218 LTEK-ASRTKKSEKVLQQ-F-PQ EKANGLFGQFIKLMVGNKADFKKVF--GLEEB-A---KI---tYASESYEEDLEG     283
WP_010775580   218 LTEK-ASRTKKSEKVLQQ-F-PQ EKANGLFGQFIKLMVGNKADFKKVF--GLEEB-A---KIKit YASESYEEDLEG    285
WP_010818269   218 LTEK-ASRTKKSEKVLQQ-F-PQ EKANGLFGQFIKLMVGNKADFKKVF--GLEEB-A---KI---tYASESYEEDLEG     283
WP_010824395   218 LTEK-ASRTKKSEKVLQQ-F-PQ EKANGLFGQFIKLMVGNKADFKKVF--GLEEB-A---KI---tYASESYEEDLEG     283
WP_016222645   218 LTEK-ASRTKKSEKVLQQ-F-PQ EKANGLFGQFIKLMVGNKADFKKVF--GLEEB-A---KI---tYASESYEEDLEG     283
WP_033624816   218 LTEK-ASRTKKSEKVLQQ-F-PQ EKANGLFGQFIKLMVGNKADFKKVF--GLEEB-A---KI---tYASESYEEDLEG     283
WP_033625576   218 LTEK-ASRTKKSEKVLQQ-F-PQ EKANGLFGQFIKLMVGNKADFKKVF--GLEEB-A---KI---tYASESYEEDLEG     283
WP_033789179   218 LTEK-ASRTKKSEKVLQQ-F-PQ EKANGLFGQFIKLMVGNKADFKKVF--GL-EE-A---EEeA--KLQ--FSKETYEEDLEE  283
WP_002310644   217 FTEK-MSKIKKAEILLKY-F-PH EKSNGYLSQFIKLMVGNQGNFKNVF--GL-EE-A---EEeA--KLQ--FSKETYEEDLEE  281
WP_002312694   217 FTEK-MSKIKKAEILLKY-F-PH EKSNGYLSQFIKLMVGNQGNFKNVF--GL-EEeA--KLQ--FSKETYEEDLEE         282
WP_002314015   217 FTEK-MSKIKKAEILLKY-F-PH EKSNGYLSQFIKLMVGNQGNFKNVF--GL-EEeA--KLQ--FSKETYEEDLEE         282
WP_002320716   217 FTEK-MSKIKKAEILLKY-F-PH EKSNGYLSQFIKLMVGNQGNFKNVF--GL-EE-A---EEeA--KLQ--FSKETYEEDLEE  281
WP_002330729   217 FTEK-MSKIKKAEILLKY-F-PH EKSNGYLSQFIKLMVGNQGNFKNVF--GL-EEeA--KLQ--FSKETYEEDLEE         282
WP_002335161   217 FTEK-MSKIKKAEILLKY-F-PH EKSNGYLSQFIKLMVGNQGNFKNVF--GL-EEeA--KLQ--FSKETYEEDLEE         282
WP_002345439   210 LTDK-LSKIKKVEEILKY-Y-PT EKINSFFAQCLKLIVGNQANFKRIF--DLEAE-V---KLQ--FSKETYEEDLES       275
WP_034867970   217 FTEK-MSKIKKAEILLKY-F-PH EKSNGYLSQFIKLMVGNQGNFKNVF--GL-EEeA--KLQ--FSKETYEEDLEE         282
WP_047937432   217 FTEK-MSKIKKAEILLKY-F-PH EKSNGYLSQFIKLMVGNQGNFKNVF--GL-EEeA--KLQ--FSKETYEEDLEE         282
```

-continued

| | | | | |
|---|---|---|---|---|
| WP_010720994 | 210 | LTDK-LSKIKKVEEILKY-Y-PT | EKINSPFAQCLKLIVGNQANFKRIF-DLEAE-V----KLQ--FSKETYEEDLES | 275 |
| WP_010737004 | 210 | LTDK-LSKIKKVEEILKY-Y-PT | EKINSPFAQCLKLIVGNQANFKRIF-DLEAE-V----KLQ--FSKETYEEDLES | 275 |
| WP_034700478 | 210 | LTDK-LSKIKKVEEILKY-IS-PT | EKINSPFAQCLKLIVGNQANFKRIF-DLEAE-V----KLQ--FSKETYEEDLES | 275 |
| WP_007209003 | 215 | LTQQ-LSKSERADNVLKL-F-PD | EKGIGIFAQFIKLIVGNQGNFKKVF--QLEED-----qKLQ--LSTDDYEENIEN | 280 |
| WP_023519017 | 210 | LTER-LSKAKRVEKVLAY-Y-PS | EKSTGNFAQFLKLMVGNQANFKKTF-DLEEB-M---KLN--FTRDCYEEDLNE | 275 |
| WP_010770040 | 213 | FSEK-VSRARKVEAILSV-Y-SE | EKSTGTLAQFIKLMVGNGRPFKKTF--DLEED-G----IIQ--IPKEEYEEBLET | 278 |
| WP_048604708 | 209 | FADK-VSRAKKAEGVLAL-F-PD | EKRNGTFDQFLKMIVGNQGNFKKTF--ELEED-A----KIQ--FSKEEYDESLEA | 274 |
| WP_010750235 | 210 | LTDK-LSKSKKVEKILQY-Y-PK | EKTIGCLAQFIKLIVGNQGNFKQAF--HLDEE-V----KIQ--ISKETYEEDLEK | 275 |
| AII16583 | 251 | LSAR-LSKSRRLENLIAQ-L-PG | EKKNGLFGNLIALSLGLIPNEKSNF-DLAED-A----KLQ--LSKDTYDDDLDN | 316 |
| WP_029073316 | 216 | LKEP-LSKKHKADKAFAL-FdTT | KDNKAAYKELCAALAGNKENVIKMLkEAELHD-EdekDISfkFSDATFDDAFVE | 289 |
| WP_031589969 | 216 | LKEP-LSKKHKADKAFAL-FdTT | KDNKAAYKELCAALAGNKENVIKMLkEAELHD-EdekDISfkFSDATFDDAFVE | 289 |
| KDA45870 | 210 | FKDNLFSKTKLSEELLKL---SG | -KKNQLAHQLPKMMVGNMGSFKKVL--GTDEE----hKLS--FGKDTYEDDLND | 275 |
| WP_039099354 | 207 | LLDNhQSASNRQRQALLLiYtPS | KQNKAIATELLKAILGLKAKPNVLT--GIEABdVktwTLT--FNAENFDEMVK | 285 |
| AKP02966 | 209 | LIGR-GNATQKSSNILNN-F--T | KETKKLLKEVINLILGNVAHLNTIPKtsLIKDeE---KLS--FSGKDIESKLDD | 278 |
| WP_010991369 | 218 | LVEK-VTRKEKLERILKL-Y-PG | EKSAGMFAQFISLIVGSKGNFQKPF--DLIEK-S----DIE--CAKDSYEEDLES | 283 |
| WP_033838504 | 218 | LVEK-VTRKEKLERILKL-Y-PG | EKSAGMFAQFISLIVGSKGNFQKPF--DLIEK-S----DIE--CAKDSYEEDLES | 283 |
| EHN60060 | 221 | LVEK-VTRKEKLERILKL-Y-PG | EKSAGMFAQFISLIVGSKGNFQKPF--DLIEK-S----DIE--CAKDSYEEDLES | 286 |
| EFR89594 | 1 | ------LKL-Y-PG | EKSTGMFAQFISLIVGSKGNFQKPF--DLIEK-S----DIE--CAKDSYEEDLES | 52 |
| WP_038409211 | 218 | LSEK-LTRREKLDKILKL-Y-TG | EKSIGMFARFINLIIGSKGDFKKVF--DLDEK-A----EIE--CAKDIYEEDLEA | 283 |
| EFR95520 | | | | |
| WP_003723650 | 218 | LAGK-FTRREKFERILQL-Y-PG | EKSIGMFAQFMAQFISLIVGSKGNFQKVF--DLIEK-T----DIE--CAKDSYEEDLET | 283 |
| WP_003727705 | 218 | LAGK-FTRREKFERILRL-Y-PG | EKSIGMFAQFISLIVGNKGNFQKVF--NLVEK-T----DIE--CAKDSYEEDLEA | 283 |
| WP_003730785 | 218 | LAGK-FTRREKFERILRL-Y-PG | EKSIGMFAQFISLIVGNKGNFQKVF--NLVEK-T----DIE--CAKDSYEEDLEA | 283 |
| WP_003733029 | 218 | LAEK-FTRKDKLDKILSL-Y-PG | EKTIGVFAQFVNIIVGSTGKEKKHF--NLHEK-K----DIN--CAEDTYDIDLES | 283 |
| WP_003739838 | 218 | LAGK-FTRKEKLERILQL-Y-PG | EKSTGMFAQFISLIVGSKGNFQKVF--DLVEK-T----DIE--CAKDSYEEDLEA | 283 |
| WP_014601172 | 218 | LAGK-FTRKEKLERILQL-Y-PG | EKSTGMFAQFISLIVGSKGNFQKVF--DLIEK-T----DIE--CAKDSYEEDLEA | 283 |
| WP_023545432 | 218 | LAGK-FTRREKLERILQL-Y-PG | EKSTGMFAQFISLIVGSKGNFQKVF--DLIEK-T----DIE--CAKDSYEEDLEA | 283 |
| WP_031665337 | 218 | LAGK-FTRREKFERILQL-Y-PG | EKSTGMFAQFISLIVGSKGNFQKVF--DLIEK-T----DIE--CAKDSYEEDLET | 283 |
| WP_031669209 | 218 | LAEK-FTRKDKLDKILSL-Y-PG | EKTTGVFAQFVNIIVGSTGKEKKHF--NLHEK-K----DIN--CAEDTYDIDLES | 283 |
| WP_033920898 | 218 | LARK-FTRREKFERILQL-Y-PG | EKSTGMFAQFISLIVGSKGNFQKVF--DLIEK-T----DIE--CAKDSYEEDLEA | 283 |
| AKI42028 | 221 | LAGK-FTRREKFERILQL-Y-PG | EKSTGMFAQFISLIVGSKGNFQKVF--DLIEK-T----DIE--CAKDSYEEDLEA | 286 |
| AKI50529 | 221 | LARK-FTRREKFERILQL-Y-PG | EKSTGMFAQFISLIVGSKGNFQKVF--DLIEK-T----DIE--CAKDSYEEDLET | 286 |
| EFR83390 | | | | |
| WP_046323366 | 218 | FSEK-LTKREKLDKILNL-Y-PN | EKSTDLFAQFISLIIGSKGNEKKFF--NLTEK-T----DIE--CAKDSYEEDLEV | 283 |
| AKE81011 | 228 | LSAR-LSKSRRLENLIAQ-L-PG | EKKNGLEGNLIALSLGLIPNEKSNF--DLAED-A----KLQ--LSKDTYDDDLDN | 293 |
| CU082355 | 215 | LKKP-LSKKAKVDEVMAL-IsPE | KEEKSAYKELVTGIAGNKMVTKMlcESIKQ-Gds-EIKlkFSDSNYDDQFSE | 287 |
| WP_033162887 | 216 | LSKI-YQRSKKADDLLKL-MnPT | KEEKAAYKEFTKALVGLKENISKMIIaQEVKK-Gdt-DIV1eFSNANYDSTIDE | 288 |
| AGZ01981 | 245 | LSAR-LSKSRRLENLIAQ-L-PG | EKKNGLEGNLIALSLGLIPNEKSNF--DLAED-A----KLQ--LSKDTYDDDLDN | 310 |
| AKA60242 | 212 | LSAR-LSKSRRLENLIAQ-L-PG | EKKNGLEGNLIALSLGLIPNEKSNF--DLAED-A----KLQ--LSKDTYDDDLDN | 277 |
| AKS40380 | 212 | LSAR-LSKSRRLENLIAQ-L-PG | EKKNGLEGNLIALSLGLIPNEKSNF--DLAED-A----KLQ--LSKDTYDDDLDN | 277 |
| 4UN5_B | 216 | LSAR-LSKSRRLENLIAQ-L-PG | EKKNGLEGNLIALSLGLIPNEKSNF--DLAED-A----KLQ--LSKDTYDDDLDN | 281 |
| WP_010922251 | 278 | LLAQIGDQYADLFLAA[K]NLSDAILLSGILTVDDNSTKAPLSASMIKRYDEHHQDLTLLKALVRQQ-LPEKYKEIFFDQSK | 356 |
| WP_039695303 | 279 | LLGKIGDQYADLFTSAKNLYDAILLSGILTVDDNSTKAPLSASMIKRYVEHHEDLEKLKEFIKAN-KSELYHDIFKDKNK | 357 |
| WP_045635197 | 278 | LLGQIGDDFIDLFVSAKKLYDAILLSGILTVIDPSTKAPLSASMIERYENHQNDLAALKQFIKNN-LPEKYDEVFSDQSK | 356 |
| 5AXW_A | 158 | ------------------------LERLKKDG----------EVR------ | 168 |
| WP_009880683 | 1 | -------LSASMIKRYDEHHQDLTLLKAPLSASMIKRYDEHHQDLILLKALVRQQ-LPEKYKEIFFDQSK | 40 |
| WP_010922251 | 278 | LLAQIGDQYADLFLAAKNLSDAILLSDILRVNTEITKAPLSASMIKRYDEHHQDLILLKALVRQQ-LPEKYKEIFFDQSK | 356 |
| WP_011054416 | 278 | LLAQIGDQYADLFLAAKNLSDAILLSDILRVNSEITKAPLSASMIKRYDEHHQDLILLKALVRQQ-LPEKYKEIFFDQSK | 356 |
| WP_011284745 | 278 | LLAQIGDQYADLFLAAKNLSDAILLSDILRLNSEITKAPLSASMIKRYDEHHQDLILLKALVRQQ-LPEKYKEIFFDQSK | 356 |
| WP_011285506 | 278 | LLAQIGDQYADLFLAAKNLSDAILLSDILRLNSEITKAPLSASMIKRYDEHHQDLILLKALVRQQ-LPEKYKEIFFDQSK | 356 |
| WP_011527619 | 278 | LLAQIGDQYADLFLAAKNLSDAILLSDILRVNTEITKAPLSASMIKRYDEHHQDLILLKALVRQQ-LPEKYKEIFFDQSK | 356 |
| WP_012560673 | 278 | LLAQIGDQYADLFLAAKNLSDAILLSDILRVNTEITKAPLSASMIKRYDEHHQDLILLKALVRQQ-LPEKYKEIFFDQSK | 356 |

| | | | |
|---|---|---|---|
| WP_014407541 | 278 | LLAQIGDQYADLFLAAKNLSDAILLSDILRVNSEITKAPLSASMIKRYDEHHQDLILLKALVRQQ-LPEKYKEIFFDQSK | 356 |
| WP_020905136 | 278 | LLAQIGDQYADLFLAAKNLSDAILLSDILRLNSEITKAPLSASMIKRYDEHHQDLILLKALVRQQ-LPEKYKEIFFDQSK | 356 |
| WP_023080005 | 278 | LLAQIGDQYADLFLAAKNLSDAILLSDILRVNSEITKAPLSASMIKRYDEHHQDLILLKALVRQQ-LPEKYKEIFFDQSK | 356 |
| WP_023610282 | 278 | LLAQIGDQYADLFLAAKNLSDAILLSDILRVNSEITKAPLSASMIKRYDEHHQDLILLKALVRQQ-LPEKYKEIFFDQSK | 356 |
| WP_030125963 | 278 | LLAQIGDQYADLFLAAKNLSDAILLSDILRVNTEITKASLSASMIKRYDEHHQDLILLKALVRQQ-LPEKYKEIFFDQSK | 356 |
| WP_030126706 | 278 | LLAQIGDQYADLFLAAKNLSDAILLSDILRVNSEITKAPLSASMIKRYDEHHQDLILLKALVRQQ-LPEKYKEIFFDQSK | 356 |
| WP_031488318 | 278 | LLAQIGDQYADLFLAAKNLSDAILLSDILRVNSEITKAPLSASMIKRYDEHHQDLILLKALVRQQ-LPEKYKEIFFDQSK | 356 |
| WP_032460140 | 278 | LLAQIGDQYADLFLAAKNLSDAILLSDILRVNTEITKAPLSASMIKRYDEHHQDLILLKALVRQQ-LPEKYKEIFFDQSK | 356 |
| WP_032461047 | 278 | LLAQIGDQYADLFLAAKNLSDAILLSDILRVNTEITKAPLSASMIKRYDEHHQDLILLKALVRQQ-LPEKYKEIFFDQSK | 356 |
| WP_032462016 | 278 | LLAQIGDQYADLFLAAKNLSDAILLSDILRVNSEITKAPLSASMIKRYDEHHQDLILLKALVRQQ-LPEKYKEIFFDQSK | 356 |
| WP_032462936 | 278 | LLAQIGDQYADLFLAAKNLSDAILLSDILRLNSEITKAPLSASMIKRYDEHHQDLILLKALVRQQ-LPEKYKEIFFDQSK | 356 |
| WP_032464890 | 278 | LLAQIGDQYADLFLAAKNLSDAILLSDILRVNSEITKAPLSASMIKRYDEHHQDLILLKALVRQQ-LPEKYKEIFFDQSK | 356 |
| WP_033888930 | 103 | LLAQIGDQYADLFLAAKNLSDAILLSDILRVNTEITKAPLSASMIKRYDEHHQDLILLKALVRQQ-LPEKYKEIFFDQSK | 181 |
| WP_038431314 | 278 | LLAQIGDQYADLFLAAKNLSDAILLSDILRVNSEITKAPLSASMIKRYDEHHQDLILLKALVRQQ-LPEKYKEIFFDQSK | 356 |
| WP_038432938 | 278 | LLAQIGDQYADLFLAAKNLSDAILLSDILRVNSEITKAPLSASMIKRYDEHHQDLILLKALVRQQ-LPEKYKEIFFDQSK | 356 |
| WP_038434062 | 278 | LLAQIGDQYADLFLAAKNLSDAILLSDILRVNTEITKAPLSASMIKRYDEHHQDLILLKALVRQQ-LPEKYKEIFFDQSK | 356 |
| BAQ51233 | 189 | LLAQIGDQYADLFLAAKNLSDAILLSDILRVNTEITKAPLSASMIKRYDEHHQDLILLKALVRQQ-LPEKYKEIFFDQSK | 267 |
| KGE60162 | | | |
| KGE60856 | | | |
| WP_002989955 | 278 | LLAQIGDQYADLFLAAKNLSDAILLSDILRLNSEITKAPLSASMIKRYDEHHQDLILLKALVRQQ-LPEKYKEIFFDQSK | 356 |
| WP_003030002 | 278 | LLGEIGDEYADLFLFASAKNLYDAILLSGIITVDDNSTKAPLSASMVKRYEEHQDLIKKLKDFIKVN-APDQYNAIFKDKNK | 356 |
| WP_003065552 | 281 | LLGKIGDDYADLFTSAKNLYDAILLSGIILVDDNSTKAPLSASMIKRYVEHQEDLEKLKEFIKAN-KSELYHDIFKDKNK | 359 |
| WP_001040076 | 279 | LLGQIGDEFADLFSAAKKLYDSVLLSGIILTVIDLSTKAPLSASMIQRYDEHREDLKQLKQFVKAS-LPEKYQEIFADSSK | 357 |
| WP_001040078 | 279 | LLGQIGDEFADLFSAAKKLYDSVLLSGIILTVIDLSTKAPLSASMIQRYDEHREDLKQLKQFVKAS-LPEKYQEIFADSSK | 357 |
| WP_001040080 | 279 | LLGQIGDEFADLFSAAKKLYDSVLLSGIILTVIDLSTKAPLSASMIQRYDEHREDLKQLKQFVKAS-LPEKYQEIFADSSK | 357 |
| WP_001040081 | 279 | LLGQIGDEFADLFSAAKKLYDSVLLSGIILTVIDLSTKAPLSASMIQRYDEHREDLKQLKQFVKAS-LPEKYQEIFADSSK | 357 |
| WP_001040083 | 279 | LLGQIGDEFADLFSAAKKLYDSVLLSGIILTVIDLSTKAPLSASMIQRYDEHREDLKQLKQFVKAS-LPEKYQEIFADSSK | 357 |
| WP_001040085 | 279 | LLGQIGDEFADLFSAAKKLYDSVLLSGIILTVIDLSTKAPLSASMIQRYDEHREDLKQLKQFVKAS-LPEKYQEIFADSSK | 357 |
| WP_001040087 | 279 | LLGQIGDEFADLFSAAKKLYDSVLLSGIILTVIDLSTKAPLSASMIQRYDEHREDLKQLKQFVKAS-LPEKYQEIFADSSK | 357 |
| WP_001040088 | 279 | LLRQIGDEFADLFSAAKKLYDSVLLSGIILTVIDLSTKAPLSASMIQRYDEHREDLKQLKQFVKAS-LPEKYQEIFADSSK | 357 |
| WP_001040089 | 279 | LLGQIGDEFADLFSAAKKLYDSVLLSGIILTVIDLSTKAPLSASMIQRYDEHREDLKQLKQFVKAS-LPEKYQEIFADSSK | 357 |
| WP_001040090 | 279 | LLGQIGDEFADLFSAAKKLYDSVLLSGIILTVIDLSTKAPLSASMIQHYDEHREDLKQLKQFVKAS-LPEKYQEIFADSSK | 357 |
| WP_001040091 | 279 | LLGQIGDEFADLFSAAKKLYDSVLLSGIILTVIDLSTKAPLSASMIQRYDEHREDLKQLKQFVKAS-LPEKYQEIFADSSK | 357 |
| WP_001040092 | 279 | LLGQIGDEFADLFSAAKKLYDSVLLSGIILTVIDLSTKAPLSAYMIQRYDEHREDLKQLKQFVKAS-LPEKYQEIFADSSK | 357 |
| WP_001040094 | 279 | LLGQIGDEFADLFSAAKKLYDSVLLSGIILTVIDLSTKAPLSASMIQRYDEHREDLKQLKQFVKAS-LPEKYQEIFADSSK | 357 |
| WP_001040095 | 279 | LLGQIGDEFADLFSAAKKLYDSVLLSGIILTVIDLSTKAPLSASMIQRYDEHREDLKQLKQFVKAS-LPEKYQEIFADSSK | 357 |
| WP_001040096 | 279 | LLGQIGDEFADLFSAAKKLYDSVLLSGIILTVIDLSTKAPLSASMIQRYDEHREDLKQLKQFVKAS-LPEKYQEIFADSSK | 357 |
| WP_001040097 | 279 | LLGQIGDEFADLFSAAKKLYDSVLLSGIILTVIDLSTKAPLSASMIQRYDEHREDLKQLKQFVKAS-LPEKYQEIFADSSK | 357 |
| WP_001040098 | 279 | LLGQIGDEFADLFSAAKKLYDSVLLSGIILTVIDLSTKAPLSASMIQRYDEHREDLKQLKQFVKAS-LPEKYQEIFADSSK | 357 |
| WP_001040099 | 279 | LLGQIGDEFADLFSAAKKLYDSVLLSGIILTVIDLSTKAPLSASMIQRYDEHREDLKQLKQFVKAS-LPEKYQEIFADSSK | 357 |
| WP_001040100 | 279 | LLGQIGDEFADLFSAAKKLYDSVLLSGIILTVIDLSTKAPLSASMIQRYDEHREDLKQLKQFVKAS-LPEKYQEIFADSSK | 357 |
| WP_001040104 | 279 | LLGQIGDEFADLFSAAKKLYDSVLLSGIILTVIDLSTKAPLSASMIQRYDEHREDLKQLKQFVKAS-LPEKYQEIFADSSK | 357 |
| WP_001040105 | 279 | LLGQIGDEFADLFSVAKKLYDSVLLSGIILTVIDLSTKAPLSASMIQRYDEHREDLKQLKQFVKAS-LPEKYQEIFTDSSK | 357 |
| WP_001040106 | 279 | LLGQIGDEFADLFSVAKKLYDSVLLSGIILTVIDLSTKAPLSASMIQRYDEHREDLKQLKQFVKAS-LPEKYQEIFTDSSK | 357 |
| WP_001040107 | 279 | LLGQIGDEFADLFSAAKKLYDSVLLSGIILTVIDLSTKAPLSASMIQRYDEHREDLKQLKQFVKAS-LPEKYQEIFTDSSK | 357 |
| WP_001040108 | 279 | LLGQIGDEFADLFSAAKKLYDSVLLSGIILTVIDLSTKAPLSASMIQRYDEHREDLKQLKQFVKAS-LPEKYQEIFTDSSK | 357 |
| WP_001040109 | 279 | LLGQIGDEFADLFSAAKKLYDSVLLSGIILTVIDLSTKAPLSASMIQRYDEHREDLKQLKQFVKAS-LPEKYQEIFTDSSK | 357 |
| WP_001040110 | 279 | LLGQIGDEFADLFSVAKKLYDSVLLSGIILTVIDLSTKAPLSASMIQRYDEHREDLKQLKQFVKAS-LPEKYQEIFTDSSK | 357 |
| WP_015058523 | 279 | LLGQIGDEFADLFSAAKKLYDSVLLSGIILTVIDLSTKAPLSASMIQRYDEHREDLKQLKQFVKAS-LPEKYQEIFADSSK | 357 |
| WP_017643650 | 279 | LLGQIGDEFADLFSAAKKLYDSVAKKLYDSVLLSGIILTVIDLSTKAPLSASMIQRYDEHREDLKQLKQFVKAS-LPEKYQEIFTDSSK | 357 |
| WP_017647151 | 279 | LLGQIGDEFADLFSVAKKLYDSVLLSGIILTVIDLSTKAPLSASMIQRYDEHREDLKQLKQFVKAS-LPEKYQEIFTDSSK | 357 |
| WP_017648376 | 279 | LLGQIGDEFADLFSAAKKLYDSVLLSGIILTVIDLSTKAPLSASMIQRYDEHREDLKQLKQFVKAS-LPEKYQEIFADSSK | 357 |
| WP_017649527 | 279 | LLGQIGDEFADLFSAAKKLYDSVLLSGIILTVIDLSTKAPLSASMIQRYDEHREDLKQLKQFVKAS-LPEKYQEIFADSSK | 357 |

```
WP_017771611  279  LLGQIGDEFADLFSAAKKLYDSVLLSGILTVTALSGILTVIDLSTKAPLSASMIQRYDEHREDLKQLKQFVKAS-LPEKYQEIFTDSSK  357
WP_017771984  279  LLGQIGDEFADLFSAAKKLYDSVLLSGILTVIDLSTKAPLSASMIQRYDEHREDLKQLKQFVKAS-LPEKYQEIFADSSK  357
CFQ25032      279  LLGQIGDEFADLFSAAKKLYDSVLLSGILTVIDLSTKASLSDSMIQRYDEHREDLKQLKQFVKAS-LPEKYQEIFADSSK  357
CFV16040      279  LLGQIGDEFADLFSAAKKLYDSVLLSGILTVIDLSTKAPLSASMIQRYDEHREDLKQLKQFVKAS-LPEKYQEIFADSSK  357
KLJ37842      279  LLGQIGDEFADLFSAAKKLYDSVLLSGILTVIDLSTKAPLSASMIQRYDEHREDLKQLKQFVKAS-LPEKYQEIFADSSK  357
KLJ72361      279  LLGQIGDEFADLFSAAKKLYDSVLLSGILTVIDLSTKAPLSASMIQRYDEHREDLKQLKQFVKAS-LPEKYQEIFADSSK  357
KLL20707      279  LLGQIGDEFADLFSAAKKLYDSVLLSGILTVIDLSTKAPLSASMIQRYDEHREDLKQLKQFVKAS-LPEKYQEIFADSSK  357
KLL42645      279  LLGQIGDEFADLFSVAKKLYDSVLLSGILTVIDLSTKAPLSASMIQRYDEHREDLKQLKQFVKAS-LPEKYQEIFTDSSK  357
WP_047207273  279  LLGQIGDEFADLFSAAKKLYDSVLLSGILTVIDLSTKAPLSASMIQRYDEHREDLKQLKQFVKAS-LPEKYQEIFADSSK  357
WP_047209694  279  LLGQIGDEFADLFSAAKKLYDSVLLSGILTVIDLSTKAPLSASMIQRYDEHREDLKQLKQFVKAS-LPEKYQEIFADSSK  357
WP_050198062  279  LLGQIGDEFADLFSAAKKLYDSVLLSGILTVIDLSTKAPLSASMIQRYDEHREDLKQLKQFVKAS-LPEKYQEIFADSSK  357
WP_050201642  279  LLGQIGDEFADLFSAAKKLYDSVLLSGILTVIDLSTKAPLSASMIQRYDEHREDLKQLKQFVKAS-LPEKYQEIFADSSK  357
WP_050204027  279  LLGQIGDEFADLFSVAKKLYDSVLLSGILTVIDLSTKAPLSASMIQRYDEHREDLKQLKQFVKAS-LPEKYQEIFADSSK  357
WP_050881965  279  LLGQIGDEFADLFSAAKKLYDSVLLSGILTVIDLSTKAPLSASMIQRYDEHREDLKQLKQFVKAS-LPEKYQEIFADSSK  357
WP_050886065  279  LLGQIGDEFADLFSAAKKLYDSVLLSGILTVIDLSTKAPLSASMIQRYDEHREDLKQLKQFVKAS-LPEKYQEIFADSSK  357
AHN30376      279  LLGQIGDEFADLFSAAKKLYDSVLLSGILTVIDLSTKAPLSASMIQRYDEHREDLKQLKQFVKAS-LPEKYQEIFADSSK  357
EAO78426      279  LLGQIGDEFADLFSAAKKLYDSVLLSGILTVIDLSTKAPLSASMIQRYDEHREDLKQLKQFVKAS-LPEKYQEIFADSSK  357
CCW42055      279  LLGQIGDEFADLFSAAKKLYDSVLLSGILTVIDLSTKAPLSASMIQRYDEHREDLKQLKQFVKAS-LPEKYQEIFADSSK  357
WP_003041502  278  LLGEVGDEYADLFASAKNLYDAILLSGILTVDDNSTKAPLSASMVKRYEEHQDLKKFEDFIKVN-ALDQYNAIFKDKNI  356
WP_037593752  279  LLGEIGDEYADLFASAKNLYDAILLSGILAVDDNITKAPLSASMVKRYEEHQDLKKLKDFIKVN-APDQYNAIFKDKNK  357
WP_049516684  278  LLGEIGDEYADLFASAKNLYDAILLSGILAVDDNITKAPLSASMVKRYEEHQDLKKLKDFIKVN-APAQYDDIFKDETK  356
GAD46167      278  LLGEIGDEYADLFASAKNLYDAILLSGILAVDDNITKAPLSASMVKRYEEHQDLKKLKDFIKVN-APDQYNAIFKDKNK  356
WP_018363470  279  LLGQIGDDYADLFTSSKNLYDAILLSDAILLSGILAVDDNITKAPLSASMIKRYVEHHEDLEKLKEFIKAN-KSELYHDIFKDKTQ  357
WP_003043819  278  LLGQIGNQYADLFLAAKNLSDAILLSDILRSNSEVTKAPLSASMIKRYDEHHQDLALLKTLVRQQ-FPEKYAEIFKDDTK  356
WP_006269858  278  FLGEVGDEYADLFLAAKNLSDAILLSDILRVNSEITKAPLSASMIKRYDEHHQDLILLKALVRQQ-APDQYNAIFKDKNK  356
WP_048800889  278  LLGKIGDDYADLFLAAKNLSDAILLSDILRVNSEITKAPLSASMIKRYDEHHQDLILLKALVRQQ-APAQYDDIFKDETK  356
WP_012767106  278  LLAQIGNQYADLFLAAKNLSDAILLSDILRVNSEITKAPLSASMIKRYDEHHQDLILLKALVRQQ-LPEKYKEIFFDQSK  356
WP_014612333  278  LLAQIGDQYADLFLAAKNLSDAILLSDILRVNSEITKAPLSASMIKRYDEHHQDLILLKALVRQQ-LPEKYKEIFFDQSK  356
WP_015017095  278  LLAQIGDQYADLFLAAKNLSDAILLSDILRVNSEITKAPLSASMIKRYDEHHQDLILLKALVRQQ-LPEKYKEIFFDQSK  356
WP_015057649  278  LLAQIGDQYADLFLAAKNLSDAILLSDILTESDEITEAPLSASMVKRYREHHKDIVTLKTLIKDQ-LPEKYQEIFLDKTK  356
WP_048327215  278  LLAQIGDQYADLFLAAKNLSDAILLSDILTESDEITRAPLSASMVKRYREHHKDIVTLKTLIKDQ-LPEKYQEIFFDQSK  356
WP_049519324  278  LLAQIGDQYADLFLAAKNLSDAILLSDILTESDEITRAPLSASMVKRYREHHKDIVTLKTLIKDQ-LPEKYQEIFLDKTK  356
WP_012515931  278  LLAQIGDQYADLFLAAKNLSDAILLSDILTESDEITESDEITAPLSASMVKRYREHHKDIVTLKTLIKDG-LPEKYQEIFLDKTK  356
WP_021320964  278  LLAQIGDQYADLFLAAKNLSDAILLSDILTESDEITRAPLSASMVKRYREHHKDIVTLKTLIKDG-LPEKYQEIFLDKTK  356
WP_037581760  279  LLAQIGDQYADLFLAAKNLSDAILLSDILTVDDNSTKAPLSASMIKRYENHQDLAALKQFIKTN-NEDKYNEHEIFKDKSK  357
WP_004232481  279  LLGQIGDQYADLFLETAAKNLYDAILLSGILTVDDNSTKAPLSASMIKRYENHQDLAALKQFIKTN-LPEKYKEIFKDKSK  357
WP_009854540  279  LLGKIGDQYADLFLETAAKNLYDAILLSGILTVDPSTKAPLSASMIKRYENHQDLAALKQFIKNN-LPEKYKEIFKDKNK  357
WP_012962174  279  LIGKIGDDYADLFTSAKNLYDAILLSGILTVADNITKAPLSASMIKRYNEHQVDLKKLKEFIKNN-ASDKYDEIFNDKDK  357
WP_039695303  279  LLGKIGDDYADLFISAKNLYDAILLSGILTVDDNSTKAPLSASMIKRYVEHHEDLEKLKEFIKAN-KSELYHDIFKDKTK  357
WP_014334983  278  LLGKVGDDYADLFISAKNLYDAILLSGILTVDDNSTKAPLSASMIKRYVEHHEDLEKLKEFIKIN-KLKLYHDIFKDKIK  356
WP_003099269  278  LLAQIGDDYADLFIAAKKLSDAILLSDILTVKGASTKAPLSASMIKRYEEHHQDLALLKNLVKKQ-IPEKYKEIFDNKEK  356
AHY15608      278  LLAQIGDDYADLFIAAKKLSDAILLSDILTVKGASTKAPLSASMIKRYEEHHQDLALLKNLVKKQ-IPEKYKEIFDNKEK  356
AHY17476      278  LLAQIGDDYADLFIAAKKLSDAILLSDILTVKGASTKAPLSASMIKRYEEHHQDLALLKNLVKKQ-IPEKYKEIFDNKEK  356
ESR09100           ---------------------------------------------------------------------------
AGM98575      278  LLAQIGDGDYADLFIAAKKLSAKKLSAKKLFLSAKKLYDAILLSDILTVKGASTKAPLSASMWQRYEEHQDLALLKNLVKKQ-IPEKYKEIFDNKEK  356
ALF27331      278  LLSKIDEEYAALFDLAKKVYDAVLLSNILTVKEKNTKAPLSASMIKRYEEHHKDDLKAFKRFFRER-LPEKYETMEKDLTK  354
WP_018372492  276  LLVQIGGDDFIDLEVSAKKLYDAILLSGILTVTDPSTKAPLSASMIERYENHQDLAALKQFIKNN-LPEKYEVESDQSK  357
WP_045618028  279  LLGGIGDDFIDLEVSAKKLYDAILLSGILTVTDPSTKAPLSASMIERYENHQDLAALKQFIKNN-LPEKYEVESDQSK  357
WP_045635197  278  LLAQIGDNYAELFLSAKKLYDSILLSGIILLSAKKLYDSILLSGIILTVDGTKAPLSASMIQRYNEHQMDLAQLKQFIRQK-LSDKYNEVFSDVSK  356
WP_002263887  278  LLAQIGDNYAELFLSAKKLYDSILLSGIILTVDGTKAPLSASMIQRYNEHQMDLAQLKQFIRQK-KPELYHDIFKDETK  356
WP_002264920  278  LLGKIGDDYAELFLTLAKNLYDAILLSGIILTADDSSTKAPLSASMIKRYABHHEDLEKLKEFIKAN-KPELYHDIFKDETK  356
WP_002269043  278  LLAQIGDNYAELFLSAKKLYDSILLSGIILTVDVSTKAPLSASMIQRYNEHQMDLAQLKQFIRQK-LSDKYNEVFSDVSK  356
```

| | | | |
|---|---|---|---|
| WP_002269448 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002271977 | 278 | LLGKIGDDYADLFTLAKNLYDAILLSGILTADDSSTKAPLSASMIQRYNEHQMDLAQLKQFIRQK-LSDKYNEVESDVSK | 356 |
| WP_002272766 | 278 | LLGKIGDDYADLFTLAKNLYDAILLSGILTADDSSTKAPLSASMIQRYNEHQMDLAQLKQFIRQK-LSDKYNEVFSDVSK | 356 |
| WP_002273241 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002275430 | 278 | LLTQIGDNYAELFLSAKKLYDSILLSGILTVTDVSTKAPLSASMIQRYNEHQMDLAQLKQFIRQK-LSDKYNEVFSDVSK | 356 |
| WP_002276448 | 278 | LLGKIGDDYADLFTLAKNLYDAILLSGILTADDSSTKAPLSASMIKRYAEHHEDLEKLKEFIKAN-KPELYHDIFKDETK | 356 |
| WP_002277050 | 278 | LLGKIGDDYADLFTLAKNLYDAILLSGILTADDSSTKAPLSASMIKRYAEHHEDLEKLKEFIKAN-KPELYHDIFKDETK | 356 |
| WP_002277364 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002279025 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002279859 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002280230 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002281696 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002282247 | 278 | LLGKIGDDYADLFTLAKNLYDAILLSGILTVTDVSTKAPLSASMIKRYAEHHEDLEKLKEFIKAN-KPELYHDIFKDETK | 356 |
| WP_002282906 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002283846 | 278 | LLGKIGDDYADLFTLAKNLYDAILLSGILTADDSSTKAPLSASMIQRYNEHQMDLAQLKQFIRQK-LSDKYNEVFSDVSK | 356 |
| WP_002287255 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002288990 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002289641 | 278 | LLAQIGDNYAELFLSAKKLYDSILLSGILTVTDVSTKAPLSASMIQRYNEHQMDLTQLKQFIRQK-LSDKYNEVFSDVSK | 356 |
| WP_002290427 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002295753 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002296423 | 278 | LLGEIGDEYADLFASAKNLYDAILLSGILAVDDNITKAPLSASMWKRYKEHKEELAAFKRFIKEK-LPKKYEEIFKDDTK | 356 |
| WP_002304487 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002305844 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_002307203 | 278 | LLAQIGDNYAELFLSAKKLYDSILLSGILTVTDVSTKAPLSASMIQRYNEHQMDLVQLKQFIRQK-LSDKYNEVFSDVSK | 356 |
| WP_002310390 | 278 | LLAQIGDNYAELFLSAKKLYDSILLSGILTVTDVSTKAPLSASMIQRYNEHQMDLTQLKQFIRQK-LSDKYNEVFSDVSK | 356 |
| WP_002352408 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_012997688 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_014677909 | 278 | LLAQIGDNYAELFLSAKKLYDSILLSGILTVTDVGTKAPLSASMIQRYNEHQMDLAQLKQFIRQK-LSDKYNEVFSDVSK | 356 |
| WP_019312892 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_019313659 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_019314093 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_019315370 | 278 | LLAQIGDNYAELFLSAKKLYDSILLSGILTVTDVSTKAPLSASMIQRYNEHQMDLTQLKQFIRQK-LSDKYNEVFSDVSK | 356 |
| WP_019803776 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_019805234 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_024783594 | 278 | LLAQIGDNYAELFLSAKKLYDSILLSGILTVTDVSTKAPLSASMIQRYNEHQMDLAQLKQFIRQK-LSDKYNEVFSDVSK | 356 |
| WP_024784288 | 278 | LLGKIGDDYADLFTLAKNLYDAILLSGILTADDSSTKAPLSASMIKRYAEHHEDLEKLKEFIKAN-KPELYHDIFKDETK | 356 |
| WP_024784666 | 278 | LLAQIGDNYAELFLVVAKKLYDAILLAGILSVKDPGIKAPLSASMIKRYDNHQMDLSALKQFVRRN-LPEKYAEVFSDDSK | 356 |
| WP_024784894 | 278 | LLAQIGDYADLFTAAKNLSDAILLSDILVKGVNTKAPLSASMVQRFNEHQDDIKLLKLLKLLKKLVVQ-LPEKYKEIFDIKDK | 325 |
| WP_003107102 | 247 | LLTQIGDEYADLELSAKNLSDAILLVNGDGIQAPLSASLIKRYEEHRQDLALLKQMFKEQ-LPDLYRDVFIDENK | 358 |
| WP_054279288 | 280 | LLGKIGDDYADFADFLIVAKKLYDAILLSGILTVIDPSTKAPLSASLIKRYEHRQDLALLKQMFKEQ-LPDLYRDVFIDENK | 357 |
| WP_024786433 | 279 | LLGKIGDDYADFADFLIVAKKLYDAILLSGILTVIDPSTKAPLSASMIERYENHQKDLATLKQFIKTN-LPEKYDEVFSDQSK | 357 |
| WP_049531101 | 279 | LLGKIGDDYADFADFLIVAKKLYDAILLSGILTVIDPSTKAPLSASMIERYENHQKDLAVLKQFIKTN-LPEKYDEVFSDQSK | 357 |
| WP_049473442 | 279 | LLGQIGDVDYADLFVVAKKLYDAILLAGILSVKDPGIKAPLSASMIERYDNHQMDLSALKQFVRRN-LPEKYAEVFSDDSK | 356 |
| WP_049538452 | 279 | LLGQIGDDFADLFLIAKKLYDAILLSDAILLSDILLVKGVNTKAPLSASMVQRFNEHQDDIKLLKLLKLLKKLVVQ-LPEKYKEIFDIKDK | 357 |
| WP_049549711 | 279 | LLTQIGDEYADLELSAKNLSDAILLVNGDGIQAPLSASLIKRYEEHRQDLALLKQMFKEQ-LPDLYRDVFIDENK | 358 |
| WP_007896501 | 280 | LLGQIGDDFADLFLIAKKLYDAILLSDAILLSDILLVKGVNTKAPLSASMIERYONHQMDLASLKQFIKNN-LPEKYDEVFSDQSK | 357 |
| EFR44625 | 232 | LLAEIGDHYADLFADLFLAAKNLSDAILLSDILTLSDENTRAPLSASMIKRYEEHQEDLALLKLKKLVKEQ-MPEKYWEIFSNAKK | 310 |
| WP_002897477 | 278 | LLGQIGDDFADFLIAKKLYDAILLSGILTVIDPSTKAPLSASMIERYENHQKDLAALKQFIKNN-LPEKYEVFSDQSK | 356 |

-continued

| | | | |
|---|---|---|---|
| WP_002906454 | 278 | LLGQIGDGDFADLFLVAKKLYDAILLSGILTVIDPSTKAPLSASMIERYENHQEDLAAALKQFIKNN-LSEKYAEVFSDQSK | 356 |
| WP_009729476 | 279 | LLGQIGDDDFADLFLVAKKLYDAILLSGILTVINPSTKAPLSASMIERYENHQKDLASLKQFIKNN-LPEKYDEVFSDQSE | 357 |
| CQR24647 | 278 | LLGIIGDEYADVFVAAKKVYDSILLSGILTINNHSTKAPLSASMIDRYDEHNSDKKLLRDFIRTNIGKEVFKEVFYDISK | 357 |
| WP_000666813 | 279 | LLGQIGDDDFADLFLVAKKLYDAILLSGILTVKDLSTKAPLSASMIERYENHQKDLAALKQFIQNN-LQBKYDEVFSDQSK | 357 |
| WP_009754323 | 279 | LLGQIGDDDFADLFLVAKKLYDAILLSGILTVIDPSTKAPLSASMIERYENHQKDLAALKQFIKNN-LPEKYDEVFSDQSK | 357 |
| WP_044674937 | 278 | LLGKIGDDYADLFIATKSLYDGILLAGILSTIDSTIKAPLSSSMVNRYEBHKKDLALLKNFIHQM-LSDSYKEVFNDKLK | 356 |
| WP_044676715 | 278 | LLGKIGDDYADLFIATKSLYDGILLAGILSTIDSTIKAPLSSSMVNRYEBHKKDLALLKNFIHQM-LSDSYKEVFNDKLK | 356 |
| WP_044680361 | 278 | LLGKIGDDYADLFIATKSLYDGILLAGILSTIDSTIKAPLSSSMVNRYEBHQKDLALLKNFIHQM-LSDSYKEVFNDKLK | 356 |
| WP_044681799 | 278 | LLGKIGDDYADLFIATKSLYDGILLAGILSTIDSTIKAPLSSSMVNRYEBHQKDLALLKNFIHQM-LSDSYKEVFNDKLK | 356 |
| WP_049533112 | 278 | LLGEIGDEYADLFASAKNLYDAILLSGILTVDDNSTKAPLSASMVKRYEBHQKDLKKKLKDFIKVN-APDQYNAIFKDKNK | 356 |
| WP_029090905 | 244 | LADVLADEEYDLLTAQKIYSAIILDESMDGYEYFA----EAKKESYRKHQEELVLVKKMLKSNaIINDERAKF---EY | 315 |
| WP_065066696 | 284 | VEKDIGE-YVEFVDALHNVYSWELQIIMGATHTD-NASISEAMVSRYNKHHDDLKLLKDCIKNN-VPNKYFDMERNDSE | 360 |
| AIT42264 | 278 | LLAQIGDQYADLFLAAKNLSDAILLSDILRVNTEITKAPLSASMIKRYDEHHQDLILLKALVRQQ-LPEKYKEIFFDQSK | 356 |
| WP_034440723 | 284 | LLSNIDEGYRDVFLQAKNVVNAIELSKILKIDGKETKAPLSAQMVELYNQHREDLKKYKDYIKAY-LPEKYGETFKDATK | 362 |
| AKQ21048 | 278 | LLAQIGDQYADLFLAAKNLSDAILLSDILRVNTEITKAPLSASMIKRYDEHHQDLILLKALVRQQ-LPEKYKEIFFDQSK | 356 |
| WP_004636532 | 277 | LLGMTDDVFLDVFMAAKNVYDAVEMSAIISTDIGNSKAVLSNQMINFYDEHKVDLAQLKQFFKTH-LPDKYYECFSDPSK | 355 |
| WP_002364836 | 284 | ILAKVGDEYSDVFLAAKNVYDAVELSTILADSDKKSHAKLSSSMIVRFTEHQEDLKKFKRFIREN-CPDEYDNLFKNEQK | 362 |
| WP_016663104 | 235 | ILAKVGDEYSDVFLAAKNVYDAVELSTILADSDKKSHAKLSSSMIVRFTEHQEDLKKFKRFIREN-CPDEYDNLFKNEQK | 313 |
| EMS75795 | 21 | LLEKSGEEFRDVFLQAKKVYDAILLSDILSIKKQMSKAKLSLGMIERYDSHKKDLEELKQFVKAN-LPEKTAIFFKDSSK | 99 |
| WP_002373311 | 284 | ILAKVGDEYSDVFLAAKNVYDAVELSTILADSDKKSHAKLSSSMIVRFTEHQEDLKNFKRFIREN-CPDEYDNLFKNEQK | 362 |
| WP_002378009 | 284 | ILAKVGDEYSDVFLAAKNVYDAVELSTILADSDKKSHAKLSSSMIVRFTEHQEDLKNFKRFIREN-CPDEYDNLFKNEQK | 362 |
| WP_002407324 | 284 | ILAKVGDEYSDVFLAAKNVYDAVELSTILADSDKKSHAKLSSSMIVRFTEHQEDLKNFKRFIREN-CPDEYDNLFKNEQK | 362 |
| WP_002413717 | 286 | ILAKVGDEYSDVFLAAKNVYDAVELSTILADSDKKSHAKLSSSMIVRFTEHQEDLKNFKRFIREN-CPDEYDNLFKNEQK | 364 |
| WP_010775580 | 284 | ILAKVGDEYSDVFLAAKNVYDAVELSTILADSDKKSHAKLSSSMIVRFTEHQEDLKNFKRFIREN-CPDEYDNLFKNEQK | 362 |
| WP_010818269 | 284 | ILAKVGDEYSDVFLAAKNVYDAVELSTILADSDKKSHAKLSSSMIVRFTEHQEDLKNFKRFIREN-CPDEYDNLFKNEQK | 362 |
| WP_010824395 | 284 | ILAKVGDEYSDVFLAAKNVYDAVELSTILADSDKKSHAKLSSSMIVRFTEHQEDLKNFKRFIREN-CPDEYDNLFKNEQK | 362 |
| WP_016622645 | 284 | ILAKVGDEYSDVFLAAKNVYDAVELSTILADSDKKSHAKLSSSMIVRFTEHQEDLKNFKRFIREN-CPDEYDNLFKNEQK | 362 |
| WP_033624816 | 284 | ILAKVGDEYSDVFLAAKNVYDAVELSTILADSDKKSHAKLSSSMIVRFTEHQEDLKNFKRFIREN-CPDEYDNLFKNEQK | 362 |
| WP_033625576 | 284 | ILAKVGDEYSDVFLAAKNVYDAVELSTILADSDKKSYAKLSSSMIVRFTEHQEDLKNFKRFIREN-CPDEYDNLFKNEQK | 362 |
| WP_033789179 | 284 | ILAKVGDEYSDVFLAAKNVYDAVELSTILADSDKKSHAKLSSSMIVRFTEHQEDLKNFKRFIREN-CPDEYDNLFKNEQK | 362 |
| WP_002310644 | 282 | LLEKIGDDYIDLFVQAKNVYDAVLLSEILSDSTKNTRAKLSAGMIRRYDAHKEDIVLLKRFVKEN-LPKKYRAFFGDNSV | 360 |
| WP_002312694 | 283 | LLEKIGDDYIDLFVQAKNVYDAVLLSEILSDSTKNTRAKLSAGMIRRYDAHKEDIVLLKRFVKEN-LPKKYRAFFGDNSV | 361 |
| WP_002314015 | 283 | LLEKIGDDYIDLFVQAKNVYDAVLLSEILSDSTKNTRAKLSAGMIRRYDAHKEDIVLLKRFVKEN-LPKKYRAFFGDNSV | 361 |
| WP_002320716 | 282 | LLEKIGDDYIDLFVQAKNVYDAVLLSEILSDSTKNTRAKLSAGMIRRYDAHKEDIVLLKRFVKEH-IPDKYAEIFNDATK | 360 |
| WP_002330729 | 283 | LLEKIGDDYIDLFVQAKNVYDAVLLSEILSDSTKNTRAKLSAGMIRRYDAHKEDIVLLKRFVKEN-LPKKYRAFFGDNSV | 361 |
| WP_002335161 | 283 | LLEKIGDDYIDLFVQAKNVYDAVLLSEILSDSTKNTRAKLSAGMIRRYDAHKEDIVLLKRFVKEN-LPKKYRAFFGDNSV | 361 |
| WP_002345439 | 283 | LLEKIGDDYIDLFVQAKNVYDAVLLSEILSDSTKNTRAKLSAGMIRRYDAHKEDIVLLKRFVKEN-LPKKYRAFFGDNSV | 361 |
| WP_034867970 | 276 | LLGEIGDEYLDIFLQAKKVHDAILLSEIISSIVKHTKAKLSGGMVERYERHKADLAKFKQFVKEN-VPQKATVFFKDITK | 354 |
| WP_047937432 | 283 | LLEKIGDDYLDIFLQAKKVYDAVLLSEIISSIVKHTKAKLSDSTKNTRAKLSAGMIRRYDAHKEDIVLLKRFVKEN-LPKKYRAFFGDNSV | 361 |
| WP_010720994 | 276 | LLEKIGDEYLDIFLQAKKVHDAILLSEIISSIVKHTQAKLSGGMVERYERHKADLAKFKQFVKEN-VPQKATVFFKDITK | 354 |
| WP_010737004 | 276 | LLEKIGDEYLDIFLQAKKVHDAILLSEIISSIVKHTKAKLSGGMVERYERHKADLAKFKQFVKEN-VPQKATVFFKDITK | 354 |
| WP_034700478 | 276 | LLEKIGDEYLDIFLQAKKVHDAILLSEIISSIVKHTQAKLSGGMVERYERHKADLAKFKQFVKEN-VPQKATVFFKDITK | 354 |
| WP_007209003 | 281 | LLAIIGDEYGDIFVAAQNLYQAILLAGILTSTEK-TRAKLSASMIQRYEEHAKDLKLLLKQLELVRRD-LPDKYAEIFNDATK | 358 |
| WP_023519017 | 279 | LLEKTSDDYAELFLKAKGVYIDAILLSQILSKSDDETKAKLSANMKLRFEEHQRDLKQLELVRRD-LPDKYDDFFKNRSK | 354 |
| WP_017770040 | 275 | LLAIIGDEYAEIFSATKSVYDAVALSGILVIDGDTKAKLSASMVERYEAHQKDLVQFKQFIRKE-LPEMYAPIERDNSV | 353 |
| WP_048604708 | 276 | LLGEIGDEYADVFEAAKNVNAVELSGILTVIDNSTKAKLSASMIKRYEDHKIDLKLEKFIRKN-LPEKYHEIENDKNT | 354 |
| WP_010750235 | 276 | LLRKSNEEMIDVFLQVKKVYDAILLSDILSTKMKDTKAKLSAGMIERYQNHKKDLEELKQFVRAH-LHEKVIVFFKDSSK | 354 |
| AII16583 | 317 | LLAQIGDQYADLFLAAKNLSDAILLSDILSTKMKDTKAKLSAGMIERYQNHKKDLEELKQFVRAH-LPKKYKEIFFDQSK | 395 |
| WP_029073316 | 290 | KQPLLGD-CVEFIDLLHDIIYSWVELQNILGSAHTS-EPSISAAMIQRYEDHKNDLKLLKDVIRKY-LPKKYFEVERDEKS | 366 |
| WP_031589969 | 290 | KQPLLGD-CVEFIDLLHDIIYSWVELQNILGSAHTS-EPSISAAMIQRYEDHKNDLKLLKDVIRKY-LPKKYFEVERDEKS | 366 |
| KDA45870 | 276 | LLAEAGDQYLDIEVAAKKVYDAALLASILDVKDTQTKIVESQAMIERYEEHQDLIELKRVEKKY-LPEKCHDFFSE-PK | 353 |
| WP_039099354 | 286 | LESSLDDNAHQIIESLQELYSGVLLAGIVPENQSLS-----QAMITKYDDHQKHLKMLKAVREAL-APEDRQRLKQAYDQ | 359 |
| AKP02966 | 279 | LDSILDDDQFTVLDTANRIYSTITLNEIL---NGESYFSMAKVNQYENHAIDLCKLRDMWHTT----KNEKAV-GLSR | 348 |

```
WP_010991369    284  LLALIGDEYAELEVAAKNAYSAVVLSSIITVAETNAKLSASMIERPDTHEEDLGELKAFIKLH-LPKHYEEIFSNTEK   362
WP_033838504    284  LLALIGDEYAELEVAAKNAYSAVVLSSIITVAETETNAKLSASMIERPDTHEEDLGELKAFIKLH-LPKHYEEIFSNTEK  362
EHN60060        287  LLALIGDEYAELEVAAKNAYSAVVLSSIITVAETETNAKLSASMIERPDTHEEDLGELKAFIKLH-LPKHYEEIFSNTEK  365
EFR89594         53  LLALIGDEYAELEVAAKNAYSAVVLSSIITVAETNAKLSASMIERPDTHEEDLGELKAFIKLH-LPKHYEEIFSNTEK    131
WP_038409211    284  LLAKIGDEYAELEVAAKSTYNAVVLSNIITVIDETKAKLSASMIERPDKHAKDLKRLLKAFFKMQ-LPEKENEVENDIEK  362
EFR95520         -   --------------------------------------------------------------------------------  -

WP_037723650    284  LLAAIGDEYAELEVAAKNTYNAVVLSSIITVIDTETNAKLSASMIERFDAHEKDLVELKAFIKLH-LPKQYEEIFSNAAI  362
WP_003727705    284  LLAIIGDEYAELEVAAKNTYNAVVLSSIITVTATETNAKLSASMIERFDAHEKELGELKAFIKLN-LPKQYQEIENNAEI  362
WP_003730785    284  LLAIIGDEYAELEVAAKNTYNAVVLSSIITVTATETNAKLSASMIERFDAHEKELGELKAFIKLN-LPKQYQEIENNAEI  362
WP_003730229    284  LLAIIGDEYAELEVAEVEVAAKNTYNAVVLSSIITVIDSTTRAKLSASLIERFENHKEDLKKMRFVRTY-LPEKYDEIFDDTEK  362
WP_003739838    284  LLAIIGDEYAELEVAAKNTYNAVVLSNIITVIDETNAKLSASMIERFDAHEKDLSELKAFIKLH-LPKQYEEIFSNVAI   362
WP_014601172    284  LLAIIGDEYAELEVAAKNTYNAVVLSSIITVTATETNAKLSASMIERFDAHEKDLGELKAFIKLH-LPKQYEIFNNAAI   362
WP_023548323    284  LLAIIGDEYAELFVAAKNTYNAVVLSSIITVIDTETNAKLSASMIERFDAHEKDLVELKAFIKLN-LPKQYEEIFSNAAI  362
WP_031666337    284  LLAIIGDEYAELFVAAKNTYNAVVLSSIITVNDTETNAKLSASMIERFDAHEKDLVELKAFIKLN-LPKYDEIFPDDTEK  362
WP_031669209    284  LLAIIGDEFAEVFVAAKNTYNAVVLSNIITVTDSTTRAKLSASLIERFENHKEDLVELKAFIKLN-LPKQYEEIFSNAAI  362
WP_039020898    284  LLAIIGDEYAELFVAAKNTYNAVVLSNIITVTDETNAKLSASMIERFDAHEKDLVELKAFIKLN-LPKQYQEIFNNAAI   362
AKI42028        287  LLAIIGDEYAELEVAAKNTYNAVVLSSIITVTDETNAKLSASMIERFDAHEKDLGELKAFIKLH-LPKQYEIFSNVAI    365
AKI50529        287  LLAIIGDEYAELEVAAKNTYNAVVLSSIITVTDETNAKLSASMIERFDAHEKDLGELKAFIKLH-LPKQYEIFSNVAI    365
EFR83390         -   --------------------------------------------------------------------------------  -

WP_046323366    284  LLARVGDEYAEIFVAAKNAYNAVLSSIITVSNTETKAKLSASMIERFDKHDKDLKRMKAFFKVR-LPENFNEVENDVEK   362
AKE81011        294  LLAQIGDQYADLFLAAKNLSDAILLSDILRVNTEITKAPLSASMIKRYDEHHQDLTLLKALVRQQ-LPEKYKEIFFDQSK  372
CUO82355        288  VENDLGE-YVEFIDSLHNIYSWVELQTIMGATHTD-NASISEAWVSRYNKHHEDLQLLKKCIKDN-VPKKYFDMERNDSE  364
WP_033162887    289  LQSELGE-YIEFIEMLHNIYSWVELQAIIGATHTD-NPSISAAMVERYEHHKDIRVLLKKVIREE-LPDKYNEVFRKDNR  365
AGZ01981        311  LLAQIGDQYADLFLAAKNLSDAILLSDILRVNTEITKAPLSASMIKRYDEHHQDLTLLKALVRQQ-LPEKYKEIFFDQSK  389
AKA60242        278  LLAQIGDQYADLFLAAKNLSDAILLSDILRVNTEITKAPLSASMIKRYDEHHQDLTLLKALVRQQ-LPEKYKEIFFDQSK  356
AKS40380        278  LLAQIGDQYADLFLAAKNLSDAILLSDILRVNTEITKAPLSASMIKRYDEHHQDLTLLKALVRQQ-LPEKYKEIFFDQSK  356
4UN5_B          282  LLAQIGDQYADLFLAAKNLSDAILLSDILRVNTEITKAPLSASMIKRYDEHHQDLTLLKALVRQQ-LPEKYKEIFFDQSK  360
WP_010922251    357  --NGYAG YIDG G ASQEEFYKFIKPILEK-M--DGTEELLv--KLNREDLLRKQRTFDNGS IPHQIHLGEL         419

WP_039695303    358  --NGYAG YIEN G VKQDEFYKYLKNlLSK-IKiDGSDYFL--DKIEREDFLRKQRTFDNGSIPHQIHLQEM          422
WP_045635197    357  --DGYAG YIDG K TIQETFYKIKNLLSK--K-----EGTDYFL--DKIEREDFLRKQRTFDNGSIPHQIHLQEM       419
5AXW_A          169  -----G SINR -                  --TSDYVk----------------------------------EA      183
WP_009880683     41  -----G YIDG G ASQEEFYKFIKPILEK-M--DGTEELLa--KLNREDLLRKQRTFDNGSIPYQIHLGEL           103
WP_010922251    357  --NGYAG YIDG G ASQEEFYKFIKPILEK-M--DGTEELLv--KLNREDLLRKQRTFDNGSIPHQIHLGEL          419
WP_011054416    357  --NGYAG YIDG G ASQEEFYKFIKPILEK-M--DGTEELLv--KLNREDLLRKQRTEDNGSIPHQIHLGEL          419
WP_011284745    357  --NGYAG YIDG G ASQEEFYKFIKPILEK-M--DGTEELLv--KLNREDLLRKQRTFDNGSIPHQIHLGEL          419
WP_011285506    357  --NGYAG YIDG G ASQEEFYKFIKPILEK-M--DGTEELLv--KLNREDLLRKQRTFDNGSIPHQIHLGEL          419
WP_011527619    357  --NGYAG YIDG G ASQEEFYKFIKPILEK-M--DGTEELLv--KLNREDLLRKQRTFDNGSIPHQIHLGEL          419
WP_012560673    357  --NGYAG YIDG G ASQEEFYKFIKPILEK-M--DGTEELLv--KLNREDLLRKQRTFDNGSIPHQIHLGEL          419
WP_014407541    357  --NGYAG YIDG G ASQEEFYKFIKPILEK-M--DGTEELLa--KLNREDLLRKQRTEDNGSIPHQIHLGEL          419
WP_020905136    357  --NGYAG YIDG G ASQEEFYKFIKPILEK-M--DGTEELLa--KLNREDLLRKQRTFDNGSIPHQIHLGEL          419
WP_023080005    357  --NGYAG YIDG G ASQEEFYKFIKPILEK-M--DGTEELLa--KLNREDLLRKQRTFDNGSIPYQIHLGEL          419
WP_023610282    357  --NGYAG YIDG G ASQEEFYKFIKPILEK-M--DGTEELLa--KLNREDLLRKQRTFDNGSIPHQIHLGEL          419
WP_030125963    357  --NGYAG YIDG G ASQEEFYKFIKPILEK-M--DGTEELLa--KLNREDLLRKQRTEDNGSIPYQIHLGEL          419
WP_030126706    357  --NGYAG YIDG G ASQEEFYKFIKPILEK-M--DGTEELLa--KLNREDLLRKQRTFDNGSIPHQIHLGEL          419
WP_031488318    357  --NGYAG YIDG G ASQEEFYKFIKPILEK-M--DGTEELLa--KLNREDLLRKQRTFDNGSIPHQIHLGEL          419
WP_032460140    357  --NGYAG YIDG G ASQEEFYKFIKPILEK-M--DGTEELLa--KLNREDLLRKQRTEDNGSIPHQIHLGEL          419
WP_032461047    357  --NGYAG YIDG G ASQEEFYKFIKPILEK-M--DGTEELLa--KLNREDLLRKQRTFDNGSIPHQIHLGEL          419
WP_032462016    357  --NGYAG YIDG G ASQEEFYKFIKPILEK-M--DGTEELLa--KLNRKDLLRKQRTEDNGSIPHQIHLGEL          419
WP_032462936    357  --NGYAG YIDG G ASQEEFYKFIKPILEK-M--DGTEELLa--KLNREDLLRKQRTFDNGSIPHQIHLGEL          419
WP_032464890    357  --NGYAG YIDG G ASQEEFYKFIKPILEK-M--DGTEELLa--KLNREDLLRKQRTFDNGSIPHQIHLGEL          419
WP_033888930    182  --NGYAG YIDG G ASQEEFYKFIKPILEK-M--DGTEELLa--KLNREDLLRKQRTFDNGSIPHQIHLGEL          244
WP_038431314    357  --NGYAG YIDG G ASQEEFYKFIKPILEK-M--DGTEELLa--KLNREDLLRKQRTFDNGSIPHQIHLGEL          419
```

| | | | | |
|---|---|---|---|---|
| WP_038432938 | 357 | --NGYAG YIDG G | ASQEEFYKFIKPILEK-M--DGTEELLa--KLNREDLLRKQRTFDNGSIPYQIHLGEL | 419 |
| WP_038434062 | 357 | --NGYAG YIDG G | ASQEEFYKFIKPILEK-M--DGTEELLa--KLNREDLLRKQRTFDNGSIPHQIHLGEL | 419 |
| BAQ51233 | 268 | --NGYAG YIDG G | ASQEEFYKFIKPILEK-M--DGTEELLv--KLNREDLLRKQRTEDNGSIPHQIHLGEL | 330 |
| KGE60162 | | | | |
| KGE60856 | 357 | --NGYAG YIDG G | ASQEEFYKFIKPILEK-M--DGTEELLa--KLNREDLLRKQRTFDNGSIPHQIHLGEL | 419 |
| WP_002989955 | 357 | --KGYAG YIEN G | VKQDEFYKYLKGILLQ-I--NGSGDFL--DKIDREDFLRKQRTFDNGSIPHQIHLQEM | 419 |
| WP_003030002 | 360 | --NGYAG YIEN G | VKQDEFYKYLKNILSK-Ia--GSDYFL--DKIEREDFLRKQRTFDNGSIPHQIHLQEM | 422 |
| WP_003065552 | 358 | --DGYAG YIEG K | INQEAFYKYLSKLLIK-Q--EGSEYFL--EKIKNEDFLRKQRTFDNGSIPHQVHLTEL | 420 |
| WP_001040076 | 358 | --DGYAG YIEG K | INQEAFYKYLSKLLIK-Q--EDSENFL--EKIKNEDFLRKQRTFDNGSIPHQVHLTEL | 420 |
| WP_001040078 | 358 | --DGYAG YIEG K | INQEAFYKYLSKLLIK-Q--EDSENFL--EKIKNEDFLRKQRTFDNGSIPHQVHLTEL | 420 |
| WP_001040080 | 358 | --DGYAG YIEG K | INQEAFYKYLSKLLIK-Q--EDSENFL--EKIKNEDFLRKQRTFDNGSIPHQVHLTEL | 420 |
| WP_001040081 | 358 | --DGYAG YIEG K | INQEAFYKYLSKLLIK-Q--EDSENFL--EKIKNEDFLRKQRTFDNGSIPHQVHLTEL | 420 |
| WP_001040083 | 358 | --DGYAG YIEG K | INQEAFYKYLSKLLIK-Q--EDSENFL--EKIKNEDFLRKQRTFDNGSIPHQVHLTEL | 420 |
| WP_001040085 | 358 | --DGYAG YIEG K | INQEAFYKYLSKLLTK-Q--EDSENFL--EKIKNEDFLRKQRTFDNGSIPHQVHLTEL | 420 |
| WP_001040087 | 358 | --DGYAG YIEG K | TNQEAFYKYLSKLLTK-Q--EDSENFL--EKIKNEDFLRKQRTFDNGSIPHQVHLTEL | 420 |
| WP_001040088 | 358 | --DGYAG YIEG K | TNQEAFYKYLSKLLTK-Q--EDSENFL--EKIKNEDFLRKQRTFDNGSIPHQVHLTEL | 420 |
| WP_001040089 | 358 | --DGYAG YIEG K | TNQEAFYKYLSKLLTK-Q--EDSEYFL--EKIKNEDFLRKQRTFDNGSIPHQVHLTEL | 420 |
| WP_001040090 | 358 | --DGYAG YIEG K | TNQEAFYKYLSKLLTK-Q--EGSEYLL--EKIKNEDFLRKQRTFDNGSIPHQVHLTEL | 420 |
| WP_001040091 | 358 | --DGYAG YIEG K | TNQEAFYKYLSKLLTK-Q--EGSEYLL--EKIKNEDFLRKQRTFDNGSIPHQVHLTEL | 420 |
| WP_001040092 | 358 | --DGYAG YIEG K | TNQEAFYKYLSKLLTK-Q--EDSEYFL--EKIKNEDFLRKQRTFDNGSIPHQVHLTEL | 420 |
| WP_001040094 | 358 | --DGYAG YIEG K | TNQEAFYKYLSKLLTK-Q--EGSEYLL--EKIKNEDFLRKQRTFDNGSIPHQVHLTEL | 420 |
| WP_001040095 | 358 | --DGYAG YIEG K | TNQEAFYKYLSKLLTK-Q--EGSEYLL--EKIKNEDFLRKQRTFDNGSIPHQVHLTEL | 420 |
| WP_001040096 | 358 | --DGYAG YIEG K | TNQEAFYKYLSKLLTK-Q--EGSEYLL--EKIKNEDFLRKQRTFDNGSIPHQVHLTEL | 420 |
| WP_001040097 | 358 | --DGYAG YIEG K | TNQEAFYKYLSKLLTK-Q--EDSENFL--EKIKNEDFLRKQRTFDNGSIPHQVHLTEL | 420 |
| WP_001040098 | 358 | --DGYAG YIEG K | TNQGAFYKYLSKLLTK-Q--EGSEYFL--EKIKNEDFLRKQRTFDNGSIPHQVHLTEL | 420 |
| WP_001040099 | 358 | --DGYAG YIEG K | TNQEAFYKYLSKLLTK-Q--EDSEYFL--EKIKNEDFLRKQRTFDNGSIPHQVHLTEL | 420 |
| WP_001040100 | 358 | --DGYAG YIEG K | TNQEAFYKYLSKLLTK-Q--EGSEYFL--EKIKNEDFLRKQRTFDNGSIPHQVHLTEL | 420 |
| WP_001040104 | 358 | --DGYAG YIEG K | TNQEAFYKYLSKLLTK-Q--EDSENFL--EKIKNEDFLRKQRTFDNGSIPHQVHLTEL | 420 |
| WP_001040105 | 358 | --DGYAG YIEG K | TNQEAFYKYLSKLLTK-Q--EGSEYFL--EKIKNEDFLRKQRTFDNGSIPHQVHLTEL | 420 |
| WP_001040106 | 358 | --DGYAG YIEG K | TNQEAFYKYLSKLLTK-Q--EDSENFL--EKIKNEDFLRKQRTFDNGSIPHQVHLTEL | 420 |
| WP_001040107 | 358 | --DGYAG YIEG K | TNQGAFYKYLSKLLTK-Q--EDSENFL--EKIKNEDFLRKQRTFDNGSIPHQVHLTEL | 420 |
| WP_001040108 | 358 | --DGYAG YIEG K | TNQEAFYKYLSKLLTK-Q--EDSENFL--EKIKNEDFLRKQRTFDNGSIPHQVHLTEL | 420 |
| WP_001040109 | 358 | --DGYAG YIEG K | TNQGAFYKYLSKLLTK-Q--EDSENFL--EKIKNEDFLRKQRTFDNGSIPHQVHLTEL | 420 |
| WP_001040110 | 358 | --DGYAG YIEG K | TNQEAFYKYLSKLLTK-Q--EDSEYFL--EKIKNEDFLRKQRTFDNGSIPHQVHLTEL | 420 |
| WP_015058523 | 358 | --DGYAG YIEG K | TNQEAFYKYLSKLLTK-Q--EDSEYFL--EKIKNEDFLRKQRTFDNGSIPHQVHLTEL | 420 |
| WP_017643650 | 358 | --DGYAG YIEG K | TNQEAFYKYLSKLLTK-Q--EDSENFL--EKIKNEDFLRKQRTFDNGSIPHQVHLTEL | 420 |
| WP_017647151 | 358 | --DGYAG YIEG K | TNQEAFYKYLSKLLTK-Q--EGSEYFL--EKIKNEDFLRKQRTFDNGSIPHQVHLTEL | 420 |
| WP_017648376 | 358 | --DGYAG YIEG K | TNQEAFYKYLSKLLTK-Q--EDSENFL--EKIKNEDFLRKQRTFDNGSIPHQVHLTEL | 420 |
| WP_017649527 | 358 | --DGYAG YIEG K | TNQEAFYKYLSKLLTK-Q--EDSEYFL--EKIKNEDFLRKQRTFDNGSIPHQVHLTEL | 420 |
| WP_017771611 | 358 | --DGYAG YIEG K | TNQEAFYKYLSKLLTK-Q--EGSEYFL--EKIKNEDFLRKQRTFDNGSIPHQVHLTEL | 420 |
| WP_017771984 | 358 | --DGYAG YIEG K | TNQEAFYKYLSKLLTK-Q--EDSENFL--EKIKNEDFLRKQRTFDNGSIPHQVHLTEL | 420 |
| CFQ25032 | 358 | --DGYAG YIEG K | TNQEAFYKYLSKLLTK-Q--EDSEYFL--EKIKNEDFLRKQRTFDNGSIPHQVHLTEL | 420 |
| CFV16040 | 358 | --DGYAG YIEG K | TNQEAFYKYLSKLLTK-Q--EDSENFL--EKIKNEDFLRKQRTFDNGSIPHQVHLTEL | 420 |
| KLJ37842 | 358 | --DGYAG YIEG K | TNQEAFYKYLSKLLTK-Q--EDSEYFL--EKIKNEDFLRKQRTFDNGSIPHQVHLTEL | 420 |
| KLJ72361 | 358 | --DGYAG YIEG K | TNQEAFYKYLSKLLTK-Q--EDSENFL--EKIKNEDFLRKQRTFDNGSIPHQVHLTEL | 420 |
| KLL20707 | 358 | --DGYAG YIEG K | TNQEAFYKYLSKLLTK-Q--EDSENFL--EKIKNEDFLRKQRTFDNGSIPHQVHLTEL | 420 |
| KLL42645 | 358 | --DGYAG YIEG K | TNQEAFYKYLSKLLTK-Q--EGSEYFL--EKIKNEDFLRKQRTFDNGSIPHQVHLTEL | 420 |
| WP_047207273 | 358 | --DGYAG YIEG K | TNQEAFYKYLSKLLTK-Q--EDSENFL--EKIKNEDFLRKQRTFDNGSIPHQVHLTEL | 420 |
| WP_047209694 | 358 | --DGYAG YIEG K | TNQEAFYKYLSKLLTK-Q--EGSEYLL--EKIKNEDFLRKQRTFDNGSIPHQVHLTEL | 420 |
| WP_050198062 | 358 | --DGYAG YIEG K | TNQEAFYKYLSKLLTK-Q--EDSENFL--EKIKNEDFLRKQRTFDNGSIPHQVHLTEL | 420 |
| WP_050201642 | 358 | --DGYAG YIES K | TNQGAFYKYLSKLLTK-Q--EGSEYFL--EKIKNEDFLRKQRTFDNGSIPHQVHLTEL | 420 |
| WP_050204027 | 358 | --DGYAG YIEG K | TNQEAFYKYLSKLLTK-Q--EDSENFL--EKIKNEDFLRKQRTFDNGSIPHQVHLTEL | 420 |
| WP_050881965 | 358 | --DGYAG YIEG K | TNQGAFYKYLSKLLTK-Q--EDSENFL--EKIKNEDFLRKQRTFDNGSIPHQVHLTEL | 420 |

| | | | | | |
|---|---|---|---|---|---|
| WP_050886065 | 358 | --DGYAG YIEG K | TNQEAFYKYLSKLLTK-Q- | -EDSENFL- | -EKIKNEDFLRKQRTFDNGSIPHQVHLTEL | 420 |
| AHN30376 | 358 | --DGYAG YIEG K | TNQEAFYKYLSKLLTK-Q- | -EDSEYFL- | -EKIKNEDFLRKQRTFDNGSIPHQVHLTEL | 420 |
| EAO78426 | 358 | --DGYAG YIEG K | TNQEAFYKYLSKLLTK-Q- | -EDSENFL- | -EKIKNEDFLRKQRTFDNGSIPHQVHLTEL | 420 |
| CCW42055 | 358 | --DGYAG YIEG K | TNQEAFYKYLSKLLTK-Q- | -EGSEYLL- | -EKIKNEDFLRKQRTFDNGSIPHQVHLTEL | 420 |
| WP_003041502 | 357 | --KGYAG YIES G | VKQDEFYKYLKGILLQ-I- | -NGSGDFL- | -DKIDREDFLRKQRTFDNGSIPHQIHLQEM | 419 |
| WP_037593752 | 358 | --DGYAG YIES G | VEQDEFYKYLKGILLK-I- | -DGSDYFL- | -DKIDREDFLRKQRTFDNGSIPHQIHLQEM | 420 |
| WP_049516684 | 358 | --NGYAG YIEN G | VEQDEFYKYLKNTLSK-I- | -DGSDYFL- | -DKIDREDFLRKQRTFDNGSIPHQIHLQEM | 420 |
| GAD46167 | 357 | --KGYAG YIES G | VKQDEFYKYLKGILLK-I- | -NGSGDFL- | -DKIDCEDFLRKQRTFDNGSIPHQIHLQEM | 419 |
| WP_018363470 | 358 | --NGYAG YIEN G | VKQDEFYKYLKGILLTK-I- | -NGSDYFL- | -DKIEREDFLRKQRTFDNGSIPHQIHLQEM | 420 |
| WP_003043819 | 357 | --NGYAG YVGI G | ATQEEFYKFIKPILEK-M- | -DGAEELLa- | -KLNRDDLLRKQRTFDNGSIPHQIHLKEL | 429 |
| WP_006269658 | 357 | --KGYAS YIES G | VKQDEFYKYLKGILLK-I- | -NGSGDFL- | -DKIDREDFLRKQRTFDNGSIPHQIHLQEM | 419 |
| WP_048800089 | 357 | --NGYAG YIES G | VKQDEFYKYLKNTLSK-I- | -DGSGYFL- | -DKIEREDFLRKQRTFDNGSIPHQIHLQEM | 419 |
| WP_012767106 | 357 | --NGYAG YIDG G | ASQEBFYKFIKPILEK-M- | -DGTEELLa- | -DKIEREDLLRKQRTFDNGSIPHQIHLGEL | 419 |
| WP_014612333 | 357 | --NGYAG YIDG G | ASQEBFYKFIKPILEK-M- | -DGTEELLa- | -DKIEREDLLRKQRTFDNGSIPHQIHLGEL | 419 |
| WP_015017095 | 357 | --NGYAG YIDG G | ASQEBFYKFIKPILEK-M- | -DGTEELLa- | -KLNREDLLRKQRTFDNGSIPHQIHLGEL | 419 |
| WP_015057649 | 357 | --NGYAG YIDG G | ASQEBFYKFIKPILEK-M- | -DGTEELLa- | -KLNREDLLRKQRTFDNGSIPHQIHLGEL | 419 |
| WP_048327215 | 357 | --NGYAG YIDG G | ASQEBFYKFIKPILEK-M- | -DGTEELLa- | -KLNREDLLRKQRTFDNGSIPHQIHLGEL | 419 |
| WP_049519324 | 357 | --NGYAG YIDG G | ASQEBFYKFIKPILEK-M- | -DGTEELLa- | -KLNREDLLRKQRTFDNGSIPHQIHLGEL | 419 |
| WP_012515931 | 357 | --NGYAG YIEG Q | VSQEBFYKYLKPILAR-L- | -DGSEPLLl- | -KIDREDFLRKQRTEDNGSIPHQIHLEEL | 419 |
| WP_021320964 | 357 | --NGYAG YIEG Q | VSQEBFYKYLKPILAR-L- | -DGSEPLLl- | -KIDREDFLRKQRTFDNGSIPHQIHLEEL | 419 |
| WP_037581760 | 357 | --NGYAG YIEG Q | VSQEBFYKYLKPILAR-L- | -DGSEPLLl- | -KIDREDFLRKQRTFDNGSIPHQIHLEEL | 419 |
| WP_004232481 | 357 | --NGYAG YIEN G | VKQDIFYKHLKSIISE-K- | -NGGQYFL- | -DKIEREDFLRKQRTFDNGSIPYQIHLQEM | 419 |
| WP_009854540 | 358 | --NGYAG YIDG G | VKQDEFYKYLKNTLSK-I- | -DGSDYFL- | -DKIEREDFLRKQRTFDNGSIPHQIHLQEM | 420 |
| WP_012962174 | 357 | --NGYAG YIEN G | VKQDEFYKYLKNILSK-I- | -IkIDGSDYFL- | -DKIEREDFLRKQRTFDNGSIPHQIHLQEM | 422 |
| WP_039695303 | 358 | --NGYAG YIDN G | VKQDEFYKYLKTLLTK-I- | -DDDSDYFL- | -DKIEREDDFLRKQRTFDNGSIPHQIHLNEL | 419 |
| WP_014334983 | 357 | --NGYAG YIDG T | TSQEBFYKYLKPILLK-L- | -DGTEKLIs- | -KLEREDFLRKQRTFDNGSIPHQIHLNEL | 419 |
| WP_003092269 | 357 | --NGYAG YIDG T | TSQEBFYKYLKPILLK-L- | -DGTEKLIs- | -KLEREDFLRKQRTFDNGSIPHQIHLNEL | 419 |
| AHY15608 | 357 | --NGYAG YIDG T | TSQEBFYKYLKPILLK-L- | -DGTEKLIs- | -KLERCNDFLRKQRTEDNGSIPHQIHLNEL | 419 |
| AHY17476 | 357 | --NGYAG YIDG T | TSQEBFYKYLKPILLK-L- | -DGTEKLIs- | -KLERCNDFLRKQRTEDNGSIPHQIHLNEL | 419 |
| ESR09100 | | | | | | |
| AGM98575 | 357 | --NGYAG YIDG K | TSQEBFYKYIKPILLK-L- | -DGTEKLIs- | -KLEREDFLRKQRTEDNGSIPHQIHLNEL | 419 |
| ALF27331 | 357 | --DGYAG YIDG K | TNQEAFYKYLKGILLNK-I- | -EGSGYFL- | -DKIEREDFLRKQRTEDNGSIPHQIHLQEM | 419 |
| WP_018372492 | 355 | --PSYAA YVSG A | VTEDDFYKFSKGLLID-V- | -EGAEYFL- | -EKIERRDFLRKQRTFDNGAIPNQVHVKEL | 432 |
| WP_045618028 | 358 | --DGYAG YIDG K | TTQETFYKYIKNLLSK-L- | -EGADYFL- | -EGIDYFLN- | -DKIEREDFLRKQRTEDNGSIPHQIHLQEM | 420 |
| WP_045635197 | 357 | --DGYAG YIDG K | TTQETFYKYIKNLLSK-F- | -EGIDYFL- | -DKIEREDFLRKQRTEDNGSIPHQIHLQEM | 419 |
| WP_002263549 | 357 | --DGYAG YIDG K | TNQEAFYKYLKGLLNK-I- | -EGSGYFL- | -DKIEREDFLRKQRTEDNGSIPHQIHLQEM | 419 |
| WP_002263887 | 357 | --DGYAG YIDG K | TNQEAFYKYLKGLLNK-I- | -EGSGYFL- | -DKIEREDFLRKQRTEDNGSIPHQIHLQEM | 419 |
| WP_002264920 | 357 | --NGYAG YIEN G | VKQDEFYKYLKNTLSK-I- | -AGSGDYFL- | -DKIEREDFLRKQRTEDNGSIPHQIHLQEM | 419 |
| WP_002269043 | 357 | --DGYAG YIDG K | TNQEAFYKYLKGLLNK-I- | -EGSGYFL- | -DKIEREDFLRKQRTEDNGSIPHQIHLQEM | 419 |
| WP_002269448 | 357 | --DGYAG YIDG K | TNQEAFYKYLKGLLNK-I- | -EGSGYFL- | -DKIEREDFLRKQRTEDNGSIPHQIHLQEM | 419 |
| WP_002271977 | 357 | --DGYAG YIDG K | TNQEAFYKYLKGLLNK-I- | -EGSGYFL- | -DKIEREDFLRKQRTEDNGSIPHQIHLQEM | 419 |
| WP_002272766 | 357 | --DGYAG YIDG K | TNQEAFYKYLKGLLNK-I- | -EGSGYFL- | -DKIEREDFLRKQRTEDNGSIPHQIHLQEM | 419 |
| WP_002273241 | 357 | --DGYAG YIDG K | TNQEAFYKYLKGLLNK-I- | -EGSGYFL- | -DKIEREDFLRKQRTEDNGSIPHQIHLQEM | 419 |
| WP_002275430 | 357 | --DGYAG YIDG K | TNQEAFYKYLKGLLNK-I- | -EGSGYFL- | -DKIEREDFLRKQRTEDNGSIPHQIHLQEM | 419 |
| WP_002276448 | 357 | --DGYAG YIDG K | TNQEAFYKYLKGLLNK-I- | -EGSGYFL- | -DKIEREDFLRKQRTEDNGSIPHQIHLQEM | 419 |
| WP_002277050 | 357 | --NGYAG YIEN G | VKQDEFYKYLKNTLSK-I- | -AGSGDYFL- | -DKIEREDFLRKQRTEDNGSIPHQIHLQEM | 419 |
| WP_002277364 | 357 | --DGYAG YIDG K | TNQEAFYKYLKGLLNK-I- | -EGSGYFL- | -DKIEREDFLRKQRTEDNGSIPHQIHLQEM | 419 |
| WP_002279025 | 357 | --DGYAG YIDG K | TNQEAFYKYLKGLLNK-I- | -EGSGYFL- | -DKIEREDFLRKQRTEDNGSIPHQIHLQEM | 419 |
| WP_002279859 | 357 | --DGYAG YIDG K | TNQEAFYKYLKGLLNK-I- | -EGSGYFL- | -DKIEREDFLRKQRTEDNGSIPHQIHLQEM | 419 |
| WP_002280230 | 357 | --NGYAG YIEN G | VKQDEFYKYLKNTLSK-I- | -TGSDYFL- | -DQIEREDFLRKQRTEDNGSIPHQIHLQEM | 419 |
| WP_002281696 | 357 | --DGYAG YIDG K | TNQEAFYKYLKGLLNK-I- | -EGSGYFL- | -DKIEREDFLRKQRTEDNGSIPHQIHLQEM | 419 |
| WP_002282247 | 357 | --NGYAG YIEN G | VKQDEFYKYLKNTLSK-I- | -TGSDYFL- | -DQIEREDFLRKQRTEDNGSIPHQIHLQEM | 419 |
| WP_002282906 | 357 | --DGYAG YIDG K | TNQEAFYKYLKGLLNK-I- | -EGSGYFL- | -DKIEREDFLRKQRTEDNGSIPHQIHLQEM | 419 |

```
-continued

WP_002283846   357  --DGYAG YIDG K TNQEAFYKYLKGLLNK-I--EGSGYFL--DKIEREDFLRKQRTEDNGSIPHQIHLQEM  419
WP_002287255   357  --DGYAG YIDG K TNQEAFYKYLKGLLNK-I--EGSGYFL--DKIEREDFLRKQRTEDNGSIPHQIHLQEM  419
WP_002288990   357  --DGYAG YIDG K TNQEAFYKYLKGLLNK-I--EGSGYFL--DKIEREDFLRKQRTEDNGSIPHQIHLQEM  419
WP_002289641   357  --DGYAG YIDG K TNQEAFYKYLKGLLNK-I--EGSGYFL--DKIEREDFLRKQRTEDNGSIPHQIHLQEM  419
WP_002290427   357  --DGYAG YIDG K TNQEAFYKYLKGLLNK-I--EGSGYFL--DKIEREDFLRKQRTEDNGSIPHQIHLQEM  419
WP_002295753   357  --DGYAG YIDG K TNQEAFYKYLKGLLNK-I--EGSGYFL--DKIEREDFLRKQRTEDNGSIPHQIHLQEM  419
WP_002296423   357  --DGYAG YIDG K TNQEAFYKYLKGLLNK-I--EGSGYFL--DKIEREDFLRKQRTEDNGSIPHQIHLQEM  419
WP_002304487   357  --NGYAG YVGA D ATEEEFYKVKGILNK-V--EGADVWL--DKIDREDFLRKQRTEDNGSIPHQIHLQEM  429
WP_002305844   357  --DGYAG YIDG K TNQEAFYKYLKGLLNK-I--EGSGYFL--DKIEREDFLRKQRTEDNGSIPHQIHLQEM  419
WP_002307203   357  --DGYAG YIDG K TNQEAFYKYLKGLLNK-I--EGSGYFL--DKIEREDFLRKQRTEDNGSIPHQIHLQEM  419
WP_002310390   357  --DGYAG YIDG K TNQEAFYKYLKGLLNK-I--EGSGYFL--DKIEREDFLRKQRTEDNGSIPHQIHLQEM  419
WP_002352408   357  --DGYAG YIDG K TNQEAFYKYLKGLLNK-I--EGSGYFL--DKIEREDFLRKQRTEDNGSIPHQIHLQEM  419
WP_012997688   357  --DGYAG YIDG K TNQEAFYKYLKGLLNK-I--EGSGYFL--DKIEREDFLRKQRTEDNGSIPHQIHLQEM  419
WP_014677909   357  --DGYAG YIDG K TNQEAFYKYLKGLLNK-I--EGSGYFL--DKIEREDFLRKQRTEDNGSIPHQIHLQEM  419
WP_019312892   357  --DGYAG YIDG K TNQEAFYKYLKGLLNK-I--EGSGYFL--DKIEREDFLRKQRTEDNGSIPHQIHLQEM  419
WP_019313659   357  --DGYAG YIDG K TNQEAFYKYLKGLLNK-I--EGSGYFL--DKIEREDFLRKQRTEDNGSIPHQIHLQEM  419
WP_019314093   357  --DGYAG YIDG K TNQEAFYKYLKGLLNK-I--EGSGYFL--DKIEREDFLRKQRTEDNGSIPHQIHLQEM  419
WP_019315370   357  --DGYAG YIDG K TNQEAFYKYLKGLLNK-I--EGNGYFL--DKIEREDFLRKQRTEDNGSIPHQIHLQEM  419
WP_019803776   357  --DGYAG YIDG K TNQEAFYKYLKGLLNK-I--EGSGYFL--DKIEREDFLRKQRTEDNGSIPHQIHLQEM  419
WP_019805234   357  --DGYAG YIDG K TNQEAFYKYLKGLLNK-I--EGSGYFL--DKIEREDFLRKQRTEDNGSIPHQIHLQEM  419
WP_024783594   357  --DGYAG YIDG K TNQEAFYKYLKGLLNK-I--EGSGYFL--DKIEREDFLRKQRTEDNGSIPHQIHLQEM  419
WP_024784288   357  --NGYAG YIEN G VKQDEFYKYLKNTLSK-I--TGSDYFL--DQIEREDFLRKQRTEDNGSIPHQIHLQEM  419
WP_024784666   357  --DGYAG YIDG K TNQEAFYKYLKGLLNK-I--EGSGYFL--DKIEREDFLRKQRTEDNGSIPHQIHLQEM  419
WP_024784894   357  --DGYAG YIDG K TNQEAFYKYIKNLISK-I--EGSGYFL--EKIEREDFLRKQRTEDNGSIPHQIHLQEM  419
WP_024786433   357  --NGYAG YIEN G VKQDEFYKYIKNTLSK-I--AGSDYFL--DKIEREDFLRKQRTEDNGSIPHQIHLQEM  419
WP_049473442   357  --DGYAG YIDG K TNQEAFYKYLKGLLNK-I--EGSGYFL--DKIEREDFLRKQRTEDNGSIPHQIHLQEM  419
WP_049474547   350  --DGYAG YIDG K TNQEAFYKYLKGLLNK-I--EGSGYFL--DKIEREDFLRKQRTEDNGSIPHQIHLQEM  412
EMC03581       358  --EGYAG YIDS G TSQEDFYKYIKPILET-L--DGAEDFLt--KINRDFLRKQRTEDNGSIPHQIHLGEL  420
WP_000428612   358  --DGYAG YVDG K TSQEDFYKYIKNLLSK-F--DGADYLL--DGADYFL--EGADYFL--DKIEREDFLRKQRTEDNGSIPHQIHLQEM  420
WP_000428613   358  --DGYAG YIDG K TTQEAFYKYIKNLLSK-F--EGADYFL--DKIEREDFLRKQRTEDNGSIPHQIHLQEM  420
WP_049523028   357  --DGYAG YIDG K TTQEGFYKYIKNLISK-F--EGTDYFL--EKIEREDFLRKQRTEDNGSIPHQIHLQEM  419
WP_003107102   326  --NGYAG YING K TTQEDFYKYIKNLLSK-L--KGAESLIs--KLEREDFLRKQRTEDNGSIPHQIHLNEL  388
WP_054279288   359  --DGYAG YISG K TSQEDFYKYIKPILSR-L--DGADYLL--DGADYLL--DKIEREDFLRKQRTEDNGSIPHQIHLGEL  421
WP_049531101   358  --EGYAG YIDS K TSQEDFYKYIKNLLSK-F--EGADYFL--EKIEREDFLRKQRTEDNGSIPHQIHLQEM  420
WP_049538452   357  --DGYAG YVDG K TTQEAFYKYIKNLLSK-F--EGADYFL--DKIEREDFLRKQRTFDNGSIPHQVHLDEM  419
WP_049549711   358  --DGYAG YIEG K TTQEAFYKYIKNLLSK-F--EGADYFL--NKIEREDFLRKQRTEDNGSIPHQIHLQEM  420
WP_007896501   359  --NGYAG YIEG K VSQEDFYRYIKPILSR-L--KGGDEFLa--KIDRDDFLRKQRTEDNGSIPHQIHLKEL  421
EFR44625       311  --NGYAG YIEG K VSQEDFYRYIKPILSR-L--KGGDEFLa--KIDRDDFLRKQRTEDNGSIPHQIHLKEL  373
WP_002897477   357  --DGYAG YIDG K TTQEAFYKYIKNLLSK-F--EGADYFL--DKIEREDFLRKQRTEDNGSIPHQIHLKEL  419
WP_002906454   357  --DGYAG FIDG K TTQEAFYKYIKNLLSK-L--EGADYFL--NKIEREDFLKKQRTEDNGSIPHQIHLQEM  419
WP_009729476   358  --DGYAG YIDG K TTQETFYKYIKNLLSK-F--EGADYFL--DKIEREDFLRKQRTEDNGSIPHQIHLQEM  420
CQR24647       358  --NGYAG YIDG K TNQEDFYKYIKNLLQK-V--DGGDYFL--EKIEREDFLRKQRTEDNGSIPHQVHLDEM  420
WP_000066813   358  --DGYAG YIDG K TTQEAFYKYIKNLLSK-F--EGADYFL--DKIEREDFLRKQRTEDNGSIPHQIHLQEM  420
WP_009754323   358  --DGYAG YIEG K TTQEAFYKYIKKAIEK-I--EGSDYFI--DKIEREDFLRKQRTEDNGSIPHQIHLQEM  420
WP_044674937   357  --DGYAG YIEG K TTQENFYRFIKKAIEK-I--EGSDYFI--DKIEREDFLRKQRTEDNGSIPHQIHLQEM  419
WP_044676715   357  --DGYAG YIEG K TTQENFYRFIKKAIEK-I--EGSNYFI--DKIEREDFLRKQRTEDNGSIPHQIHLQEM  419
WP_044680361   357  --DGYAG YIEG K TTQENFYRFIKKAIEK-I--EGSNYFI--DKIDREDFLRKQRTEDNGSIPHQIHLQEM  419
WP_044681799   357  --DGYAG YIEG K TTQENFYRFIKKAIEK-I--EGSDYFI--DKIDREDFLRKQRTEDNGSIPHQIHLQEM  419
WP_049533112   357  --KGYAG YIEN G VKQDEFYKYLKGILLQ-I--NGSGDFL--DKIDREDFLRKQRTEDNGSIPHQIHLQEM  419
WP_029090905   316  fYIDYIG YBES K SKEERLEKHIELLLAKeNvlTTVEHALleKNITFASLLPLQRSSRNAVIPYQVHEKEL  403
WP_006506696   361  ksKGYYN YINR K APVDEFYKYVKKCIEK-VdtPEAKQIln--DIELENFLLKQNSRINGSVPYQMQLDEM  429
AIT42264       357  --NGYAG YIDG G ASQEEFYKFIKPILEK-M--DGTEELLv--KLNREDLLRKQRTEDNGSIPHQIHLGEL  419
WP_034440723   363  --NGYAG YIDG K TSQEDFYKFVKAQLKG---eENGEYFL--EAIENENFLRKQRSFYNGVIPYQIHLQEL  425
```

```
AKQ21048       357  --NGYAG YIDG G ASQEBFYKFIKPLEK-M-DGTEELLv--KLNREDLLRKQRTEDNGSIPHQIHLGEL    419
WP_004636532   356  --NGYAG YIDG K TNQEDFYKYIEKVMKT-IksDKKDYFL--DKIDREVFLRKQRSFYNSVIPHQIHLQEM    420
WP_002364836   363  --DGYAG YIAH A VSQLKFYQVVKKIIQD-I-AGAEYFL--EKIAQENFLRKQRTFDNGVIPHQIHLAEL    427
WP_016631044   314  --DGYAG YIAH A VSQLKFYQVVKKIIQD-I-AGAEYFL--EKIAQENFLRKQRTEDNGVIPHQIHLAEL    378
EMS75795       100  --NGYAG YIDG K TTQEDFYKFPLKKELNG-I-AGSERFM--EKVDQENFLLKQRTANGVIPHQVHLTEL    162
WP_002373311   363  --DGYAG YIAH A VSQLKFYQVVKKIIQD-I-AGAEYFL--EKIAQENFLRKQRTFDNGVIPHQIHLAEL    427
WP_002378009   363  --DGYAG YITH A VSQLKFYQVVKKIIQD-I-AGAEYFL--EKIAQENFLRKQRTFDNGVIPHQIHLAEL    427
WP_002407324   363  --DGYAG YITH A VSQLKFYQVVKKIIQD-I-AGAEYFL--EKIAQENFLRKQRTFDNGVIPHQIHLAEL    427
WP_002413717   363  --DGYAG YIAH A VSQLKFYQVVKKIIQD-I-AGAEYFL--EKIAQENFLRKQRTFDNGVIPHQIHLAEL    427
WP_010775580   365  --DGYAG YIAH A VSQLKFYQVVKKIIQD-I-AGAEYFL--EKIAQENFLRKQRTFDNGVIPHQIHLAEL    429
WP_010818269   363  --DGYAG YIAH A VSQLKFYQVVKKIIQD-I-AGAEYFL--EKIAQENFLRKQRTFDNGVIPHQIHLAEL    427
WP_010824395   363  --DGYAG YIAH A VSQLKFYQVVKKIIQD-I-AGAEYFL--EKIAQENFLRKQRTFDNGVIPHQIHLAEL    427
WP_016622645   363  --DGYAG YIAH A VSQLKFYQVVKKIIQD-I-AGAEYFL--EKIAQENFLRKQRTFDNGVIPHQIHLAEL    427
WP_033624816   363  --DGYAG YIAH A VSQLKFYQVVKKIIQD-I-AGAEYFL--EKIAQENFLRKQRTFDNGVIPHQIHLAEL    427
WP_033625576   363  --DGYAG YIAH A VSQLKFYQVVKKIIQD-I-AGAEYFL--EKIAQENFLRKQRTFDNGVIPHQIHLAEL    427
WP_033789179   363  --DGYAG YIAH A VSQLKFYQVVKKIIQD-I-AGAEYFL--EKIAQENFLRKQRTFDNGVIPHQIHLAEL    427
WP_002310644   361  --NGYAG YIEG H ATQEDFYKFVKKELTG-I-RGSEVFL--TKIEQENFLRKQRTFDNGVIPHQIHLTEL    423
WP_002112694   362  --NGYAG YIEG H ATQERAFYKFVKKELTG-I-RGSEVFL--TKIEQENFLRKQRTFDNGVIPHQIHLSEL    424
WP_002314015   362  --NGYAG YIEG H ATQEDFYKFVKKELTG-I-RGSEVFL--TKIEQENFLRKQRTFDNGVIPHQIHLTEL    424
WP_002320716   362  --NGYAG YIEG H ATQEDFYKFVKKELTG-I-RGSEVFL--TKIEQENFLRKQRTFDNGVIPHQIHLTEL    424
WP_002330729   361  --NGYAG YIEG H ATQEDFYKFVKKELTG-I-RGSEVFL--TKIEQENFLRKQRTFDNGVIPHQIHLTEL    423
WP_002335161   362  --NGYAG YIEG H ATQEDFYKFVKKELTG-I-RGSEVFL--TKIEQENFLRKQRTFDNGVIPHQIHLTEL    424
WP_002345439   362  --NGYAG YIEG H ATQEDFYKFVKKELSG-V-VGSEPFL--EKIDQETFLLKQRTYINGVIPHQVHLIEL    424
WP_034867970   355  --NGYAG YIEG H ATQEDFYKFVKKELTG-I-RGSEVFL--TKIEQENFLRKQRTFDNGVIPHQIHLTEL    417
WP_047937432   362  --NGYAG YIEG H ATQEDFYKFVKKELSG-V-VGSEPFL--EKIDQETFLLKQRTYINGVIPHQVHLIEL    424
WP_010720994   355  --NGYAG YIKG K TIQEBFYKFVKKELSG-V-VGSEPFL--EKIDQETFLLKQRTYINGVIPHQVHLIEL    417
WP_010733664   355  --NGYAG YIKG K TIQEEFYKFVKKELSG-V-VGSEPFL--EKIDQETFLLKQRTYINGVIPHQVHLIEL    417
WP_034700478   355  --NGYAG YIKG K TIQEEFYKFVKKELSG-V-VGSEPFL--EKIDQETFLLKQRTYINGVIPHQVHLIEL    417
WP_007209003   359  --NGYAG YIDG K TKEEBFYKYLKTTLVQ---kSGYQYFI--EKIEQEHFLRKQRIYDNGVIPHQVHAEEL    421
WP_023519017   355  --NGYAG YVKG K ATQEDFYKFLRTELAG-L-EESQSIM--EKIDLEIYLLKQRTFANGVIPHQIHLVEM    417
WP_010770040   358  --SGYAG YVEN S VTQABFYKYLRTELKAIEK-V-PGAEYFL--EKIEQBTFLDKQRTENNGVIPHQIHLEEL    422
WP_048604708   354  --DGYAG YIDN S ISQREFYKYITNLIEK-I-DGAEYFL--KKIENEDFLLKQRTEDNGIIPHQVHLKEL    418
WP_010750235   355  --DGYAG YIDG K TTQADFYKFLKKELTG-V-PGSEPML--AKIDQCENFLLKQRTPINGVIPHQVHLTEF    417
AII16583       396  --NGYAG YIDG G ASQEBFYKFIKPILEK-M-DGTEELLv--KLNREDLLRKQRTEDNGSIPHQIHLGEL    458
WP_029073316   367  kkNNYCN YINH K TPVDEFYKYIKKLIEK-IqdPDVKTILn--KIELESFMLKQNSRINGAVPYQMQLDEL    435
WP_031589969   367  kkNNYCN YINH K TPVDEFYKYIKKLIEK-IqdPDVKTILn--KIELESFMLKQNSRINGAVPYQMQLDEL    435
KDA45870       354  -iSGYAG YINH K VSEEDFYKYIKKILKG-I--PETEELq--KIDANNYLRKQRTEDNGIAIPHQVHLKEL    417
WP_039099354   360  ------- YVDG K -SKEDFYGDITKALKNnPqhPIVSEIKk--LIELDQFMPKQRTKDNGAIPHQLHQQEL    425
AKP02966       349  ------- YINK K ---KELYISLKKELKVaLp-INLAKEAe--EKISKGTYLVKPRNSENGVVPYQLNKIEM   415
WP_010991369   363  --QAYDD YINK K TKQADFYKYMKMTLEN-I-EGADYFI--AKIEKENFLRKQRTFDNGAIPHQLHLEEL    425
WP_033838504   363  --HGYAG YIDG I TKQADFYKYMKMTLEN-I-EGADYFI--AKIEKENFLRKQRTFDNGAIPHQLHLEEL    425
EHN60060       366  --HGYAG YIDG I TKQADFYKYMKMTLEN-I-EGADYFI--AKIEKENFLRKQRTFDNGAIPHQLHLEEL    428
EFR89594       132  --HGYAG YIDG I TKQADFYKYMKTTLEN-I-EGADYFI--AKIEKENFLRKQRTFDNGAIPHQLHLEEL    194
WP_038409211   363  --HGYAG YIDG I TIQEKFYKYMKMLAN-I-DGADYFI--DQIEEENFLRKQRTFDNGTIPHQLHLEEL    425
EFR95520       1    ------- ---- - ---MKKMLAN-I-DGADYFI--DQIEEENFLRKQRTFDNGTIPHQLHLEEL    44
WP_003723650   363  --DGYAG YIDG I TKQVDFYKYLKTTILEN-I-EGSDYFI--AKIEEENFLRKQRTFDNGAIPHQLHLEEL    425
WP_003727705   363  --DGYAG YIDG I TKQVDFYKYLKTTLLEN-V-EGADYFI--TKIEEENFLRKQRTFDNGAIPHQLHLEEL    425
WP_003730785   363  --DGYAG YIDG I TKQVDFYKYLKTTLLEN-V-EGADYFI--AKIEEENFLRKQRTFDNGAIPHQLHLEEL    425
WP_003733029   363  --HGYAG YISG I TKQADFYKYMKATLEK-I-EGADYFI--AKIEEENFLRKQRTFDNGVIPHQLHLEEL    425
WP_003739838   363  --DGYAG YIDG I TKQVDFYKYLKTILEN-I-EGADYFI--AKIEEENFLRKQRTFDNGAIPHQLHLEEL    425
WP_014601172   363  --DGYAG YIDG I TKQVDFYKYLKTILEN-I-EGADYFI--AKIEEENFLRKQRTFDNGAIPHQLHLEEL    425
WP_023548323   363  --DGYAG YIDG I TKQVDFYKYLKTTLLEN-V-EGADYFI--TKIEEENFLRKQRTFDNGVIPHQLHLEEL    425
WP_031665337   363  --DGYAG YIDG I TKQVDFYKYLKTILEN-I-EGSDYFI--AKIEEENFLRKQRTFDNGAIPHQLHLEEL    425
```

-continued

```
WP_031669209  363  --HGYAG YISG - TKQADFYKYKMKATLEK-I--EGADYFI--AKIEEENFLRKQRTFDNGVIPHQLHLEEL                                    425
WP_033920898  363  --DGYAG YIDG - TKQVDFYKYLKTILEN-I--EGADYFI--AKIEEENFLRKQRTFDNGAIPHQLHLEEL                                    425
AKI42028      366  --DGYAG YIDG - TKQVDFYKYLKTILEN-I--EGADYFI--AKIEEENFLRKQRTFDNGAIPHQLHLEEL                                    428
AKI50529      366  --DGYAG YIDG - TKQVDFYKYLKTILEN-I--EGADYFI--AKIEEENFLRKQRTFDNGAIPHQLHLEEL                                    428
EFR83390                                                                                                               
WP_046323366  363  --DGYAG YIEG - TKQEAFYKYMKKMLEH-V--EGADYFI--NQIEEENFLRKQRTFDNGAIPHQLHLEEL                                    425
AKE81011      373  --NGYAG YIDG G ASQEEFYKFIKPILEK-M--DGTELLv--KLNREDLLRKQRTFDNGSIPHQIHLGEL                                    435
CUO82355      365  kvKGYYN YINR K APVDEFYKFKFVKKCIEK-VdtPEAKQILh--DIELENFLLKQNSRINGSVPYQMQLDEM                                   433
WP_033162887  366  klHNYLG YIKY D TPVEEFYKYLGLLAK-VqtDEAREILe--RIDLEKFMLKQNSRTNGSIPYQMQKDEM                                    434
AGZ01981      390  --NGYAG YIDG G ASQEEFYKFIKPILEK-M--DGTELLv--KLNREDLLRKQRTFDNGSIPHQIHLGEL                                    452
AKA60242      357  --NGYAG YIDG G ASQEEFYKFIKPILEK-M--DGTELLv--KLNREDLLRKQRTFDNGSIPHQIHLGEL                                    419
AKS40380      361  --NGYAG YIDG G ASQEEFYKFIKPILEK-M--DGTELLv--KLNREDLLRKQRTFDNGSIPHQIHLGEL                                    423
4UN5_B        420  --NGYAG YIDG G ASQEEFYKFIKPILEK-M--DGTELLv--KLNREDLLRKQRTFDNGSIPHQIHLGEL                                    486
WP_010922251  420  HAILRRQEDFYPFLKD--NRE KIEKILTFRIPYYVGPL ARG-n-SRFAWMTR---KSEETITPWNFEVVDKGA                                   486

WP_039695303  423  HAILRRQGEYYPFLKD--KQD RIEKILTFRIPYYVGPL VRKD--SRFAWAEY---RSDEKITPWNFDKVIDKEK                                   489
WP_045635197  420  NAILRRQGEYYPFLKD--NKE KIEKILTFRIPYYVGPL ARGN--RDFAWLTR---NSDEAIRPWNFEEIVDKAS                                   486
5AXW_A        184  KQLLKVQKAYHQLDQsfi--D TYIDLLETRRTYYEGPG --Eg--SPPGWKDI--                                                       229
WP_009880683  104  HAILRRQEDFYPFLKD--NRE KIEKILTFRIPYYVGPL ARG-n-SRFAWMTR---KSEETITPWNFEVVDKGA                                   170
WP_010922251  420  HAILRRQEDFYPFLKD--NRE KIEKILTFRIPYYVGPL ARG-n-SRFAWMTR---KSEETITPWNFEVVDKGA                                   486
WP_011054416  420  HAILRRQEDFYPFLKD--NRE KIEKILTFRIPYYVGPL ARG-n-SRFAWMTR---KSEETITPWNFEVVDKGA                                   486
WP_011284745  420  HAILRRQEDFYPFLKD--NRE KIEKILTFRIPYYVGPL ARG-n-SRFAWMTR---KSEETITPWNFEVVDKGA                                   486
WP_011285506  420  HAILRRQEDFYPFLKD--NRE KIEKILTFRIPYYVGPL ARG-n-SRFAWMTR---KSEETITPWNFEVVDKGA                                   486
WP_011527619  420  HAILRRQEDFYPFLKD--NRE KIEKILTFRIPYYVGPL ARG-n-SRFAWMTR---KSEETITPWNFEVVDKGA                                   486
WP_012560673  420  HAILRRQEDFYPFLKD--NRE KIEKILTFRIPYYVGPL ARG-n-SRFAWMTR---KSEETITPWNFEVVDKGA                                   486
WP_014407541  420  HAILRRQEDFYPFLKD--NRE KIEKILTFRIPYYVGPL ARG-n-SRFAWMTR---KSEETITPWNFEVVDKGA                                   486
WP_020905136  420  HAILRRQEDFYPFLKD--NRE KIEKILTFRIPYYVGPL ARG-n-SRFAWMTR---KSEETITPWNFEVVDKGA                                   486
WP_023080005  420  HAILRRQEDFYPFLKD--NRE KIEKILTFRIPYYVGPL ARG-n-SRFAWMTR---KSEETITPWNFEVVDKGA                                   486
WP_023610282  420  HAILRRQEDFYPFLKD--NRE KIEKILTFRIPYYVGPL ARG-n-SRFAWMTR---KSEETITPWNFEVVDKGA                                   486
WP_030125963  420  HAILRRQEDFYPFLKD--NRE KIEKILTFRIPYYVGPL ARG-n-SRFAWMTR---KSEETITPWNFEVVDKGA                                   486
WP_030122706  420  HAILRRQEDFYPFLKD--NRE KIEKILTFRIPYYVGPL ARG-n-SRFAWMTR---KSEETITPWNFEVVDKGA                                   486
WP_031488318  420  HAILRRQEDFYPFLKD--NRE KIEKILTFRIPYYVGPL ARG-n-SRFAWMTR---KSEETITPWNFEVVDKGA                                   486
WP_032460140  420  HAILRRQEDFYPFLKD--NRE KIEKILTFRIPYYVGPL ARG-n-SRFAWMTR---KSEETITPWNFEVVDKGA                                   486
WP_032461047  420  HAILRRQEDFYPFLKD--NRE KIEKILTFRIPYYVGPL ARG-n-SRFAWMTR---KSEETITPWNFEVVDKGA                                   486
WP_032462016  420  HAILRRQEDFYPFLKD--NRE KIEKILTFRIPYYVGPL ARG-n-SRFAWMTR---KSEETITPWNFEVVDKGA                                   486
WP_032462936  420  HAILRRQEDFYPFLKD--NRE KIEKILTFRIPYYVGPL ARG-n-SRFAWMTR---KSEETITPWNFEVVDKGA                                   486
WP_032464890  420  HAILRRQEDFYPFLKD--NRE KIEKILTFRIPYYVGPL ARG-n-SRFAWMTR---KSEETITPWNFEVVDKGA                                   486
WP_033888930  245  HAILRRQEDFYPFLKD--NRE KIEKILTFRIPYYVGPL ARG-n-SRFAWMTR---KSEETITPWNFEVVDKGA                                   311
WP_038431314  420  HAILRRQEDFYPFLKD--NRE KIEKILTFRIPYYVGPL ARG-n-SRFAWMTR---KSEETITPWNFEVVDKGA                                   486
WP_038432938  420  HAILRRQEDFYPFLKD--NRE KIEKILTFRIPYYVGPL ARG-n-SRFAWMTR---KSEETITPWNFEVVDKGA                                   486
WP_038434062  420  HAILRRQEDFYPFLKD--NRE KIEKILTFRIPYYVGPL ARG-n-SRFAWMTR---KSEETITPWNFEVVDKGA                                   486
BAQ51233      331  HAILRRQEDFYPFLKD--NRE KIEKILTFRIPYYVGPL ARG-n-SRFAWMTR---KSEETITPWNFEVVDKGA                                   397
KGE60162                                                                                                               
KGE60856                                                                                                               
WP_002989955  420  HAILRRQEDFYPFLKE--NQD RIEKILTFRIPYYVGPL ARG-n-SRFAWMTR---KSEETITPWNFEEVDKGA                                   486
WP_003030002  420  HAILRRQEEHYPFLKE--NQD RIEKILTFRIPYYVGPL ARKG--SRFAWAEY---KADEKITPWNFDDILDKEK                                   486
WP_003065552  423  HAILRRQGDYYPFLKE--NLD RIEKILTFRIPYIGPL ARKD--SRFSWAEY---HSDEKITPWNFDKVIDKEK                                    489
WP_001040076  421  RAIIRRQSEYYPFLKE--NQD RIEKILTFRIPYIGPL AREK--SDFAWMTR---KTDDSIRPWNFEDLVDKEK                                    487
WP_001040078  421  KAIIRRQSEYYPFLKE--NQD RIEKILTFRIPYIGPL AREK--SDFAWMTR---KTDDSIRPWNFEDLVDKEK                                    487
WP_001040080  421  KAIIRRQSEYYPFLKE--NQD RIEKILTFRIPYIGPL AREK--SDFAWMTR---KTDDSIRPWNFEDLVDKEK                                    487
WP_001040081  421  KAIIRRQSEYYPFLKE--NQD RIEKILTFRIPYIGPL AREK--SDFAWMTR---KTDDSIRPWNFEDLVDKEK                                    487
WP_001040083  421  KAIIRRQSEYYPFLKE--NQD RIEKILTFRIPYIGPL AREK--SDFAWMTR---KTDDSIRPWNFEDLVDKEK                                    487
WP_001040085  421  KAIIRRQSEYYPFLKE--NQD RIEKILTFRIPYIGPL AREK--SDFAWMTR---KTDDSIRPWNFEDLVDKEK                                    487
```

| | | | | | |
|---|---|---|---|---|---|
| WP_001040087 | 421 | KAIIRRQSEYYPFLKE-NQD | RIEKILTFRIPYYIGPL | AREK--SDFAWMTR---KTDDSIRPWNFEDLVDKEK | 487 |
| WP_001040088 | 421 | KAIIRRQSEYYPFLKE-NQD | RIEKILTFRIPYYIGPL | AREK--SDFAWMTR---KTDDSIRPWNFEDLVDKEK | 487 |
| WP_001040089 | 421 | KAIIRRQSEYYPFLKE-NQD | RIEKILTFRIPYYIGPL | AREK--SDFAWMTR---KTDDSIRPWNFEDLVDKEK | 487 |
| WP_001040090 | 421 | KAIIRRQSEYYPFLKE-NQD | RIEKILTFRIPYYIGPL | AREK--SDFAWMTR---KTDDSIRPWNFEDLVDKEK | 487 |
| WP_001040091 | 421 | KAIIRRQSEYYPFLKE-NQD | RIEKILTFRIPYYIGPL | AREK--SDFAWMTR---KTDDSIRPWNFEDLVDKEK | 487 |
| WP_001040092 | 421 | KAIIRRQSEYYPFLKE-NQD | RIEKILTFRIPYYIGPL | ARGN--SDFAWMTR---KTDDSIRPWNFEDLVDKEK | 487 |
| WP_001040094 | 421 | RAIIRRQSEYYPFLKE-NLD | RIEKILTFRIPYYIGPL | AREK--SDFAWMTR---KTDDSIRPWNFEDLVDKEK | 487 |
| WP_001040095 | 421 | RAIIRRQSEYYPFLKE-NLD | RIEKILTFRIPYYIGPL | AREK--SDFAWMTR---KTDDSIRPWNFEDLVDKEK | 487 |
| WP_001040096 | 421 | RAIIRRQSEYYPFLKE-NLD | RIEKILTFRIPYYIGPL | AREK--SDFAWMTR---KTDDSIRPWNFEDLVDKEK | 487 |
| WP_001040097 | 421 | RAIIRRQSEYYPFLKE-NLD | RIEKILTFRIPYYIGPL | AREK--SDFAWMTR---KTDDSIRPWNFEDLVDKEK | 487 |
| WP_001040098 | 421 | RAIIRRQSEYYPFLKE-NLD | RIEKILTFRIPYYIGPL | AREK--SDFAWMTR---KTDDSIRPWNFEDLVDKEK | 487 |
| WP_001040099 | 421 | RAIIRRQSEYYPFLLKE-NLD | RIEKILTFRIPYYIGPL | AREK--SDFAWMTR---KTDDSIRPWNFEDLVDKEK | 487 |
| WP_001040100 | 421 | KAIIRRQSEYYPFLKE-NQD | RIEKILTFRIPYYIGPL | AREK--SDFAWMTR---KTDDSIRPWNFEDLVDKEA | 487 |
| WP_001040104 | 421 | KAIIRRQSEYYPFLKE-NLD | RIEKILTFRIPYYIGPL | AREK--SDFAWMTR---KTDDSIRPWNFEELVDKEA | 487 |
| WP_001040105 | 421 | KAIIRRQSEYYPFLKE-NQD | RIEKILTFRIPYYVGPL | AREK--SDFAWMTR---KTDDSIRPWNFEELVDKEA | 487 |
| WP_001040106 | 421 | KAIIRRQSEYYPFLKE-NLD | RIEKILTFRIPYYIGPL | AREK--SDFAWMTR---KTDDSIRPWNFEDLVDKEA | 487 |
| WP_001040107 | 421 | KAIIRRQSEYYPFLKE-NLD | RIEKILTFRIPYYIGPL | AREK--SDFAWMTR---KTDDSIRPWNFEELVDKEA | 487 |
| WP_001040108 | 421 | KAIIRRQSEYYPFLKE-NLD | RIEKILTFRIPYYVGPL | AREK--SDFAWMTR---KTDDSIRPWNFEELVDKEA | 487 |
| WP_001040109 | 421 | KAIIRRQSEYYPFLKE-NQD | RIEKILTFRIPYYVGPL | AREK--SDFAWMTR---KTDDSIRPWNFEELVDKEA | 487 |
| WP_001040110 | 421 | KAIIRRQSEYYPFLKE-NLD | RIEKILTFRIPYYVGPL | AREK--SDFAWMTR---KTDDSIRPWNFEELVDKEA | 487 |
| WP_015058523 | 421 | KAIIRRQSEYYPFLKE-NQD | RIEKILTFRIPYYVGPL | ARGN--SDFAWMTR---KTDDSIRPWNFEDLVDKEK | 487 |
| WP_017643650 | 421 | KAIIRRQSEYYPFLKE-NLD | RIEKILTFRIPYYIGPL | AREK--SDFAWMTR---KTDDSIRPWNFEDLVDKEK | 487 |
| WP_017647151 | 421 | KAIIRRQSEYYPFLKE-NQD | RIEKILTFRIPYYVGPL | AREK--SDFAWMTR---KTDDSIRPWNFEDLVDKEA | 487 |
| WP_017648376 | 421 | KAIIRRQSEYYPFLKE-NLD | RIEKILTFRIPYYVGPL | AREK--SDFAWMTR---KTDDSIRPWNFEDLVDKEA | 487 |
| WP_017649527 | 421 | KAIIRRQSEYYPFLKE-NQD | RIEKILTFRIPYYIGPL | AREK--SDFAWMTR---KTDDSIRPWNFEDLVDKEA | 487 |
| WP_017771611 | 421 | KAIIRRQSEYYPFLKE-NLD | RIEKILTFRIPYYIGPL | AREK--SDFAWMTR---KTDDSIRPWNFEELVDKEA | 487 |
| WP_017771984 | 421 | KAIIRRQSEYYPFLKE-NQD | RIEKILTFRIPYYVGPL | AREK--SDFAWMTR---KTDDSIRPWNFEDLVDKEA | 487 |
| CFQ25032 | 421 | KAIIRRQSEYYPFLKE-NQD | RIEKILTFRIPYYVGPL | AREK--SDFAWMTR---KTDDSIRPWNFEDLVDKEK | 487 |
| CFV16040 | 421 | KAIIRRQSEYYPFLKE-NQD | KIEKILTFRIPYYIGPL | AREK--SDFAWMTR---KTDDSIRPWNFEDLVDKEK | 487 |
| KLJ37842 | 421 | KAIIRRQSEYYPFLKE-NQD | KIEKILTFRIPYYIGPL | AREK--SDFAWMTR---KTDDSIRPWNFEDLVDKEK | 487 |
| KLJ72361 | 421 | KAIIRRQSEYYPFLKE-NQD | KIEKILTFRIPYYIGPL | AREK--SDFAWMTR---KTDDSIRPWNFEDLVDKEK | 487 |
| KLL20707 | 421 | KAIIRRQSEYYPFLKE-NQD | KIEKILTFRIPYYIGPL | AREK--SDFAWMTR---KTDDSIRPWNFEDLVDKEK | 487 |
| KLL42645 | 421 | KAIIRRQSEYYPFLKE-NQD | RIEKILTFRIPYYVGPL | AREK--SDFAWMTR---KTDDSIRPWNFELVDKEA | 487 |
| WP_047207273 | 421 | KAIIRRQSEYYPFLKE-NLD | RIEKILTFRIPYYIGPL | AREK--SDFAWMTR---KTDDSIRPWNFEDLVDKEA | 487 |
| WP_047209694 | 421 | RAIIRRQSEYYPFLKE-NLD | RIEKILTFRIPYYVGPL | AREK--SDFAWMTR---KTDDSIRPWNFEDLVDKEK | 487 |
| WP_050198062 | 421 | KAIIRRQSEYYPFLKE-NQD | RIEKILTFRIPYYIGPL | AREK--SDFAWMTR---KTDDSIRPWNFEDLVDKEK | 487 |
| WP_050201642 | 421 | KAIIRRQSEYYPFLKE-NQD | RIEKILTFRIPYYIGPL | AREK--SDFAWMTR---KTDDSIRPWNFEDLVDKEK | 487 |
| WP_050204027 | 421 | KDIRRQSEYYPFLKE-NQD | EIEKILTFRIPYYIGPL | AREK--SDFAWMTR---KTDDSIRPWNFEDLVDKEA | 487 |
| WP_050881965 | 421 | KAIIRRQSEYYPFLKE-NQD | RIEKILTFRIPYYIGPL | AREK--SDFAWMTR---KTDDSIRPWNFEDLVDKEK | 487 |
| WP_050886065 | 421 | KAIIRRQSEYYPFLKE-NQD | RIEKILTFRIPYYVGPL | ARGN--SDFAWMTR---KTDDSIRPWNFEDLVDKEK | 487 |
| AHN30376 | 421 | KAIIRRQSEYYPFLKE-NQD | KIEKILTFRIPYYIGPL | AREK--SDFAWMTR---KTDDSIRPWNFEDLVDKEA | 487 |
| EA078426 | 421 | KAIIRRQSEYYPFLKE-NOD | KIEKILTFRIPYYVGPL | ARKG--SRFAWAEY--KADEKITPWNFDDILDKEK | 487 |
| CCW42055 | 420 | HAILRRQGEHYPFLKE-NOD | KIEKILTFRIPYYVGPL | ARKG--SRFAWAEY--KADEKITPWNFDDILDKEK | 486 |
| WP_003041502 | 420 | HAILRRQGEHYPFLKE-NOD | KIEKILTFRIPYYVGPL | ARKG--SRFAWAEY--KADEKITPWNFDDILDKEK | 486 |
| WP_037593752 | 420 | HAILRRQGEHYPFLKE-NOD | KIEKILTFRIPYYVGPL | ARKG--SRFAWAEY--KADEKITPWNFDDILDKEK | 487 |
| WP_049516684 | 430 | HAILRRQGEHYPFLKE-NOE | EIEKILTFRIPYYVGPL | ARKD--SRFAWAEY--RSDEKITPWNFDKVIDKEK | 496 |
| GAD46167 | 420 | KAIIRRQGDYYPFLKE-NQE | KIEKILTFRIPYYVGPL | ARKD--SRFAWAEY--KSEEAITPWNFEEVVDKGA | 486 |
| WP_018363470 | 420 | HAILRRQEEFYPFLKE-NRE | KIEKILTFRIPYYVGPL | ARG-n-SRFAWLTR--KSEEAITPWNFEEVVDKGA | 486 |
| WP_003043819 | 420 | HAILRRQGEHYPFLKE-NRE | KIEKILTFRIPYYVGPL | ARG-n-SRFAWLTR--KADEKITPWNFDDILDKEK | 486 |
| WP_006269658 | 420 | HAILRRQGEHYPFLKE-NQD | KIEKILTFRIPYYVGPL | VRKG--SRFAWMTR--KADEKITPWNFDDILDKEK | 487 |
| WP_048800889 | 420 | HAILRRQGEHYPFLKD-NRE | KIEKILTFRIPYYVGPL | ARG-n-SRFAWMTR--KSEETITPWNFEEVDKGA | 486 |
| WP_012767106 | 420 | HAILRRQEDFYPFLKD-NRE | KIEKILTFRIPYYVGPL | ARG-n-SRFAWMTR--KSEETITPWNFEEVDKGA | 486 |
| WP_014612333 | 420 | HAILRRQEDFYPFLKD-NRE | KIEKILTFRIPYYVGPL | ARG-n-SRFAWMTR--KSEETITPWNFEEVDKGA | 486 |

| | | | | |
|---|---|---|---|---|
| WP_015017095 | 420 | HAILRRQEDFYPFLKD-NRE KIEKILTFRIPYYVGPL ARG-n-SRFAWMTR---KSEETITPWNFEEVVDKGA | 486 |
| WP_015057649 | 420 | HAILRRQEDFYPFLKD-NRE KIEKILTFRIPYYVGPL ARG-n-SRFAWMTR---KSEETITPWNFEEVVDKGA | 486 |
| WP_0483272l5 | 420 | HAILRRQEDFYPFLKD-NRE KIEKILTFRIPYYVGPL ARG-n-SRFAWMTR---KSEETITPWNFEEVVDKGA | 486 |
| WP_049519324 | 420 | HAILRRQEVEYPFLKD-NRE KIESLLTFRIPYYVGPL ARG-n-SRFAWVKR---KSEETITPWNFEEVVDKGA | 486 |
| WP_012515931 | 420 | HAILRRQEVEYPFLKD-NRK KIESLLTFRIPYYVGPL ARG-h-SRFAWVKR---KFDGAIRPWNFEEIVDEEA | 486 |
| WP_021320964 | 420 | HAILRRQEVEYPFLKD-NRK KIESLLTFRIPYYVGPL ARG-h-SRFAWVKR---KFDGAIRPWNFEEIVDEEA | 486 |
| WP_037581760 | 420 | HAILRRQEVEYPFLKD-NRK KIESLLTFRIPYYVGPL ARG-h-SRFAWVKR---KFDGAIRPWNFEEIVDEEA | 486 |
| WP_004232481 | 420 | RTILRRQGEYYPFLKE-NQA KIEKILTFRIPYYVGPL ARKN--SRFAWAKY---HSDEPITPWNFDEVVDKEK | 486 |
| WP_009854540 | 421 | HAILRRQGDYYPFLKE-KQD RIEKILTFRIPYYVGPL VRKD--SRFAWAEY---RSDEKITPWNFDEIIDKEK | 487 |
| WP_012962174 | 421 | HAILRRQGEHYAFLKE-NQA KIEKILTFRIPYYVGPL ARKN--SRFAWAEY---HSDEKITPWNFDEIIDKEK | 487 |
| WP_039695303 | 423 | HAILRRQGEHYPFLKE-KQD KIEKILTFRIPYYVGPL VRKD--SRFAWAEY---RSDEKITPWNFDKVIDKEK | 489 |
| WP_014334983 | 420 | HSILRRQGDYYPFLKE-NQA KIEKILTFRIPYYVGPL ARKD--SRFAWANY---HSDEPITPWNFDEVVDKEK | 486 |
| WP_003099269 | 420 | KAILRRQEKEYPFLKE-NQK KIEKLFTKIPYYVGPL ANG-q-SSFAWLKR---QSNESITPWNFEEVVDQEA | 486 |
| AHY15608 | 420 | KAIIRRQEKEYPFLKE-NQK KIEKLFTKIPYYVGPL ANG-q-SSFAWLKR---QSNESITPWNFEEVVDQEA | 486 |
| AHY17476 | 420 | KAIIRRQEKEYPFLKE-NQK KIEKLFTKIPYYVGPL ANG-q-SSFAWLKR---QSNESITPWNFEEVVDQEA | 486 |
| ESR09100 | | ---------------- ---------------- ---------------- ---- | |
| AGM98575 | 420 | KAIIRRQEKEYPFLKE-NQK KIEKLFTKIPYYVGPL ANG-q-SSFAWLKR---QSNESITPWNFEEVVDQEA | 486 |
| ALF27331 | 420 | RAIIRRQAEFYPFLAD-NOD RIEKILTFRIPYYIGPL ARGK--SDFSWLSR---KSADKITPWNFDEIVDKES | 486 |
| WP_018372492 | 433 | QAIILNQSKYYPFLAE-NKE KIEKILTFRIPYYVGPL ARGK--SSFAWLQR---KSDEAIRPWNFEQVVDMET | 499 |
| WP_045618028 | 421 | NAIIRRQGEHYPFLQE-NKE KIEKILTFRIPYYVGPL ARGN--RDFAWLTR---NSDQAIRPWNFEIVDKAR | 487 |
| WP_045635197 | 420 | RAIIRRQGEYYPFLKE-NQD RIEKILTFRIPYYVGPL ARGN--RDFAWLTR---NSDEAIRPWNFEEIVDKAS | 486 |
| WP_002263549 | 420 | RAIIRRQAEFYPFLAD-NQD RIEKLLTFRIPYYVGPL ARGK--SDFAWLSR---KSADKITPWNFDEIVDKES | 486 |
| WP_002263887 | 420 | RAIIRRQAEFYPFLAD-NQD RIEKILTFRIPYYVGPL ARGK--SDFAWLSR---KSADKITPWNFDEIVDKES | 486 |
| WP_002264920 | 420 | HAILRRQGDYYPFLKE-NQD RIEKILTFRIPYYVGPL ARGK--SDFAWLSR---KSADKITPWNFDEIVDKES | 486 |
| WP_002269043 | 420 | RAIIRRQAEFYPFLAD-NQD RIEKILTFRIPYYVGPL ARGK--SDFAWLSR---KSADKITPWNFDEIVDKES | 486 |
| WP_002269448 | 420 | RAIIRRQAEFYPFLAD-NQD RIEKILTFRIPYYVGPL ARGK--SDFAWLSR---KSADKITPWNFDEIVDKES | 486 |
| WP_002271977 | 420 | RAIIRRQAEFYPFLAD-NQD RIEKILTFRIPYYVGPL ARGK--SDFAWLSR---KSADKITPWNFDEIVDKES | 486 |
| WP_002272766 | 420 | RAIIRRQAEFYPFLAD-NQD RIEKILTFRIPYYVGPL ARGK--SDFAWLSR---KSADKITPWNFDEIVDKES | 486 |
| WP_002273241 | 420 | RAIIRRQAEFYPFLAD-NQD RIEKILTFRIPYYVGPL ARGK--SDFAWLSR---KSADKITPWNFDEIVDKES | 486 |
| WP_002275430 | 420 | RAIIRRQAEFYPFLAD-NQD RIEKILTFRIPYYVGPL ARGK--SDFAWLSR---KSADKITPWNFDEIVDKES | 486 |
| WP_002276448 | 420 | RAIIRRQAEFYPFLAD-NQD RIEKILTFRIPYYVGPL ARGK--SDFAWLSR---HSDEAVMPWNFDQVIDKES | 486 |
| WP_002277050 | 420 | RAIIRRQAEFYPFLAD-NQD RIEKILTFRIPYYVGPL ARKN--SRFAWAEY---KSADKITPWNFDEIVDKES | 486 |
| WP_002773364 | 420 | HAILRRQGDYYPFLKE-NQD RIEKILTFRIPYYVGPL ARGK--SDFAWLSR---KSADKITPWNFDEIVDKES | 486 |
| WP_002279025 | 420 | RAIIRRQSEFYPFLAD-NQD RIEKILTFRIPYYVGPL ARKN--SRFAWAEY---HSDEAVTPWNFDQVIDKES | 486 |
| WP_002279859 | 420 | RAIIRRQAEFYPFLAD-NQD RIEKILTFRIPYYVGPL ARGK--SDFAWLSR---KSADKITPWNFDEIVDKES | 486 |
| WP_002280230 | 420 | RAIIRRQAEFYPFLAD-NQD RIEKILTFRIPYYVGPL ARGK--SDFAWLSR---KSADKITPWNFDEIVDKES | 486 |
| WP_002281696 | 420 | RAIIRRQAEFYPFLAD-NQD RIEKILTFRIPYYVGPL ARGK--SDFAWLSR---KSADKITPWNFDEIVDKES | 486 |
| WP_002282247 | 420 | RAIIRRQAEFYPFLAD-NQD RIEKILTFRIPYYVGPL ARGK--SDFAWLSR---KSADKITPWNFDEIVDKES | 486 |
| WP_002282906 | 420 | RAIIRRQAEFYPFLAD-NQD RIEKILTFRIPYYVGPL ARGK--SDFAWLSR---KSADKITPWNFDEIVDKES | 486 |
| WP_002283846 | 420 | RAIIRRQAEFYPFLAD-NQD RIEKILTFRIPYYVGPL ARGK--SDFAWLSR---KSADKITPWNFDEIVDKES | 486 |
| WP_002287255 | 420 | RAIIRRQAEFYPFLAD-NQD RIEKILTFRIPYYVGPL ASGK--SDFAWLSR---KSADKITPWNFDEIVDKES | 486 |
| WP_002288990 | 420 | RAIIRRQAEFYPFLAD-NQD RIEKILTFRIPYYVGPL ARGK--SDFAWLSR---KSADKITPWNFDEIVDKES | 486 |
| WP_002289641 | 420 | RAIIRRQAEFYPFLAD-NQD RIEKILTFRIPYYVGPL ARGK--SDFAWLSR---KSADKITPWNFDEIVDKES | 486 |
| WP_002290427 | 420 | RAIIRRQAEFYPFLAD-NQD RIEKILTFRIPYYVGPL ARGK--SDFAWLSR---KSADKITPWNFDEIVDKES | 486 |
| WP_002295753 | 420 | RAIIRRQAEFYPFLAD-NQD RIEKILTFRIPYYVGPL ARGK--SDFAWLSR---KSADKITPWNFDEIVDKES | 486 |
| WP_002296423 | 430 | HAILRRQGEHYPFLAD-NQD RIEKLLTFRIPYYVGPL VRKG--SRFAWAEY---KADEKITPWNFDDILDKEK | 496 |
| WP_002304487 | 420 | RAIIRRQAEFYPFLAD-NQD RIEKILTFRIPYYVGPL ARGK--SDFAWLSR---KSADKITPWNFDEIVDKES | 486 |
| WP_002305844 | 420 | RAIIRRQAEFYPFLAD-NQD RIEKILTFRIPYYVGPL ARGK--SDFAWLSR---KSADKITPWNFDEIVDKES | 486 |
| WP_002307203 | 420 | RAIIRRQAEFYPFLAD-NQD RIEKILTFRIPYYVGPL ARGK--SDFAWLSR---KSADKITPWNFDEIVDKES | 486 |
| WP_002310390 | 420 | RAIIRRQAEFYPFLAD-NQD RIEKILTFRIPYYVGPL ARGK--SDFAWLSR---KSADKITPWNFDEIVDKES | 486 |
| WP_002352408 | 420 | RAIIRRQAEFYPFLAD-NQD RIEKILTFRIPYYVGPL ARGK--SDFAWLSR---KSADKITPWNFDEIVDKES | 486 |
| WP_012997688 | 420 | RAIIRRQAEFYPFLAD-NQD RIEKILTFRIPYYVGPL ARGK--SDFAWLSR---KSADKITPWNFDEIVDKES | 486 |
| WP_014677909 | 420 | RAIIRRQAEFYPFLAD-NQD RIEKILTFRIPYYVGPL ARGK--SDFAWLSR---KSADKITPWNFDEIVDKES | 486 |

| | | | | |
|---|---|---|---|---|
| WP_019312892 | 420 | RAIIRRQAEFYPFLAD--NQD RIEKILTFRIPYYVGPL ARGK--SDFAWLSR---KSADKITPWNFDEIVDKES | 486 |
| WP_019313659 | 420 | RAIIRRQAEFYPFLAD--NQD RIEKILTFRIPYYVGPL ARGK--SDFAWLSR---KSADKITPWNFDEIVDKES | 486 |
| WP_019314093 | 420 | RAIIRRQAEFYPFLAD--NQD RIEKILTFRIPYYVGPL ARGK--SDFAWLSR---KSADKITPWNFDEIVDKES | 486 |
| WP_019315370 | 420 | RAIIRRQAEFYPFLAD--NQD RIEKILTFRIPYYVGPL ARGK--SDFAWLSR---KSADKITPWNFDEIVDKES | 486 |
| WP_019803776 | 420 | RAIIRRQAEFYPFLAD--NQD RIEKILTFRIPYYVGPL ARGK--SDFAWLSR---KSADKITPWNFDEIVDKES | 486 |
| WP_019805234 | 420 | RAIIRRQAEFYPFLAD--NQD RIEKILTFRIPYYVGPL ARGK--SDFAWLSR---KSADKITPWNFDEIVDKES | 486 |
| WP_024783594 | 420 | RAIIRRQAEFYPFLAD--NQD RIEKILTFRIPYYVGPL ARGK--SDFAWLSR---KSADKITPWNFDEIVDKES | 486 |
| WP_024784288 | 420 | HAILRRQGDYYPFLKE--NQD RIEKILTFRIPYYVGPL ARKN--SRFAWAEY---HSDEAVTPWNFDQVIDKES | 486 |
| WP_024784666 | 420 | RAIIRRQAEFYPFLAD--NQD RIEKILTFRIPYYVGPL ARGK--SDFAWLSR---KSADKITPWNFDEIVDKES | 486 |
| WP_024784894 | 420 | RAIIRRQAEFYPFLAD--NQD RIEKILTFRIPYYVGPL ASGK--SRFAWAEY---HSDEAVTPWNFDQVIDKES | 486 |
| WP_024786433 | 420 | HAILRRQGDYYPFLKE--NQD RIEKILTFRIPYYVGPL ARKN--SRFAWAEY---HSDEAVTPWNFDQVIDKES | 486 |
| WP_049473442 | 420 | RAIIRRQAEFYPFLAD--NQD RIEKILTFRIPYYVGPL ARGK--SDFAWLSR---KSADKITPWNFDEIVDKES | 486 |
| WP_049474547 | 420 | RAIIRRQAEFYPFLAD--NQD RIEKILTFRIPYYVGPL ASGK--SDFAWLSR---KSADKITPWNFDEIVDKES | 486 |
| EMC03581 | 413 | RAIIRRQAEFYPFLAD--NQD RIEKILTFRIPYYVGPL ARGK--SDFAWLSR---KSADKITPWNFDEIVDKES | 479 |
| WP_000428612 | 421 | NAILRRQGEHYPFLKE--NKE KIEKILTFRIPYYVGPL ARGN--RDFAWLTR---NSDQAIRPWNFBEIVDKAS | 487 |
| WP_000428613 | 421 | NAILRRQGEHYPFLKE--NKE KIEKILTFRIPYYVGPL ARGN--RDFAWLTR---NSDEAIRPWNFEEIVDKAS | 487 |
| WP_049523028 | 420 | NAILRHQGEXYPFLKE--NKD KIEQILTFRIPYYVGPL ARGN--SDFAWLTR---NSDEAIRPWNFEEMVDKSS | 486 |
| WP_003107102 | 389 | KSIIRROEKYYPFLKD--KQV RIEKIFTFRIPYYFVGPL ANG-n-SSFAWVKR---RSNESITPWNFEEVVEQEA | 455 |
| WP_054279288 | 422 | QAILERQQAYYPFLKD--NQE KIEKILTFRIPYYIGPL ARG-n-SRFAWLTR---TSDQKITPWNFDEMVDQEA | 488 |
| WP_049531101 | 421 | NAILRRQGEHYPFLKE--NRE KIEKILTFRIPYYVGPL ARGN--RDFAWLTR---NSNEKMTPWNFDNVIDKTS | 487 |
| WP_049538452 | 421 | NAIIRRQGEHYPFLQE--NKE KIEKILTFRIPYYVGPL ARGN--GDFAWLTR---NSDQAIRPWNFEEIVDKAS | 487 |
| WP_049549711 | 421 | NAILRRQGEHYPFLKE--NKE KIEKILTFRIPYYVGPL ARGK--RDFAWLTR---NSDQAIRPWNFEEIVDKAS | 487 |
| WP_007896501 | 422 | HAILRRQEKYYPFLAE--QKE KIEQLLCFRIPYYVGPL AKGGn-SSFAWLKR---RSDEPITPWNFKDVVDKEA | 489 |
| EFR44625 | 374 | HAILRRQEKYYPFLKE--QKE KIEQLLCRIPYYVGPL AKGGn-SSFAWLKR---RSDEPITPWNFKDVVDKEA | 441 |
| WP_002897477 | 420 | NAILRRQGEHYPFLKE--NRE KIEKILTFRIPYYVGPL ARDN--RDFSWLTR---NSDEPIRPWNFEEVDKAR | 486 |
| WP_002906454 | 420 | NAILRRQGEHYLFLKE--NRE KIEKILAFRIPYYVGPL ARGN--RDFAWLTR---NSDQAIRPWNFEEVVDKAS | 486 |
| WP_009729476 | 421 | NAILRRQGEHYPFLKE--NKE KIEKILTFRIPYYVGPL ARGN--SRFAWASY---NSNEKMTPWNFDNVIDKTS | 487 |
| CQR24647 | 421 | KAILRRQGEHYPFLKE--NAE KIQQILTFKIPYYVGPL ARGN--SRFAWASY---NSNEKMTPWNFDNVIDKTS | 487 |
| WP_000666813 | 421 | NAIIRRQGEHYPFLQE--NKE KIEKILTFRIPYYVGPL ARGN--GDFAWLTR---NSDQAIRPWNFEEIVDKAS | 487 |
| WP_009754323 | 421 | NAILRRQGEHYPLLKE--NKE KIEKILTFRIPYYVGPL ARGN--RDFAWLTR---NSDQAIRPWNFEEIVDKAS | 487 |
| WP_044674937 | 420 | HAIIRRQAEFYPFLVE--NQD KIEKILTFRIPYYVGPL ARGK--SEFAWLNR---KSDEKIRPWNFDEMVDKET | 486 |
| WP_044676715 | 420 | HAIIRRQAEFYPFLVE--NQD KIEKILTFRIPYYVGPL ARGK--SEFAWLNR---KSDEKIRPWNFDEMVDKET | 486 |
| WP_044680361 | 420 | HAIIRRQAEFYPFLVE--NQD KIEKILTFRIPYYVGPL ARGK--SEFAWLNR---KSDEKIRPWNFDEMVDKET | 486 |
| WP_044681799 | 420 | HAILRRQEEHYPFLKE--NQD KIEKILTFRIPYYVGPL ARKG--SRFAWAEY---KADEKITPWNFDDILDEK | 486 |
| WP_049533112 | 404 | VAILENQATYYPFLLE--QKD NIHKLLTFRIPYYVGPL ADQKd-SEFAWMVR---KQAGKITPFNFEEMVDIDA | 471 |
| WP_029090905 | 430 | IKIINQAEYYPILKE--KRE QLlSILTFRIPYYVGPL ETSEh----AWIKRlegKENQRILPWNYQDIVDVDA | 498 |
| WP_006506696 | 420 | HAILRRQEDFYPFLKD--NRE KIEKILTFRIPYYVGPL ARG-n-SRFAWMTR---KSEETITPWNFEEVVDKGA | 486 |
| AIT42264 | 426 | TAVILDQQEKHYSFLKE--NRD KIISLLTFRIPYYVGPL AKGE--SRFAWLER---sNSEEKIKPWNFDKIVDIDK | 493 |
| AKQ21048 | 421 | QAILDRQSQYYPFLKE--NRD KIESLVTFRIPYYVGPL ARG-n-SRFAWMER---QSDEPIRPWNFDEIVNKER | 488 |
| WP_004636532 | 428 | QAILHRQAAYYPFLKE--NQE KIEQLVTFRIPYYVGPL TVSDg-SEFAWMER---QSDEPIRPWNFDEIVNKER | 495 |
| WP_002364836 | 430 | QAILHRQAAYYPFLKE--NQE KIEQLVTFRIPYYVGPL SKGDa-STFAWLKR---QSEEPIRPWNLQETVDLDQ | 497 |
| WP_016631044 | 379 | QAILHRQAAYYPFLKE--NQE KIEQLVTFRIPYYVGPL SKGDa-STFAWLKR---QSEEPIRPWNLQETVDLDQ | 446 |
| EMS75795 | 163 | KAIIERQKPYYPSLEE--ARD KMIRLLTFRIPYYVGPL AQGetsSEFAWLER---KTPEKVTPWNATEVIDYSA | 231 |
| WP_002373311 | 428 | QAILHRQAAYYPFLKE--NQE KIEQLVTFRIPYYVGPL SKGDa-STFAWLKR---QSEEPIRPWNLQETVDLDQ | 495 |
| WP_002378009 | 428 | QAIIHRQAAYYPFLKE--NQE KIEQLVTFRIPYYVGPL SKGDa-NTFAWLKR---QSEEPIRPWNLQETVDLDQ | 495 |
| WP_002407324 | 428 | QAIIHRQAAYYPFLKE--NQE KIEQLVTFRIPYYVGPL SKGDa-STFAWLKR---QSEEPIRPWNLQETVDLDQ | 495 |
| WP_002413717 | 430 | QAIIHRQAAYYPFLKE--NQK KIEQLVTFRIPYYVGPL SKGDa-STFAWLKR---QSEEPIRPWNLQETVDLDQ | 497 |
| WP_010775580 | 428 | QAIIHRQAAYYPFLKE--NQE KIEQLVTFRIPYYVGPL SKGDa-STFAWLKR---QSEEPIRPWNLQETVDLDQ | 495 |
| WP_010818269 | 428 | QAIIHRQAAYYPFLKE--NQE KIEQLVTFRIPYYVGPL SKGDa-STFAWLKR---QSEEPIRPWNLQETVDLDQ | 495 |
| WP_010824395 | 428 | QAIIHRQAAYYPFLKE--NQE KIEQLVTFRIPYYVGPL SKGDa-STFAWLKR---QSEEPIRPWNLQETVDLDQ | 495 |
| WP_016622645 | 428 | QAIIHRQAAYYPFLKE--NQE KIEQLVTFRIPYYVGPL SKGDa-STFAWLKR---QSEEPIRPWNLQETVDLDQ | 495 |
| WP_033624816 | 428 | QAIIHRQAAYYPFLKE--NQK KIEQLVTFRIPYYVGPL SKGDa-STFAWLKR---QSEEPIRPWNLQETVDLDQ | 495 |

-continued

```
WP_033625576  428  QAIIHRQAAYYPFLKE--NQE KIEQLVTFRIPYYVGPL SKGDa-STFAWLKR---QNEKPIRPWNLQETVDLDQ   495
WP_033789179  428  QAIIHRQAAYYPFLKE--NQK KIEQLVTFRIPYYVGPL SKGDa-STFAWLKR---QSEEPIRPWNLQETVDLDQ   495
WP_002310644  424  RAIIANQKKHYPFLKE--EQE KLESLLTFKIPYYVGPL AKKQenSPPAWLIR---KSEEKIKPWNLPEIVDMEG   492
WP_002312694  425  RAIIANQKKHYPFLKE--EQE KLESLLTFKIPYYVGPL AKKQenSPPAWLIR---KSEEKIKPWNLPEIVDMEG   493
WP_002314015  425  RAIIANQKKHYPFLKE--EQE KLESLLTFKIPYYVGPL AKKQenSPPAWLIR---KSEEKIKPWNLPEIVDMEG   493
WP_002320716  424  RAIIANQKKHYPFLKE--EQE KLESLLTFKIPYYVGPL AKKQenSPPAWLIR---KSEEKIKPWNLPEIVDMEG   492
WP_002330729  425  RAIIANQKKHYPFLKE--EQE KLESLLTFKIPYYVGPL AKKQenSPPAWLIR---KSEEKIKPWNLPEIVDMEG   493
WP_002335161  425  RAIIANQKKHYPFLKE--EQE KLESLLTFKIPYYVGPL AKKQenSPPAWLIR---KSEEKIKPWNLPEIVDMEG   493
WP_002345439  425  RAIIANQKKHYPFLKE--EQE KLESLLTFKIPYYVGPL AKKQenSPPAWLIR---KSEEKIKPWNLPEIVDMEG   493
WP_034867970  418  KAIDQQKQHYPFLEE--AGP KIIALFKPRIPYYVGPL AKEQeaSFAWIER---KTAEKINPWNFSEVVDIEK    486
WP_047937432  425  RAIIANQKKHYPFLKE--EQE KLESLLTFKIPYYVGPL AKKQenSPPAWLIR---KSEEKIKPWNLPEIVDMEG   493
WP_010720994  418  KAIDQQKQHYPFLEE--AGP KIIALFKPRIPYYVGPL AKEQeaSSFAWIER---KTAEKINPWNFSEVVDIEK   486
WP_010737004  418  KAIDQQKQHYPFLEE--AGP KIIALFKPRIPYYVGPL AKEQeaSSFAWIER---KTAEKINPWNFSEVVDIEK   486
WP_034700478  418  KAIDQQKQHYPFLEE--AGP KIIALFKPRIPYYVGPL AKEQeaSSFAWIER---KTAEKINPWNFSEVVDIEK   486
WP_007209003  422  RALRKQEKYSFLKE--NHE KIEQIFKVRIPYYVGPL AKHNegSRFAWNIR---KSDEPIRPWNMDVVDENA    490
WP_023519017  418  REIMDRQKRFYPFLKG--AQG KIEKILTFRIPYYVGPL AQEGg-SPFAWIKR---KSPSQITPWNFAEVVDEKN  485
WP_010770040  423  EAIIQKQATYYPFLAD--NKE EMKQLVTFRIPYYVGPL ADGN--SPFAWLER---ISSEPIRPGNLAEVVDIKK  489
WP_048604708  419  KAILHHQAMYYPFLQE--KFS NFVDLLTFRIPYYVGPL ANGN--SRPSWLSR---KSDEPIRPWNLAEVVDLSK  485
WP_010750235  418  KAIDQKQYYPFLEK--SKE KMIQLLTFRIPYYVGPL AQDKetsSFAWLER---KTTEKIKPWNNAKDVIDYGA   486
AII16583      459  HAILRRQEDFYPFLKD--NRE KIEKILTFRIPYYVGPL ARG-n-SRFAWMTR---KSEETITPWNFBEVVDKGA  525
WP_029073316  436  NKILENQSVYYSDLKD--NED KIRSILTFRIPYFGPL ITKDr-QFDWIIKkegKENERILPWNANEIVDVDK    506
WP_031589969  436  NKILENQSVYYSDLKD--NED KIRSILTFRIPYFGPL ITKDr-QFDWIIKkegKENERILPWNANEIVDVDK    506
KDA45870      418  VAIVENQGKYYPFLRE--NKD KFEKILNFRIPYYVGPL ARGN--SKFAWLTR-a-GEGKITPYNFDEMIDKET   484
WP_039099354  416  DRIIENQQQYYPWLAE--INPN KLDELVAFRVPYYVGPL KAEGQIIPWNFDDKVDRQA                  509
AKP02966      426  EKIIDNSQYYPFLKE--NKE KLLSILSFRIPYYVGPL -QSSeKNPFAWMER---KSNGHARPWNFDEIVDREK   483
WP_010991369  426  EAILHQQAKYYPFLKE--NYD KIKSLVTFRIPYYVGPL ANGQ--SEFAWLTR---KADGEIRPWNIEEKVDFGK  492
WP_033838504  429  EAILHQQAKYYPFLKE--NYD KIKSLVTFRIPYYVGPL ANGQ--SEFAWLTR---KADGEIRPWNIEEKVDFGK  495
EHN60060      195  ---------------     KIKSLVTFRIPYYVGPL ANGQ--SEFAWLTR---KADGEIRPWNIEEKVDFGK   261
EFR89594      426  EAILHQQAKYYPFLKE--NYD KIKSLVTFRIPYYVGPL ANGQ--SEFAWLTR---KADGEIRPWNIEEKVDFGK  492
WP_038409211  426  EAILHQQAKYYPFLRK--DYE KIRSLVTFRIPYFGPL ANGQ--SDFAWLTR---KADGEIRPWNIEEKVDFGK   492
EFR95520      45   EAILHQQAKYYPFLRK--DYE KIRSLVTFRIPYFGPL ANGQ--SDFAWLTR---KADGEIRPWNIEEKVDFGK   111
WP_003723650  426  EAILHQQAKYYPFLRE--DYD KIKSLVTFRIPYYVGPL ANGQ--SEFAWLTR---KADGEIRPWNIEEKVDFGK  492
WP_003727705  426  EAILHQQAKYYPFLRE--GYD KIKSLVTFRIPYYVGPL ANGQ--SEFAWLTR---KDDGEIRPWNIEEKVDFGK  492
WP_003730785  426  EAILHQQAKYYPFLRE--GYD KIKSLVTFRIPYYVGPL ANGQ--SEFAWLTR---KDDGEIRPWNIEEKVDFGK  492
WP_003733029  426  EAILHQQAKYYPFLRE--DYE KIKSLVTFRIPYYVGPL AKGQ--SDFAWLTR---KADGEIRPWNIEEKVDFGK  492
WP_003739838  426  EAILHQQAKYYPFLRE--AYD KIKSLVTFRIPYYVGPL ANGQ--SEFAWLTR---KADGEIRPWNIEEKVDFGK  492
WP_014601172  426  EAILHQQAKYYPFLRE--DYE KIKSLVTFRIPYYVGPL AKGQ--SRFAWLTR---KADGEIRPWNIEEKVDFGK  492
WP_023548323  426  EAILHQQAKYYPFLRE--DYE KIKSLVTFRIPYYVGPL AKGQ--SEFAWLTR---KADGEIRPWNIEEKVDFGK  492
WP_031665337  426  EAILHQQAKYTELKE--DYE KIKSLVTFRIPYYVGPL ANGQ--SEFAWLTR---KADGEIRPWNIEEKVDFGK   492
WP_031669209  426  EAILHQQAKYYPFLRE--DYE KIKSLVTFRIPYYVGPL ANGQ--SEFAWLTR---KADGEIRPWNIEEKVDFGK  492
WP_003920898  426  EAILHQQAKYYPFLRE--DYE KIKSLVTFRIPYYVGPL AKGQ--SEFAWLTR---KADGEIRPWNIEEKVDFGK  492
AKI42028      429  EAILHQQAKYYPFLRE--DYE KIKSLVTFRIPYYVGPL AKGQ--SEFAWLTR---KADGEIRPWNIEEKVDFGK  495
AKI50529      429  EAILHQQAKYYPFLRE--DYE KIKSLVTFRIPYYVGPL AKGQ--SEFAWLTR---KADGEIRPWNIEEKVDFGK  495
EFR83390      ---  ---------------                                                        
WP_046323366  426  EAILHQQAKYYPFLKV--DYE KIKSLVTFRIPYYVGPL ANGQ--SEFSWLTR---KADGEIRPWNIEEKVDFGK  492
AKE81011      436  HAILRRQEDFYPFLKD--NRE KIEKILTFRIPYYVGPL ARG-n-SRFAWMTR---KSEETITPWNFEEVDKGA   502
CU082355      434  IKIIDNQAKYYPVLKE--KRE QLLSILEFRIPYYVGPL ETSEh--AWIKrlegKENQRILPWNYQDTVDVDA    502
WP_033162887  435  IQIIDNSVYYPQLKE--NRD KIJISILEFRIPYYVGPL AHSE---FAWIKfedKQKERILPWNYDQIVDIDA    503
AGZ01981      453  HAILRRQEDFYPFLKD--NRE KIEKILTFRIPYYVGPL ARG-n-SRFAWMTR---KSEETITPWNFEEVDKGA   519
AKA60242      420  HAILRRQEDFYPFLKD--NRE KIEKILTFRIPYYVGPL ARG-n-SRFAWMTR---KSEETITPWNFEEVDKGA   486
```

| | | | |
|---|---|---|---|
| AKS40380 | 420 | HAILRRQEDFYPFLKD--NRE KIEKILTFRIPYYVGPL ARG-n-SRFAWMTR---KSEETITPWNFEEVDKGA | 486 |
| 4UN5_B | 424 | HAILRRQEDFYPFLKD--NRE KIEKILTFRIPYYVGPL ARG-n-SRFAWMTR---KSEETITPWNFEEVDKGA | 490 |
| WP_010922251 | 487 | SAQSFIERMTNFDKNLPNEKVLPKHSLLYEYFTVNELTKVKYVT--EGMRKPaFLSG[E]QKKAIVDLLFK--TNR-KVTV | 561 |
| WP_039695303 | 490 | SAEKFITRMTLNDLYLPKHSLLYEYFTVNELTKVKVT-AVVNELTKVKFIA--EQGKES-FFDSNMKQEIFDHVEK--ENR-KVTK | 563 |
| WP_045635197 | 487 | SAEDFINKMTNYDLYLPKHSLLYETFAVVNELTKVKFIA--EGLRDYqFLDSQKKQIVNQLFK--ENR-KVTE | 561 |
| 5AXW_A | 230 | ---KEWYEMLMGHCTYFPEELRSVKYAYNADLYNALNDLNNLVITR--DENEKLeYYE---KFQIIENVRK--QKK-KPTL | 299 |
| WP_009880683 | 171 | SAQSFIERMTNEDKNLPNEKVLPKHSLLYEYFTVNELTKVKYVT--EGMRKPaELSGEQKKAIVDLLFK--TNR-KVTV | 245 |
| WP_010922251 | 487 | SAQSFIERMTNEDKNLPNEKVLPKHSLLYEYFTVNELTKVKYVT--EGMRKPaELSGEQKKAIVDLLFK--TNR-KVTV | 561 |
| WP_011054416 | 487 | SAQSFIERMTNEDKNLPNEKVLPKHSLLYEYFTVNELTKVKYVT--EGMRKPaELSGEQKKAIVDLLFK--TNR-KVTV | 561 |
| WP_011284745 | 487 | SAQSFIERMTNEDKNLPNEKVLPKHSLLYEYFTVNELTKVKYVT--EGMRKPaELSGEQKKAIVDLLFK--TNR-KVTV | 561 |
| WP_011285506 | 487 | SAQSFIERMTNEDKNLPNEKVLPKHSLLYEYFTVNELTKVKYVT--EGMRKPaELSGEQKKAIVDLLFK--TNR-KVTV | 561 |
| WP_011527619 | 487 | SAQSFIERMTNEDKNLPNEKVLPKHSLLYEYFTVNELTKVKYVT--EGMRKPaELSGEQKKAIVDLLFK--TNR-KVTV | 561 |
| WP_012560673 | 487 | SAQSFIERMTNEDKNLPNEKVLPKHSLLYEYFTVNELTKVKYVT--EGMRKPaELSGEQKKAIVDLLFK--TNR-KVTV | 561 |
| WP_014407541 | 487 | SAQSFIERMTNEDKNLPNEKVLPKHSLLYEYFTVNELTKVKYVT--EGMRKPaELSGEQKKAIVDLLFK--TNR-KVTV | 561 |
| WP_020905136 | 487 | SAQSFIERMTNEDKNLPNEKVLPKHSLLYEYFTVNELTKVKYVT--EGMRKPaELSGEQKKAIVDLLFK--TNR-KVTV | 561 |
| WP_023080005 | 487 | SAQSFIERMTNEDKNLPNEKVLPKHSLLYEYFTVNELTKVKYVT--EGMRKPaELSGEQKKAIVDLLFK--TNR-KVTV | 561 |
| WP_023610282 | 487 | SAQSFIERMTNEDKNLPNEKVLPKHSLLYEYFTVNELTKVKYVT--EGMRKPaELSGEQKKAIVDLLFK--TNR-KVTV | 561 |
| WP_030125963 | 487 | SAQSFIERMTNEDKNLPNEKVLPKHSLLYEYFTVNELTKVKYVT--EGMRKPaELSGEQKKAIVDLLFK--TNR-KVTV | 561 |
| WP_030126706 | 487 | SAQSFIERMTNEDKNLPNEKVLPKHSLLYEYFTVNELTKVKYVT--EGMRKPaELSGEQKKAIVDLLFK--TNR-KVTV | 561 |
| WP_031488318 | 487 | SAQSFIERMTNEDKNLPNEKVLPKHSLLYEYFTVNELTKVKYVT--EGMRKPeFLSGEQKKAIVDLLFK--TNR-KVTV | 561 |
| WP_032460140 | 487 | SAQSFIERMTNEDKNLPNEKVLPKHSLLYEYFTVNELTKVKYVT--EGMRKPaELSGEQKKAIVDLLFK--TNR-KVTV | 561 |
| WP_032461047 | 487 | SAQSFIERMTNEDKNLPNEKVLPKHSLLYEYFTVNELTKVKYVT--EGMRKPaELSGEQKKAIVDLLFK--TNR-KVTV | 561 |
| WP_032462016 | 487 | SAQSFIERMTNEDKNLPNEKVLPKHSLLYEYFTVNELTKVKYVT--EGMRKPaELSGEQKKAIVDLLFK--TNR-KVTV | 561 |
| WP_032462936 | 487 | SAQSFIERMTNEDKNLPNEKVLPKHSLLYEYFTVNELTKVKYVT--EGMRKPaELSGEQKKAIVDLLFK--TNR-KVTV | 561 |
| WP_032464890 | 487 | SAQSFIERMTNEDKNLPNEKVLPKHSLLYEYFTVNELTKVKYVT--EGMRKPaELSGEQKKAIVDLLFK--TNR-KVTV | 561 |
| WP_033888930 | 312 | SAQSFIERMTNEDKNLPNEKVLPKHSLLYEYFTVNELTKVKYVT--EGMRKPaELSGEQKKAIVDLLFK--TNR-KVTV | 386 |
| WP_038431314 | 487 | SAQSFIERMTNEDKNLPNEKVLPKHSLLYEYFTVNELTKVKYVT--EGMRKPaELSGEQKKAIVDLLFK--TNR-KVTV | 561 |
| WP_038432938 | 487 | SAQSFIERMTNEDKNLPNEKVLPKHSLLYEYFTVNELTKVKYVT--EGMRKPaELSGEQKKAIVDLLFK--TNR-KVTV | 561 |
| WP_038434062 | 398 | SAQSFIERMTNEDKNLPNEKVLPKHSLLYEYFTVNELTKVKYVT--EGMRKPaELSGEQKKAIVDLLFK--TNR-KVTV | 472 |
| BAQ51233 | | | |
| KGE60162 | | | |
| KGE60856 | | | |
| WP_002989955 | 487 | SAEKFITRMTLNDLYLPKHSLLYEYFTVNELTKVKYVN--EGMRKPaELSGEQKKAIVDLLFK--TNR-KVTV | 561 |
| WP_003030002 | 487 | SAEKFITRMTLNDLYLPKHSLLYETFTVNELTKVKYVN--EQQEAK-FFDAMMKQEIFDHVEK--ENR-KVTK | 560 |
| WP_003065552 | 490 | SAEKFITRMTLNDLYLPKHSLLYEYFTVAVVNELTKVKIKYVN--EQGKDS-FFDSNMKQEIFDHVEK--ENR-KVTK | 563 |
| WP_001040076 | 488 | SAEAFIHRMTNNDFYLPEEKVLPKHSLLYEYFTVNELTKVRYKN--EQGETY-FFDSNIKQEIFPDGVFK--EKR-KVSK | 562 |
| WP_001040078 | 487 | SAEAFIHRMTNNDFYLPEEKVLPKHSLLYEYFTVNELTKVRYKN--EQGETY-FFDSNIKQEIFPDGVFK--EHR-KVSK | 561 |
| WP_001040080 | 488 | SAEAFIHRMTNNDFYLPEEKVLPKHSLLYEYFTVNELTKVRYKN--EQGETY-FFDSNIKQEIFPDGVFK--EHR-KVSK | 562 |
| WP_001040081 | 488 | SAEAFIHRMTNNDFYLPEEKVLPKHSLLYEYFTVNELTKVRYKN--EQGETY-FFDSNIKQEIFPDGVFK--EHR-KVSK | 562 |
| WP_001040083 | 488 | SAEAFIHRMTNNDFYLPEEKVLPKHSLLYEYFTVNELTKVRYKN--EQGETY-FFDSNIKQEIFPDGVFK--EHR-KVSK | 562 |
| WP_001040085 | 488 | SAEAFIHRMTNNDFYLPEEKVLPKHSLLYEYFTVNELTKVRYKN--EQGETY-FFDSNIKQEIFPDGVFK--EHR-KVSK | 562 |
| WP_001040087 | 488 | SAEAFIHRMTNNDFYLPEEKVLPKHSLLYEYFTVNELTKVRYKN--EQGETY-FFDSNIKQEIFPDGVFK--EHR-KVSK | 562 |
| WP_001040088 | 488 | SAEAFIHRMTNNDFYLPEEKVLPKHSLLYEYFTVNELTKVRYKN--EQGETY-FFDSNIKQEIFPDGVFK--EHR-KVSK | 562 |
| WP_001040089 | 488 | SAEAFIHRMTNNDFYLPEEKVLPKHSLLYEYFTVNELTKVRYKN--EQGETY-FFDSNIKQEIFPDGVFK--EHR-KVSK | 562 |
| WP_001040090 | 488 | SAEAFIHRMTNNDFYLPEEKVLPKHSLLYEYFTVNELTKVRYKN--EQGETY-FFDSNIKQEIFPDGVFK--EHR-KVSK | 562 |
| WP_001040091 | 488 | SAEAFIHRMTNNDFYLPEEKVLPKHSLLYEYFTVNELTKVRYKN--EQGETY-FFDSNIKQEIFPDGVFK--EHR-KVSK | 562 |
| WP_001040092 | 488 | SAEAFIHRMTNNDFYLPEEKVLPKHSLLYEYFTVNELTKVRYKN--EQGETY-FFDSNVKQEIFPDGVFK--EHR-KVSK | 562 |
| WP_001040094 | 488 | SAEAFIHRMTNNDFYLPEEKVLPKHSLLYEYFTVNELTKVRFLA--EGFKDFqFLNRKQEETIENSLEK--EKR-KVTE | 562 |
| WP_001040095 | 488 | SAEAFIHRMTNNDFYLPEEKVLPKHSLLYEYFTVNELTKVRFLA--EGFKDFqFLNRKQEETIENSLEK--EKR-KVTE | 562 |
| WP_001040096 | 488 | SAEAFIHRMTNNDLYLPEEKVLPKHSLLYEYFTVNELTKVRFLA--EGFKDFqFLNRKQEETIENSLEK--EKR-KVTE | 562 |
| WP_001040097 | 488 | SAEAFIHRMTNNDLYLPEEKVLPKHSLLYEYFTVNELTKVRFLA--EGFKDFqFLNRKQEETIENSLEK--EKR-KVTE | 562 |
| WP_001040098 | 488 | SAEAFIHRMTNNDLYLPEEKVLPKHSLLYEYFTVNELTKVRFLA--EGFKDFqFLNRKQEETIENSLEK--EKR-KVTE | 562 |

-continued

```
WP_001040099   488  SAEEAFIHRMTNNDLYLPEEKVLPKHSLIYEKFTYNELTKVRFLA--EGFKDFqFLNRKQKETIENSLEK--EKR-KVTE  562
WP_001040100   488  SAEEAFIHRMTNNDLYLPEEKVLPKHSLIYEKFTYNELTKVRFLA--EGFKDFqFLNRKQKETIENSLEK--EKR-KVTE  562
WP_001040104   488  SAEEAFIHRMTNNDLYLPEEKVLPKHSLIYEKFTVNELTKVRYKN--EQGETY-FFDSNIKQEIFDGVFK--EHR-KVSK  561
WP_001040105   488  SAEEAFIHRMTNNDLYLPEEKVLPKHSLIYEKFTVNELTKVRYKN--EQGETY-FFDSNIKQEIFDGVFK--EHR-KVSK  561
WP_001040106   488  SAEEAFIHRMTNNDLYLPEEKVLPKHSLIYEKFTVNELTKVRYKN--EQGETY-FFDSNIKQEIFDGVFK--EHR-KVSK  561
WP_001040107   488  SAEEAFIHRMTNNDLYLPEEKVLPKHSLIYEKFTVNELTKVRYKN--EQGETY-FFDTNMKQEIFDGVFK--EHR-KVSK  561
WP_001040108   488  SAEEAFIHRMTNNDLYLPEEKVLPKHSLIYEKFTVNELTKVRYKN--EQGETY-FFDSNIKQEIFDGVFK--EHR-KVSK  561
WP_001040109   488  SAEEAFIHRMTNNDLYLPEEKVLPKHSLIYEKFTVNELTKVRYKN--EQGETY-FFDSNIKQEIFDGVFK--EHR-KVSK  561
WP_001040110   488  SAEEAFIHRMTNNDLYLPEEKVLPKHSLIYEKFTVNELTKVRYKN--EQGETY-FFDSNIKQEIFDGVFK--EHR-KVSK  561
WP_015058823   488  SAEEAFIHRMTNNDLYLPEEKVLPKHSLIYEKFTYNELTKVRFLA--EGFKDFgFLNRKQKETIENSLEK--EKR-KVTE  562
WP_017643650   488  SAEEAFIHRMTNNDLYLPEEKVLPKHSLIYEKFTVNELTKVRYKN--EQGETY-FFDSNIKQEIFDGVFK--EHR-KVSK  561
WP_017647151   488  SAEEAFIHRMTNNDFYLPEEKVLPKHSLIYEKFTYNELTKVRFLA--EGFKDFgFLNRKQKETIENSLEK--EKR-KVTE  562
WP_017648376   488  SAEEAFIHRMTNNDFYLPEEKVLPKHSLIYEKFTVNELTKVRYKN--EQGETY-FFDSNIKQEIFDGVFK--EHR-KVSK  561
WP_017649527   488  SAEEAFIHRMTNNDFYLPEEKVLPKHSLIYEKFTVNELTKVRYKN--EQGETY-FFDSNIKQEIFDGVFK--EHR-KVSK  561
WP_017771611   488  SAEEAFIHRMTNNDFYLPEEKVLPKHSLIYEKFTVNELTKVRYKN--EQGETY-FFDSNIKQEIFDGVFK--EHR-KVSK  561
WP_017771984   488  SAEEAFIHRMTNNDFYLPEEKVLPKHSLIYEKFTVNELTKVRYKN--EQGETY-FFDSNIKQEIFDGVFK--EHR-KVSK  561
CFQ25032       488  SAEEAFIHRMTNNDFYLPEEKVLPKHSLIYEKFTVNELTKVRYKN--EQGETY-FFDSNIKQEIFDGVFK--EHR-KVSK  561
CFV16040       488  SAEEAFIHRMTNNDFYLPEEKVLPKHSLIYEKFTVNELTKVRYKN--EQGETY-FFDSNIKQEIFDGVFK--EHR-KVSK  561
KLJ37842       488  SAEEAFIHRMTNNDFYLPEEKVLPKHSLIYEKFTVNELTKVRYKN--EQGETY-FFDSNIKQEIFDGVFK--EHR-KVSK  561
KLJ72361       488  SAEEAFIHRMTNNDFYLPEEKVLPKHSLIYEKFTVNELTKVRYKN--EQGETY-FFDSNIKQEIFDGVFK--EHR-KVSK  561
KLL20707       488  SAEEAFIHRMTNNDFYLPEEKVLPKHSLIYEKFTYNELTKVRFLA--EGFKDFgFLNRKQKETIENSLEK--EKR-KVTE  562
KLL42645       488  SAEEAFIHRMTNNDFYLPEEKVLPKHSLIYEKFTVNELTKVRYKN--EQGETY-FFDSNIKQEIFDGVFK--EHR-KVSK  561
WP_047207273   488  SAEEAFIHRMTNNDFYLPEEKVLPKHSLIYEKFTVNELTKVRYKN--EQGETY-FFDSNIKQEIFDGVFK--EHR-KVSK  561
WP_047209694   488  SAEEAFIHRMTNNDFYLPEEKVLPKHSLIYEKFTYNELTKVRFLA--EGFKDFgFLNRKQKETIENSLEK--EKR-KVTE  562
WP_049516684   488  SAEEAFIHRMTNNDFYLPEEKVLPKHSLIYEKFTVNELTKVRYKN--EQGETY-FFDSNIKQEIFDGVFK--EHR-KVSK  561
WP_050198062   488  SAEEAFIHRMTNNDFYLPEEKVLPKHSLIYEKFTVNELTKVRYKN--EQGETY-FFDSNIKQEIFDGVFK--EHR-KVSK  561
WP_050201642   488  SAEEAFIHRMTNNDFYLPEEKVLPKHSLIYEKFTVNELTKVRYKN--EQGETY-FFDSNIKQEIFDGVFK--EHR-KVSK  561
WP_050204027   488  SAEEAFIHRMTNNDFYLPEEKVLPKHSLIYEKFTVNELTKVRYKN--EQGETY-FFDSNIKQEIFDGVFK--EHR-KVSK  561
WP_050881965   488  SAEEAFIHRMTNNDFYLPEEKVLPKHSLIYEKFTVNELTKVRYKN--EQGETY-FFDSNVKQEIFDGVFK--EHR-KVSK  561
WP_050886065   488  SAEEAFIHRMTNNDFYLPEEKVLPKHSLIYEKFTVNELTKVRYKN--EQGETY-FFDSNIKQEIFDGVFK--EHR-KVSK  561
AHN30376       488  SAEEAFIHRMTNNDFYLPEEKVLPKHSLIYEKFTVNELTKVRYKN--EQGETY-FFDSNIKQEIFDGVFK--EHR-KVSK  561
EAO78426       488  SAEEAFIHCMTNNDFYLPEEKVLPKHSLLYETFTVNELTKVKYVN--EQGEAK-FFDANMKQEIFDHVEK--EYR-KVSK  561
CCW42055       488  SAEEAFIHCMTNNDFYLPEEKVLPKHSLLYETFTVNELTKVKYVN--EQGEAK-FFDANMKQEIFDHVEK--ENR-KVTK  561
WP_003041502   488  SAEKFITRMTLNDLYLPEEKVLPKHSLLYETFTVNELTKVKYVN--EQGEAK-FFDTNMKQEIFDHVEK--ENR-KVTK  560
WP_037593752   488  SAEKFITRMTLNDLYLPEEKVLPKHSLLYETFTVNELTKVKYVN--EQGEAK-FFDTNMKQEIFDHVEK--ENR-KVTK  560
GAD46167       488  SAEKFITRMTLNDLYLPEEKVLPKHSPLYETFTVNELTKVKYVN--EQGEAK-FFDTNMKQEIFDHVEK--ENR-KVTK  560
WP_018363470   497  SAQSFIERMTNEDEQLPNKKVLPKHSLLYEAFTVNELTKVKYVT--EQGKDS-FFDSNMKQEIFDHVEK--ENR-KVTK  571
WP_003043819   487  SAQSFIERMTNEDKNLPNEKVLPKHSLLYEYFTVNELTKVKYVT--ERMRKPeFLSGEQKKAIVDLLFK--TNR-KVTV  560
WP_006269658   487  SAQSFIERMTNEDKNLPNEKVLPKHSLLYEAFTVNELTKVKYVN--EQGEAK-FFDTNMKQEIFDHVEK--ENR-KVTK  560
WP_048800889   487  SAQSFIERMTNEDKNLPNEKVLPKHSLLYEIFTVNELTKVKYVT--EGMRKPeFLSGKQKEAIVDLLFK--TNR-KVTV  560
WP_012767106   487  SAQSFIERMTNEDKNLPNEKVLPKHSLLYEYFTVNELTKVKYVT--EGMRKPeFLSGKQKEAIVDLLFK--TNR-KVTV  560
WP_014612333   487  SAQSFIERMTNEDKNLPNEKVLPKHSLLYEFFTVNELTKVKYVT--EGMRKPeFLSGKQKEAIVDLLFK--TNR-KVTV  560
WP_015017095   487  SAQSFIERMTNEDKNLPNEKVLPKHSLLYEYFTVNELTKVKYVT--EGMRKPeFLSGKQKEAIVDLLFK--TNR-KVTV  561
WP_015057649   487  SAQSFIERMTNEDKNLPNEKVLPKHSLLYEYFTVNELTKVKYVT--EGMRKPeFLSGKQKEAIVDLLFK--TNR-KVTV  561
WP_048327215   487  SAQSFIERMTNEDKNLPNEKVLPKHSLLYEYFTVNELTKVKYAT--EGMRKPeFLSGKQKEAIVDLLFK--TNR-KVTV  561
WP_049519324   487  SAQIFIEKMTKNDLYLPNEKVLPKHSLLYETFTVNELTKVKYAT--EGMRKPaELSGEQKKAIVDLLFK--TNR-KVTV  561
WP_012515931   487  SAQIFIEKMTKNDLYLPNEKVLPKHSLLYEFIFTVNELTKVKYVT--EGMTRPgFLSADQKQAIVDLLFK--TNR-KVTV  561
WP_012132096   487  SAQIFIEKMTKNDLYLPNEKVLPKHSLLYETFTVNELTKVKYAT--EGMTRPqFLSGDQKQAIVDLLFK--TNR-KVTV  561
WP_037581760   487  SAQIFIEKMTKNDLYLPNEKVLPKHSLLYETFTVNELTKVKYAT--EGMTRPqFLSADQKQAIVDLLFK--TNR-KVTV  561
WP_004232481   488  SAEKFITRMTKDLYLPNEKVLPKHSVVETFTFAVNELTKVKIKIVN--EQGKSF-FFDANMKQEIFEHVEK--ENR-KVTK  561
WP_009854540   487  SAEKFITRMTLNDLYLPEEKVLPKHSHVETYAVNELTKIKIKYVN--EQGKES-FFDSNMKQEIFDHVEK--ENR-KVTK  560
WP_012962174   488  SAEKFITRMTLNDLYLPEEKVLPKHSHVETYAVNELTKIKIKYVN--EQGKSN-FFDSNMKQEIFDHVEK--ENR-KVTK  561
WP_039695303   490  SAEKFITRMTLNDLYLPEEKVLPKHSHVETYAVNELTKIKIKYVN--EQGKES-FFDSNMKQEIFDHVEK--ENR-KVTK  563
```

```
WP_014334983  487  SAEKFITRMTLNDLYLPEEKVLPKHSHVETFTVNELTKIKVN--EQGESF-FFDANKQEIFDHVEK--ENR-KVTK  560
WP_003099269  487  SARAFIERMTNEDTYLPEEKVLPKHSPLYEMFMVNELTKVKYQT--EGMKRPvFLSSEDKEEIVNLLFK--KER-KVTV  561
AHY15608      487  SARAFIERMTNEDTYLPEEKVLPKHSPLYEMFMVNELTKVKYQT--EGMKRPvFLSSEDKEEIVNLLFK--KER-KVTV  561
AHY17476      487  SARAFIERMTNEDTYLPEEKVLPKHSPLYEMFMVNELTKVKYQT--EGMKRPvFLSSEDKEEIVNLLFK--KER-KVTV  561
ESR09100      ---  ------------------------------------------------------------------------------  ---
AGM98575      487  SARAFIERMTNEDTYLPEEKVLPKHSPLYEMFMVNELTKVKYQT--EGMKRPvFLSSEDKEEIVNLFFK--KER-KVTK  561
ALF27331      487  SAEAFINRMTNYDLYLPNQKVLPRHSLLYEKFTVNELTKVKYKT--EQGKTA-FFDANMKQEIEDGVEK--VVR-KVTK  560
WP_018372492  500  SASRFIERMTLHDLYLPDEKVLPRHSLLIYEKYTVNELTKVRETP--EGGKEV-YESKTDKENIFDSLEK--RYR-KVTK  573
WP_045618028  488  SAEDFINKMTNYDLYLPEEKVLPKHSLLYETFAVNELTKVKFIA--EGLRDYqFLDSGQKQIVTQLFK--EKR-KVTE  562
WP_045635197  487  SAEDFINKMTNYDLYLPNQKVLPKHSLLYEKFTVNELTKVKFIA--EGLRDYqFLDSGQKKQIVNQLFK--ENR-KVTE  561
WP_002263549  487  SAEAFINRMTNYDLYLPNQKVLPKHSLLYEKFTVNELTKVKYKT--EQGKTA-FFDANMKQEIEDGVEK--VVR-KVTK  560
WP_002263887  487  SAEAFINRMTNYDLYLPNQKVLPKHSLLYEKFTVNELTKVKYKT--EQGKTA-FFDANMKQEIEDGVEK--VVR-KVTK  560
WP_002264920  487  SVEAFINRMTNYDLYLPNQKVLPKHSLLYEKFTVNELTKVKYKT--EQGKTA-FFDANMKQEIEDGVEK--VVR-KVTK  560
WP_002269043  487  SAEAFINRMTNYDLYLPNQKVLPKHSLLYEKFTVNELTKVKYKT--EQGKTA-FFDANMKQEIFDGVEK--VVR-KVTK  560
WP_002269448  487  SAEAFINRMTNYDLYLPNQKVLPKHSLLYEKFTVNELTKVKYKT--EQGKTA-FFDANMKQEIFDGVEK--VVR-KVTK  560
WP_002271977  487  SAEAFINRMTNYDLYLPNQKVLPKHSLLYEKFTVNELTKVKYKT--EQGKTA-FFDANMKQEIFDGVEK--VVR-KVTK  560
WP_002272766  487  SAEAFINRMTNYDLYLPNQKVLPKHSLLYEKFTVNELTKVKYKT--EQGKTA-FFDANMKQEIFDGVFK--VVR-KVTK  560
WP_002273241  487  SAEAFINRMTNYDLYLPNQKVLPKHSLLYEKFTVNELTKVKYKT--EQGKTA-FFDANMKQEIFDGVFK--VVR-KVTK  560
WP_002275430  487  SAEAFINRMTNYDLYLPNQKVLPKHSLLYEKFTVNELTKVKYKT--EQGKTA-FFDANMKQEIFDGVFK--VVR-KVTK  560
WP_002276448  487  SAEAFINRMTNYDLYLPNQKVLPKHSLLYEKFTVNELTKVKYKT--EQGKTA-FFDANMKQEIFDGVFK--VVR-KVTK  560
WP_002277050  487  SAQAFIEHMTNYDLYLPNEKVLPKHSPLYEKFTVNELTKIKYVT--EIGEAK-FFDANLKQEIFDGLFK--HER-KVTK  560
WP_002277364  487  SAEAFINRMTNYDLYLPNQKVLPKHSLLYEKFTVNELTKVKYKT--EQGKTA-FFDANMKQEIFDGVFK--VVR-KVTK  560
WP_002279025  487  SAEAFINRMTNYDLYLPEEKVLPKHSLLYEKFTVNELTKVKYKT--EQGETA-FFDANMKQEIFDGVFK--VVR-KVTK  560
WP_002279859  487  SVEAFINRMTNYDLYLPNQKVLPKHSLLYEKFTVNELTKVKYKT--EQGKTA-FFDANMKQEIFDGVFK--VVR-KVTK  560
WP_002280230  487  SAEAFINRMTNYDLYLPNQKVLPKHSLLYEKFTVNELTKVKYKT--EQGKTA-FFDANMKQEIFDGVFK--VVR-KVTK  560
WP_002281696  487  SAEAFINRMTNYDLYLPNQKVLPKHSLLYEKFTVNELTKVKYKT--EQGKTA-FFDANMKQEIFDGVFK--VVR-KVTK  560
WP_002282247  487  SAQAFIEHMTNYDLYLPNEKVLPKHSPLYEKFTVNELTKIKIKVT--EIGEAK-FFDANLKQEIFDGLFK--HER-KVTK  560
WP_002282906  487  SAEAFINRMTNYDLYLPNQKVLPKHSLLYEKFTVNELTKVKYVT--EQGKTA-FFDANMKQEIFDGVFK--VVR-KVTK  560
WP_002283846  487  SVEAFINRMTNYDLYLPNQKVLPKHSLLYEKFTVNELTKVKYKT--EQGKTA-FFDANMKQEIFDGVFK--VVR-KVTK  560
WP_002287255  487  SAEAFINRMTNYDLYLPNQKVLPKHSLLYEKFTVNELTKVKYKT--EQGKTA-FFDANMKQEIFDGVFK--VVR-KVTK  560
WP_002288990  487  SAEAFINRMTNYDLYLPNQKVLPKHSLLYEKFTVNELTKVKYKT--EQGKTA-FFDANMKQEIFDGVFK--VVR-KVTK  560
WP_002289641  487  SAEAFINRMTNYDLYLPNQKVLPKHSLLYEKFTVNELTKVKYKT--EQGKTA-FFDANMKQEIFDGVFK--VVR-KVTK  560
WP_002290427  487  SAEAFINRMTNYDLYLPNQKVLPKHSLLYEKFTVNELTKVKYKT--EQGKTA-FFDANMKQEIFDGVFK--VVR-KVTK  560
WP_002295753  487  SAEAFINRMTNYDLYLPNQKVLPKHSLLYEKFTVNELTKVKYKT--EQGKTA-FFDANMKQEIFDGVFK--VVR-KVTK  560
WP_002296423  487  SAEAFINRMTNYDLYLPNQKVLPKHSLLYEKFTVNELTKVKYVN--EQGKTA-FFDANMKQEIFDHVFK--ENR-KVTK  560
WP_002304487  497  SAEKFITRMTLNDLYLPEEKVLPKHSPLYETFTVNELTKVKFIA--EQGEAK-FFDANMKQEIFDGVFK--VVR-KVTK  570
WP_002305844  487  SAEAFINRMTNYDLYLPNQKVLPKHSLLYEKFTVNELTKVKYKT--EQGKTA-FFDANMKQEIFDGVFK--VVR-KVTK  560
WP_002307203  487  SAEAFINRMTNYDLYLPNQKVLPKHSLLYEKFTVNELTKVKYKT--EQGKTA-FFDANMKQEIFDGVFK--VVR-KVTK  560
WP_002310390  487  SAEAFINRMTNYDLYLPNQKVLPKHSLLYEKFTVNELTKVKYKT--EQGKTA-FFDANMKQEIFDGVFK--VVR-KVTK  560
WP_002352408  487  SAEAFINRMTNYDLYLPNQKVLPKHSLLYEKFTVNELTKVKYKT--EQGKTA-FFDANMKQEIFDGVFK--VVR-KVTK  560
WP_012997688  487  SAEAFINRMTNYDLYLPNQKVLPKHSLLYEKFTVNELTKVKYKT--EQGKTA-FFDANMKQEIFDGVFK--VVR-KVTK  560
WP_014677909  487  SAEAFINRMTNYDLYLPNQKVLPKHSLLYEKFTVNELTKVKYKT--EQGKTA-FFDANMKQEIFDGVFK--VVR-KVTK  560
WP_019312892  487  SAEAFINRMTNYDLYLPNQKVLPKHSLLYEKFTVNELTKVKYKT--EQGKTA-FFDANMKQEIFDGVFK--VVR-KVTK  560
WP_019313659  487  SVEAFINRMTNYDLYLPNQKVLPKHSLLYEKFTVNELTKVKYKT--EQGKTA-FFDANMKQEIFDGVFK--VVR-KVTK  560
WP_019314093  487  SVEAFINRMTNYDLYLPNQKVLPKHSLLYEKFTVNELTKVKYKT--EQGKTA-FFDANMKQEIFDGVFK--VVR-KVTK  560
WP_019315370  487  SAEAFINRMTNYDLYLPNQKVLPKHSLLYEKFTVNELTKVKYKT--EQGKTA-FFDANMKQEIFDGVFK--VVR-KVTK  560
WP_019803776  487  SAEAFINRMTNYDLYLPNQKVLPKHSLLYEKFTVNELTKVKYKT--EQGKTA-FFDANMKQEIFDGVFK--VVR-KVTK  560
WP_019805234  487  SAEAFINRMTNYDLYLPNQKVLPKHSLLYEKFTVNELTKVKYKT--EQGKTA-FFDANMKQEIFDGVFK--VVR-KVTK  560
WP_024783594  487  SAEAFINRMTNYDLYLPNQKVLPKHSLLYEKFTVNELTKVKYKT--EQGKTA-FFDANMKQEIFDGVFK--VVR-KVTK  560
WP_024784288  487  SAQAFIEHMTNNDLYLPNEKVLPKHSPLYEKYTVNELTKIKYVT--EIGEAK-FFDANLKQEIFDGLFK--HER-KVTK  560
WP_024784666  487  SAEAFINRMTNYDLYLPNQKVLPKHSLLYEKFTVNELTKVKYKT--EQGKTA-FFDANMKQEIFDGVFK--VVR-KVTK  560
WP_024784894  487  SAEAFINRMTNYDLYLPNQKVLPKHSLLYEKFTVNELTKVKYKT--EQGKTA-FFDANMKQEIFDGVFK--VVR-KVTK  560
WP_024786433  487  SAQAFIEHMTNNDLYLPNEKVLPKHSPLYEKYTVNELTKIKIKVT--EIGEAK-FFDANLKQEIFDGLFK--HER-KVTK  560
```

| | | | |
|---|---|---|---|
| WP_049473442 | 487 | SAEAFINRMTNYDLYLPNQKVLPKHSLLYEKFTVYNELTKVKYKT--EQGKTA-FFDANMKQEIFDGVFK--VYR-KVTK | 560 |
| WP_049474547 | 487 | SAEAFINRMTNYDLYLPNQKVLPKHSLLYEKFTVYNELTKVKYKT--EQGKTA-FFDANMKQEIFDGVFK--VYR-KVTK | 560 |
| EMC03581 | 480 | SAEAFINRMTNYDLYLPNQKVLPKHSLLYEKFTVNELTKVKYKT--EQGKTA-FFDANMKQEIFDGVFK--VYR-KVTK | 553 |
| WP_000428612 | 488 | SAESFINKMTNYDLYLPEEKVLPKHSLLYETFAVYNELTKVKFIA--EGLRDYqFLDSRQKKDIFYTLFKaeDKR-KVTE | 564 |
| WP_000428613 | 487 | SAEDFIHRMTNYDLYLPEEKVLPKHSLLYETFAVYNELTKVKFIA--EGLRDYqFLDSQKKQIVTQLFK--EKR-KVTE | 562 |
| WP_049523028 | 488 | SAEDFINKMTNYDLYLPEEKVLPKHSLLYETFAVYNELTKVKFIA--EGMKDYqFLDSQKKQIVNQLFK--TER-KVTE | 561 |
| WP_003107102 | 456 | SAKVFIERMTNFDTYLPEEKVLPKHSLLYEMFTVYNELTKVKYQA--EGMRKPeFLSSEEKIEIVSNLFK--TER-KVTV | 530 |
| WP_054279288 | 489 | SAQAFIERMTNFDEYLPQEKVLPKHSLTYEYFTVYNELTKVKFIA--EGMTKPeFLSAQKEQIVELLFK--KYR-KVTV | 563 |
| WP_049531101 | 488 | SAEAFINKMTNYDLYLPEEKVLPKHSLLYETFAVYNELTKVKFIA--EGLRDYqFLDSQKKKIINQLFK--EKR-KVTE | 562 |
| WP_049538452 | 488 | SAEDFINKMTNYDLYLPEEKVLPKHSLLYETFAVYNELTKVKFIA--EGLRDYqFLDSQKKQIVNQLFK--EKR-KVTE | 562 |
| WP_049549711 | 488 | SAEDFINRMTNYDLYLPEEKVLPKHSLLYETFAVYNELTKVKFIA--EGLRDYqFLDSQKKQIVNQLFK--EKR-KVTE | 562 |
| WP_007896501 | 490 | SAQAFIEGMTNYDTYLPEEKVLPKHSPLYEMFTVYNELTKVKYIA--ENMTKPlYLSAEQKEATIDHLFK--QTR-KVTV | 564 |
| EFR44625 | 442 | SAQAFIEGMTNYDTYLPEEKVLPKHSPLYEMFTVNELTKVKYIA--ENMTKPlYLSAEQKEATIDHLFK--QTR-KVTV | 516 |
| WP_002897477 | 487 | SAEDFIHRMTNYDLYLPEEKVLPKHSLLYETFAVYNELTKVKFIA--EGLRDYqFLDSQKKQIVNQLFK--EKR-KVTE | 561 |
| WP_002906454 | 487 | SAEDFINKMTNYDLYLPEEKVLPKHSLLYETFAVYNELTKVKFIA--EGLRDYqFLDSQKKQIVNQLFK--DKR-KVTE | 561 |
| WP_009729476 | 488 | SAEDFINKMTNYDLYLPEEKVLPKHSLLYETFAVYNELTKVKFIA--EGLRDYqFLDSQKKQIVTQLFK--EKR-KVTE | 562 |
| CQR24647 | 488 | SAQAFIERMTNNDLYLPDQKVLPKHSLLYQKFAVYNELTKVKIKVT--ETGEAR-LFDVFLKKEIFDGLFK--KER-KVTK | 562 |
| WP_000066813 | 488 | SAEDFINKMTNYDLYLPEEKVLPKHSLLYETFAVYNELTKVKFIA--EGLTRYqFLDKKQKKDIFDTFPKaeNKR-KVTE | 564 |
| WP_009754323 | 488 | SAEDFINKMTNYDLYLPEEKVLPKHSLLYETFAVYNELTKVKFIA--EGLRDYqFFDSQKKQIVNQLFK--EKR-KVTE | 562 |
| WP_044674937 | 487 | SAENFITRMTNYDQYLPDQKVLPKHSLLYEKFAVYNELTKVKFIA--EGMRDYqFLDSQKKDIVKTLFK--TKR-KVTA | 561 |
| WP_044676715 | 487 | SAENFITRMTNYDQYLPDQKVLPKHSLLYEKFAVYNELTKVKVRVT--EQCKSF-FFDANMKQEIFDGVFK--VYR-KVTK | 560 |
| WP_044680361 | 487 | SAENFITRMTNYDQYLPDQKVLPKHSLLYEKFAVYNELTKVKVRVT--EQCKSF-FFDANMKQEIFDGVFK--VYR-KVTK | 560 |
| WP_044681799 | 487 | SAENFITRMTNYDQYLPDQKVLPKHSLLYEKFAVYNELTKVKFIA--EGMRDYqFLDSQKKDIVKTLFK--TKR-KVTA | 561 |
| WP_049533112 | 487 | SAEKFITRMTLNDLYLPEEKVLPKHSLLYETFTVNELTKVKYVN--EQGEAK-FFDANMKQEIFDHVEK--ENR-KVTV | 560 |
| WP_029090905 | 472 | SSEAFIKRMTNKCTYLIHEDVIPKHSFSYAKFEVLNELNKIRLDG-----KP--IDIPLKKRIFPEGLFL--BKtKVTQ | 540 |
| WP_006506696 | 499 | TAEGFIKRMRSYCYFPDDEVLPKNSLIVSKYEVYNELNKIRVDD------kLLEVDVKNDIYNELFM--KNK-TVTE | 567 |
| AIT42264 | 487 | SAELFIENLTSRDTYLPDEFVLPKHSLLYEKFTIFNELTKVKYVT--EGRILQ-NFSSREKIAIFNDLFK--NKsKVTK | 561 |
| AKQ21048 | 494 | SAQSFIERMTNEDKNLPNEKVLPKHSLLPKKRSLLIYQKFTIFNELTKVKYVT--EGRILQ-NFSSREKIAIFNDLFK--NKsKVTK | 567 |
| WP_004636532 | 489 | SAEKFIERMTNMDTYLLEEKVLPKHSLLPKKRSLLIYQTFEVYNELTKVKVRTN--EQGKTE-KLNRQQKAEIIETLFK-qKNR-VRE | 562 |
| WP_002364836 | 496 | SATAFIERMTNEDTYLPSEKVLPKHSLLPKHSLLYEKFMVFNELTKVKISYTD--DRGIKA-NFSGKEKEKIFDYLFK--TRR-KVKK | 569 |
| WP_002413717 | 447 | SATAFIERMTNEDTYLPSEKVLPKHSLLPKHSLLYEKFMVFNELTKVKISYTD--DRGIKA-NFSGKEKEKIFDYLFK--TRR-KVKK | 520 |
| WP_010775580 | 498 | SATAFIERMTNEDTYLPSEKVLPKHSLLPKHSLLYEKFMVFNELTKVKISYTD--DRGIKA-NFSGKEKEKIFDYLFK--TRR-KVKK | 571 |
| EMS75795 | 232 | SAMKFIQRMINYDTYLPTEKVLPKHSILYQKYTIFNELTKVAYKD--ERGIKH-QFSSKEKREIFKELFQ--KQR-KVTV | 305 |
| WP_002373311 | 496 | SATAFIERMTNEDTYLPSEKVLPKHSLLPKHSLLYEKFMVFNELTKVKISYTD--DRGIKA-NFSGKEKEKIFDYLFK--TRR-KVKK | 569 |
| WP_002378009 | 496 | SATAFIERMTNEDTYLPSEKVLPKHSLLPKHSLLYEKFMVFNELTKVKISYTD--DRGIKA-NFSGKEKEKIFDYLFK--TRR-KVKK | 569 |
| WP_002407324 | 496 | SATAFIERMTNEDTYLPSEKVLPKHSLLPKHSLLYEKFMVFNELTKVKISYTD--DRGIKA-NFSGKEKEKIFDYLFK--TRR-KVKK | 569 |
| WP_010818269 | 496 | SATAFIERMTNEDTYLPSEKVLPKHSLLPKHSLLYEKFMVFNELTKVKISYTD--DRGIKA-NFSGKEKEKIFDYLFK--TRR-KVKK | 569 |
| WP_010824395 | 496 | SATAFIERMTNEDTYLPSEKVLPKHSLLPKHSLLYEKFMVFNELTKVKISYTD--DRGIKA-NFSGKEKEKIFDYLFK--TRR-KVKK | 569 |
| WP_016622645 | 496 | SATAFIERMTNFDTYLPSEKVLPKHSLLPKHSLLYEKFMVFNELTKVKISYTD--DRGIKA-NFSGKEKEKIFDYLFK--TRR-KVKK | 569 |
| WP_033624816 | 496 | SATAFIERMTNFDTYLPSEKVLPKHSLLPKHSLLYEKFMVFNELTKVKISYTD--DRGIKA-NFSGKEKEKIFDYLFK--TRR-KVKK | 569 |
| WP_033625576 | 496 | SATAFIERMTNFDTYLPSEKVLPKHSLLPKHSLLYEKFMVFNELTKVKISYTD--DRGIKA-NFSGKEKEKIFDYLFK--TRR-KVKK | 569 |
| WP_033789179 | 496 | SATAFIERMTNFDTYLPSEKVLPKHSLLPKHSLLYEKFMVFNELTKVKISYTD--DRGIKA-NFSGKEKEKIFDYLFK--TRR-KVKK | 569 |
| WP_023106544 | 493 | SAVRFIERMINTDMYPHNKVLPKNSLLYQKFSIYNELTKVKRYQD--ERGQMN-YFSSIEKKEIFHELFE--KNR-KVIK | 566 |
| WP_002312694 | 494 | SAVRFIERMINTDMYIPHNKVLPKNSLLYQKFSIYNELTKVKRYQD--ERGQMN-YFSSIEKKEIFHELFE--KNR-KVIK | 567 |
| WP_002314015 | 494 | SAVRFIERMINTDMYIPHNKVLPKNSLLYQKFSIYNELTKVKRYQD--ERGQMN-YFSSIEKKEIFHELFE--KNR-KVIK | 567 |
| WP_002320716 | 494 | SAVRFIERMINTDMYIPHNKVLPKNSLLYQKFSIYNELTKVKRYQD--ERGQMN-YFSSIEKKEIFHELFE--KNR-KVIK | 567 |
| WP_002330729 | 493 | SAVRFIERMINTDMYIPHNKVLPKNSLLYQKFSIYNELTKVKRYQD--ERGQMN-YFSSIEKKEIFHELFE--KNR-KVIK | 566 |
| WP_002335161 | 494 | SAVRFIERMINTDMYMPHNKVLPKNSLLYQKFSIYNELTKVKRYQD--ERGQMN-YFSSIEKKEIFHELFE--KNR-KVIK | 567 |
| WP_002345439 | 494 | SAVRFIERMINTDMYMPHNKVLPKNSLLYQKFSIYNELTKVKRYQD--ERGQMN-YFSSIEKKEIFHELFE--KNR-KVIK | 567 |
| WP_034867970 | 487 | SAMRFIQRMTKQDTYLPTEKVLPKNSLLYQKYMIFNELTKVKSYKD--ERGVKQ-YFSGDEKQQIFKQLFQ--KERgKITV | 561 |
| WP_047937432 | 494 | SAVRFIERMINTDMWMPHNKVLPKNSLLYQKFSIYNELTKVKRYQD--ERGQMN-YFSSIEKKEIFHELFE--KNR-KVIK | 567 |

-continued

```
WP_010720994  487  SAMRPIQRMTKQDTYLPTEKVLPTEKVLPKNSLFYQKYMIFNELTKVSYKD--ERGVKQ-YFSGDEKQQIFKQLFQ--KERgKITV  561
WP_010737004  487  SAMRPIQRMTKQDTYLPTEKVLPTEKVLPKNSLLYQKYMIFNELTKVSYKD--ERGVKQ-YFSGDEKQQIFKQLFQ--KERgKITV  561
WP_034700478  487  SAMRPIQRMTKQDTYLPTEKVLPTEKVLPKNSLLYQKYMIFNELTKVSYKD--ERGVKQ-YFSGDEKQQIFKQLFQ--KERgKITV  561
WP_007209003  491  SAVAFIERMTIKDIYI-NENVLPRHSLIYEKFTVFNELTKVLYAD--DRGVFQ-RFSAEEKEDIFEKLFK--SER-KVIK  563
WP_023519017  486  SAIEFIERMINQDTYLPKEKVLPKHSLIYQRFMIFNELTKVSYTD--ERGKSH-YFSSEQKRKIFNELFK--QHP-RVIE  559
WP_010770040  490  SATKFIERMINFDTYLPTEKVLPKHSMLYEKYMVNELTKVSYVD--ERGMNQ-RFSGEEKKQIVEELFK--QSR-KVIK  563
WP_048604708  486  SAELFIERMINFDLYLPSEKVLPKHSMLYEKYTVNELTKVTYKD--EQGKVQ-NFSSEEKERIFIDLFK--QHR-KVIK  559
WP_010750235  487  SATKFIQRMINYDTYLPTEKVLPKYSMLYQKYTIFNELTKVAYKD--DRGIKH-QFSSEEKLRIFQELFK--KQR-RVIK  560
AII16583      526  SAQSFIERMINFDKNLPNEKVLPKHSLLYEYFTVNELTKVKVT--EGMRKPaFLSGEQKKAIVDLLFK--TNR-KVIV  600
WP_029073316  507  TADEFIKRMRNFCTYFPDEPVLAKNSLIVSKYEVLNEINKLRIND------hLIKRDIKDKMLHTLFM--DHK-SISA  575
WP_031589969  507  TADEFIKRMRNECTYFPDEVMAKNSLIVSKYEVLNEINKLRIND------hLIKRDMKDKMLHTLFM--DHK-SISA  575
KDA45870      485  SAEDFIKRMTINDLYLPTEVLPKQSLLYERYTIFNELAGVRYVT--ENGEAK-YEDAQKRSIFE-LFKI--DR-KVSE  557
WP_039099354  510  SANEFIKRMTIDTYLLAEDVLPKQSLIYQRFEVLNELNGLKIDD--QPITTE----LKQAIFTDLFM--QKtSVTV  578
AKP02966      484  SSNKFIRRMVIDSYLVGEPVLPKNSLIYQRYEVLNELANNIRITEnlKINPIGsRLIVETKQHIYNELFK--NYK-KITV  560
WP_010991369  493  SAVDFIEKMINKDTYLPKENVLPKHSLCYQKYLVVNELTKVRYIN--DQGKTS-YFSGQEKEQIENDLFK--QKR-KVKK  566
WP_033838504  493  SAVDFIEKMINKDTYLPKENVLPKHSLCYQKYLVVNELTKVRYIN--DQGKTS-YFSGQEKEQIENDLFK--QKR-KVKK  566
EHN60060      496  SAVDFIEKMINKDTYLPKENVLPKHSLCYQKYLVVNELTKVRYIN--DQGKTS-YFSGQEKEQIENDLFK--QKR-KVKK  569
EFR89594      262  SAVDFIEKMINKDTYLPKENVLPKHSLCYQKYLVVNELTKVRYIN--DQGKTS-YFSGQEKEQIENDLFK--QKR-KVKK  335
WP_038409211  493  SAVDFIEKMINKDTYLPKENVLPKHSLCYQKYMVNELTKIRYID--DQGKTH-HFSGQEKQQIFNGLFK--QQR-KVKK  566
EFR95520      112  SAIDFIEKMINKDTYLPKENVLPKHSLCYQKYMVNELTKIRYID--DQGKTH-YFSGQEKQQIFNGLFK--QQR-KVKK  185
WP_003723650  493  SAVDFIEKMINKDTYLPKENVLPKHSLCYQKYMVNELTKIRYID--DQGKIN-YFSGREKQQVPNDLFK--QKR-KVKK  566
WP_003727705  493  SAVDFIEKMINKDTYLPKENVLPKHSLCYQKYMVNELTKIRYID--DQGKIN-YFSGREKQQIENDLFK--QKR-KVKK  566
WP_003730785  493  SAVDFIEKMINKDTYLPKENVLPKHSLCYQKYMVNELTKIRYID--DQGKIN-YFSGQEKQQIENDLFK--QKR-KVKK  566
WP_003733029  493  SAVDFIEKMINKDTYLPKENVLPKHSLCYQKYMVNELTKIRYID--DQGKIN-YFSGQEKQQIENDLFK--QKR-KVKK  566
WP_003739838  493  SAVDFIEKMINKDTYLPKENVLPKHSLCYQKYLYQKYMVNELTKIRYID--DQGKIN-YFSGQEKQQIENDLFK--QKR-KVSK  566
WP_014601172  493  SAVDFIEKMINKDTYLPKENVLPKHSLCYQKYMVNELTKIRYID--DQGKTN-YFSGQEKQQIENDLEK--QKR-KVKK  566
WP_023548323  493  SAVDFIEKMINKDTYLPKENVLPKHSLCYQKYMVNELTKIRYID--DQGKTN-YFSGQEKQQIENDLEK--QKR-KVKK  566
WP_031665337  493  SAVDFIEKMINKDTYLPKENVLPKHSLCYQKYMVNELTKVRYID--DQGKTN-YFSGQEKQQIENDLEK--QKR-KVKK  566
WP_031669209  493  SAVDFIEKMINKDTYLPKENVLPKHSLCYQKYMVNELTKVRYID--DQGKTN-YFSGQEKQQIENDLEK--QKR-KVKK  566
WP_033920898  493  SAVDFIEKMTNKDTYLPKENVLPKHSLCYQKYMVNELTKIRYID--DQGKTN-YFSGQEKQQIENDLEK--QKR-KVKK  566
AKI42028      496  SAVDFIEKMTNKDTYLPKENVLPKHSLCYQKYMVNELTKIRYID--DQGKTN-YFSGQEKQQIENDLEK--QKR-KVKK  569
AKI50529      496  SAVDFIEKMTNKDTYLPKENVLPKHSLCYQKYMVNELTKIRYID--DQGKTN-YFSGQEKQQIENDLEK--QKR-KVKK  569
EFR83390      1    -----------------------------------------------------------------IFNDLFK--QKR-KVKK  14
WP_046323366  493  SAIDFIEKMTNKDTYLPKENVLPKHSMCYQKYMVNELTKIRYTD--DQGKTH-YESGQEKQQIENDLEK--QKR-KVKK  566
AKE81011      503  SAQSFIERMTNEDKNLPNEKVLPKHSLLYEYFTVNELTKVKVT--EGMRKPaELSGEQKKAIVDLLFK--TNR-KVTV  577
CUO82355      503  KQLKEDYFKK--IECFDSVEISGVEDR---VDGYDGIELKGIEKQ--FTNLKVYHDIKDITARK---------  571
WP_033162887  504  TAEGFIERMKNTGTYFPDEPVMAKNSLTVSKFEVLNELNKIRING------KLIAVETKKELLSDLFM--KNK-TITD  572
AGZ01981      520  SAQSFIERMTNEDKNLPNEKVLPKHSLLYEYFTVNELTKVKVT--EGMRKPaELSGEQKKAIVDLLFK--TNR-KVTV  594
AKA60242      487  SAQSFIERMTNEDKNLPNEKVLPKHSLLYEYFTVNELTKVKVT--EGMRKPaELSGEQKKAIVDLLFK--TNR-KVTV  561
AKS40380      491  SAQSFIERMTNEDKNLPNEKVLPKHSLLYEYFTVNELTKVKVT--EGMRKPaELSGEQKKAIVDLLFK--TNR-KVTV  565
4UN5_B        562  KQLKEDYFKK--IECFDSVEISGVEDR---FNASLGTYHDLLKIIKDK DFLDNEENEDILEDIVLTLTLFEDREMIE  633
WP_010922251  564  EKLLNYLNKE--FPEYRIKDLIGLDKEnkSFNASLGTYHDLLKIL-DK AFLDDKVNEEVIEDIIKTLTLFEDKDMIH  637
WP_039695303  562  KDIIHYLHN---VDGYDGIELKGIEKQ---FTNLKVYHDIKDITARK  ENAELLDQIAKILTIYQSSEDIQ  632
WP_045635197  562  KQIAKEILVNe---EDIKGYRVISIGKPe--FTNLKVYHDIKDITARK  ENAELLDQIAKILTIYQSSEDIQ  632
5AXW_A        300  -------------------------------------  368
WP_009880683  246  KQLKEDYFKK--IECFDSVEISGVEDR---FNASLGTYHDLLKIIKDK DFLDNEENEDILEDIVLTLTLFEDREMIE  317
WP_010922251  562  KQLKEDYFKK--IECFDSVEISGVEDR---FNASLGTYHDLLKIIKDK DFLDNEENEDILEDIVLTLTLFEDREMIE  633
WP_011054416  562  KQLKEDYFKK--IECFDSVEISGVEDR---FNASLGTYHDLLLKIIKDK DFLDNEENEDILEDIVLTLTLFEDREMIE  633
WP_011284745  562  KQLKEDYFKK--IECFDSVEISGVEDR---FNASLGTYHDLLLKIIKDK DFLDNEENEDILEDIVLTLTLFEDREMIE  633
WP_011285506  562  KQLKEDYFKK--IECFDSVEISGVEDR---FNASLGTYHDLLKIIKDK DFLDNEENEDILEDIVLTLTLFEDREMIE  633
WP_011527619  562  KQLKEDYFKK--IECFDSVEISGVEDR---FNASLGTYHDLLKIIKDK DFLDNEENEDILEDIVLTLTLFEDREMIE  633
WP_012566673  562  KQLKEDYFKK--IECFDSVEISGVEDR---FNASLGTYHDLLKIIKDK DFLDNEENEDILEDIVLTLTLFEDREMIE  633
WP_014407541  562  KQLKEDYFKK--IECFDSVEISGVEDR---FNASLGAYHDLLKIIKDK DFLDNEENEDILEDIVLTLTLFEDRGMIE  633
```

| | | | |
|---|---|---|---|
| WP_020905136 | 562 | KQLKEDYFKK---IECFFDSVEISGVEDR---FNASLGTYHDLLKIIKDK DFLDNEENEDILEDIVLTLTLFEDREMIE | 633 |
| WP_023080005 | 562 | KQLKEDYFKK---IECFFDSVEISGVEDR---FNTSLGTYHDLLKIIKDK DFLDNEENEDILEDIVLTLTLFEDREMIE | 633 |
| WP_023610282 | 562 | KQLKEDYFKK---IECFFDSVEISGVEDR---FNTSLGTYHDLLKIIKDK DFLDNEENEDILEDIVLTLTLFEDREMIE | 633 |
| WP_030125963 | 562 | KQLKEDYFKK---IECFFDSVEISGVEDR---FNASLGTYHDLLKIIKDK DFLDNEENEDILEDIVLTLTLFEDREMIE | 633 |
| WP_030126706 | 562 | KQLKEDYFKK---IECFFDSVEISGVEDR---FNASLGTYHDLLKIIKDK DFLDNEENEDILEDIVLTLTLFEDREMIE | 633 |
| WP_031488318 | 562 | KQLKEDYFKK---IECFFDSVEISGVEDR---FNASLGTYHDLLKIIKDK DFLDNEENEDILEDIVLTLTLFEDREMIE | 633 |
| WP_032460140 | 562 | KQLKEDYFKK---IECFFDSVEISGVEDR---FNASLGTYHDLLKIIKDK DFLDNEENEDILEDIVLTLTLFEDREMIE | 633 |
| WP_032461047 | 562 | KQLKEDYFKK---IECFFDSVEISGVEDR---FNASLGTYHDLLKIIKDK DFLDNEENEDILEDIVLTLTLFEDREMIE | 633 |
| WP_032462016 | 562 | KQLKEDYFKK---IECFFDSVEISGVEDR---FNASLGTYHDLLKIIKDK DFLDNEENEDILEDIVLTLTLFEDREMIE | 633 |
| WP_032462936 | 562 | KQLKEDYFKK---IECFFDSVEISGVEDR---FNASLGTYHDLLKIIKDK DFLDNEENEDILEDIVLTLTLFEDKEMIE | 633 |
| WP_032464890 | 562 | KQLKEDYFKK---IECFFDSVEISGVEDR---FNASLGTYHDLLKIIKDK DFLDNEENEDILEDIVLTLTLFEDREMIE | 633 |
| WP_033888930 | 387 | KQLKEDYFKK---IECFFDSVEISGVEDR---FNASLGTYHDLLKIIKDK DFLDNEENEDILEDIVLTLTLFEDREMIE | 458 |
| WP_038431314 | 562 | KQLKEDYFKK---IECFFDSVEISGVEDR---FNASLGTYHDLLKIIKDK DFLDNEENEDILEDIVLTLTLFEDREMIE | 633 |
| WP_038432938 | 562 | KQLKEDYFKK---IECFFDSVEISGVEDR---FNTSLGTYHDLLKIIKDK DFLDNEENEDILEDIVLTLTLFEDKEMIE | 633 |
| WP_038434062 | 562 | KQLKEDYFKK---IECFFDSVEISGVEDR---FNASLGTYHDLLKIIKDK DFLDNEENEDILEDIVLTLTLFEDREMIE | 633 |
| BAQ51233 | 473 | KQLKEDYFKK---IECFFDSVEISGVEDR---FNASLGTYHDLLKIIKDK ------------------------------ | 544 |
| KGE60162 | | | |
| KGE60856 | | | |
| WP_002989955 | 562 | KQLKEDYFKK---IECFFDSVEISGVEDR---FNASLGTYHDLLKIIKDK DFLDNEENEDILEDIVLTLTLFEDREMIE | 633 |
| WP_003030002 | 561 | DKLLNYLNKE--FEEFRIVNLIGLDKEnKAFNSSLGTYHDLLKIIL-DK SFLDDKANEKTIEDIIQTLFEDREMIE | 634 |
| WP_003065552 | 564 | EKLLNYLNKE--FPEYRIKDLIGLDKEnhSFNASLGTYHDLKKIL-DK AFLDDKVNEEVIEDIIKTLTLFEDKDMIH | 637 |
| WP_001040076 | 563 | KDIISFLNK---VDGYEGIAIKGIEKQ---FNASLSTYHDLKKIL-GK DFLDNIDNELILEDIVQTLFEDREMIK | 632 |
| WP_001040078 | 562 | KKLLDFLAKE--YEEFRIVDVIGLDKEnKAFNASLGTYHDLEKIL-DK DFLDNPDNESILEDIVQTLFEDREMIK | 635 |
| WP_001040080 | 562 | KKLLDFLAKE--YEEFRIVDVIGLDKEnKAFNASLGTYHDLEKIL-DK DFLDNPDNESILEDIVQTLFEDREMIK | 635 |
| WP_001040081 | 562 | KKLLDFLAKE--YEEFRIVDVIGLDKEnKAFNASLGTYHDLEKIL-DK DFLDNPDNESILEDIIQTLFEDREMIK | 635 |
| WP_001040083 | 562 | KKLLDFLAKE--YEEFRIVDVIGLDKEnKAFNASLGTYHDLEKIL-DK DFLDNPDNESILEDIVQTLFEDREMIK | 635 |
| WP_001040085 | 562 | KKLLDFLAKE--YEEFRIVDVIGLDKEnKAFNASLGTYHDLEKIL-DK DFLDNPDNESILEDIVQTLFEDREMIK | 635 |
| WP_001040087 | 562 | KKLLDFLAKE--YEEFRIVDVIGLDKEnKAFNASLGTYHDLEKIL-DK DFLDNPDNESILEDIVQTLFEDREMIK | 635 |
| WP_001040088 | 562 | KKLLDFLAKE--YEEFRIVDVIGLDKEnKAFNASLGTYHDLEKIL-DK DFLDNPDNESILEDIVQTLTLFEDREMIK | 635 |
| WP_001040089 | 562 | KKLLDFLAKE--YEEFRIVDVIGLDKEnKAFNASLGTYHDLEKIL-DK DFLDNPDNESILEDIVQTLTLFEDREMIK | 635 |
| WP_001040090 | 562 | KKLLDFLAKE--YEEFRIVDVIGLDKEnKAFNASLGTYHDLKKIL-DK DFLDNPDNESILEDIVQTLTLFEDREMIK | 635 |
| WP_001040091 | 563 | KQLLDFLAKE--FEEFRIVDVTGLDKEnKAFNASLGTYHDLKKIL-DK DFLDNPDNESILEDIVQTTTLFEDREMIR | 635 |
| WP_001040092 | 562 | KDIISFLNK---VDGYEGIAIKGIEKQ---FNASLSTYHDLKKIL-GK DFLDNIDNELILEDIVQTLFEDREMIR | 632 |
| WP_001040094 | 563 | KKLLDFLAKE--YEEFRIVDVIGLDKEnKAFNASLGTYHDLKKIL-DK DFLDNPDNESILEDIVQTLFEDREMIR | 635 |
| WP_001040095 | 563 | KDIISFLNK---VDGYEGIAIKGIEKQ---FNASLSTYHDLKKIL-GK DFLDNIDNELILEDIVQTLFEDREMIR | 632 |
| WP_001040096 | 563 | KDIISFLNK---VDGYEGIAIKGIEKQ---FNASLSTYHDLKKIL-GK DFLDNIDNELILEDIVQTLFEDREMIR | 632 |
| WP_001040097 | 562 | KDIISFLNK---VDGYEGIAIKGIEKQ---FNASLSTYHDLKKIL-GK DFLDNIDNELILEDIVQTLFEDREMIR | 632 |
| WP_001040098 | 562 | KDIISFLNK---VDGYEGIAIKGIEKQ---FNASLSTYHDLKKIL-GK DFLDNIDNELILEDIVQTLFEDREMIR | 632 |
| WP_001040099 | 562 | KDIISFLNK---VDGYEGIAIKGIEKQ---FNASLSTYHDLKKIL-GK DFLDNIDNELILEDIVQTLFEDREMIR | 632 |
| WP_001040100 | 562 | KKLLDFLAKE--YEEFRIVDVIGLDKEnKAFNASLGTYHDLEKIL-GK DFLDNPDNESILEDIVQTLFEDREMIR | 635 |
| WP_001040104 | 562 | KKLLDFLAKE--YEEFRIVDVIGLDKEnKAFNASLGTYHDLKKIL-GK DFLDNPDNESILEDIVQTLTLFEDREMIR | 635 |
| WP_001040105 | 562 | KKLLDFLAKE--YEEFRIVDVIGLDKEnKAFNASLGTYHDLKKIL-GK DFLDNPDNESILEDIVQTLTLFEDREMIR | 635 |
| WP_001040106 | 562 | KKLLDFLAKE--YEEFRIVDVIGLDKEnKAFNASLGTYHDLKKIL-DK DFLDNPDNESILEDIVQTLTLFEDREMIR | 635 |
| WP_001040107 | 562 | KKLLDFLAKE--YEEFRIVDVIGLDKEnKAFNASLGTYHDLKKIL-DK DFLDNPDNESILEDIVQTLTLFEDREMIR | 635 |
| WP_001040108 | 562 | KKLLDFLAKE--YEEFRIVDVIGLDKEnKAFNASLGTYHDLKKIL-DK DFLDNPDNESILEDIVQTLTLFEDREMIR | 635 |
| WP_001040109 | 562 | KKLLDFLAKE--YEEFRIVDVIGLDKEnKAFNASLGTYHDLKKIL-DK DFLDNPDNESILEDIVQTLTLFEDREMIR | 635 |
| WP_001040110 | 562 | KKLLDFLAKE--YEEFRIVDVIGLDKEnKAFNASLGTYHDLKKIL-DK DFLDNPDNESILEDIVQTLTLFEDREMIR | 635 |
| WP_015058523 | 562 | KQLLDFLAKE--FEEFRIVDVIGLDKEnKAFNASLGTYHDLKKIL-DK DFLDNPDNESILEDIVQTLTLFEDREMIR | 635 |
| WP_017643650 | 563 | KDIISFLNK---VDGYEGIAIKGIEKQ---FNASLSTYHDLKKIL-GK DFLDNIDNELILEDIVQTLTLFEDREMIK | 632 |
| WP_017647151 | 562 | KKLLDFLAKE--YEEFRIVDVIGLDKEnKAFNASLGTYHDLKKIL-DK DFLDNPDNESILEDIVQTLTLFEDREMIK | 635 |
| WP_017648376 | 562 | KKLLDFLAKE--YEEFRIVDVIGLDKEnKAFNASLGTYHDLKKIL-DK DFLDNPDNESILEDIVQTLTLFEDREMIK | 635 |
| WP_017649527 | 562 | KKLLDFLAKE--YEEFRIVDVIGLDKEnKAFNASLGTYHDLKKIL-DK DFLDNPDNESILEDIVQTLTLFEDREMIK | 635 |
| WP_017771611 | 562 | KKLLDFLAKE--YEEFRIVDVIGLDKEnKAFNASLGTYHDLKKIL-DK DFLDNPDNESILEDIVQTLTLFEDREMIK | 635 |

```
WP_017771984   562  KKLLDFLAKE--YEEFRIVDVIGLDKEhKAFNASLGTYHDLEKIL-DK DFLDNPDNESILEDIVQTLTLFEDREMIK  635
CFQ25032       562  KKLLDFLAKE--YEEFRIVDVIGLDKEhKAFNASLGTYHDLEKIL-DK DFLDNPDNESILEDIVQTLTLFEDREMIK  635
CFV16040       562  KKLLDFLAKE--YEEFRIVDVIGLDKEhKAFNASLGTYHDLEKIL-DK DFLDNPDNESILEDIVQTLTLFEDREMIK  635
KLJ37842       562  KKLLDFLAKE--YEEFRIVDVIGLDKEhKAFNASLGTYHDLEKIL-DK DFLDNPDNESILEDIVQTLTLFEDREMIK  635
KLJ72361       562  KKLLDFLAKE--YEEFRIVDVIGLDKEhKAFNASLGTYHDLEKIL-DK DFLDNPDNESILEDIVQTLTLFEDREMIK  635
KLL20707       562  KKLLDFLAKE--YEEFRIVDVIGLDKEhKAFNASLGTYHDLEKIL-DK DFLDNPDNESILEDIVQTLTLFEDREMIK  635
KLL42645       562  KKLLDFLAKE--YEEFRIVDVIGLDKEhKAFNASLGTYHDLEKIL-DK DFLDNPDNESILEDIVQTLTLFEDREMIK  635
WP_047207273   562  KKLLDFLAKE--YEEFRIVDVIGLDKEhKAFNASLGTYHDLKKIL-DK DFLDNPDNESILEDIVQTLTLFEDREMIK  635
WP_047209694   563  KDIISFLNK---VDGYEGIAIKGIEKQ---FNASLSTYHDLKKIL-GK DFLDNIDNELILEDIVQTLTLFEDREMIK  632
WP_050198062   562  KKLLDFLAKE--YEEFRIVDVIGLDKEhKAFNASLGTYHDLEKIL-DK DFLDNPDNESILEDIVQTLTLFEDREMIK  635
WP_050201642   562  KKLLDFLAKE--YEEFRIVDVIGLDKEhKAFNASLGTYHDLKKIL-DK DFLDNPDNESILEDIVQTLTLFEDREMIK  635
WP_050204027   562  KKLLDFLAKE--YEEFRIVDVIGLDKEhKAFNASLGTYHDLKKIL-DK DFLDNPDNESILEDIVQTLTLFEDREMIK  635
WP_050881965   562  KKLLDFLAKE--YEEFRIVDVIGLDKEhKAFNASLGTYHDLEKIL-DK DFLDNPDNESILEDIVQTLTLFEDREMIK  635
WP_050886065   562  KKLLDFLAKE--YEEFRIVDVIGLDKEhKAFNASLGTYHDLEKIL-DK DFLDNPDNESILEDIVQTLTLFEDREMIK  635
AHN30376       562  KQLLDFLAKE--FEEFRIVDVTGLDKEhKAFNASLGTYHDLKKIL-DK DFLDNPDNESILEDIVQTLTLFEDREMIK  635
EAO78426       562  KKLLDFLAKE--YEEFRIVDVIGLDKEhKAFNASLGTYHDLKKIL-DK DFLDNPDNESILEDIVQTLTLFEDREMIK  635
CCW42055       562  KQLLDFLAKE--FEEFRIVDTGLDKEhKAFNASLGTYHDLEKIL-GK SFLDNKENAQIIEDIIQTLTLFEDREMIK  635
WP_003041502   561  DKLLNYLNKE--FEEFRIVNLTGLDKEhKvENSSLGTYHDLRKIL-NK SFLDDKANEKTIEDIIQTLTLFEDREMIR  634
WP_037593752   562  DKLLNYLNKE--FEEFRIVNLTGLDKEhKAENSSLGTYHDLRKIL-DK SFLDDKANEKTIEDIIQTLTLFEDREMIR  635
WP_049516684   562  DKLLNYLNKE--FEEFRIVNLTGLDKEhKAENSSLGTYHDLRKIL-DK SFLDDKANEKTIEDIIQTLTLFEDREMIR  635
GAD46167       561  DKLLNYLNKE--FEEFRIVDLTGLDKEhKAFNASLGTYHDLRKIL-DK SFLDDKVNEKIIEDIIQTLTLFEDREMIR  634
WP_018363470   562  EKLLNYLDKE--FPEYRIQDLVGLDKEhKSFNASLGTYHDLKKIL-DK SFLDDKVNEEVIEDIIKTLTLFEDREMIQ  635
WP_003043819   572  KQLKEDYFKK--IECFDSVEISGVEDR---FNASLGTYHDLLKIIKDK DELDNEENEDILEDIVLILTLFEDREMIE  643
WP_006269658   561  DKLLNYLDKE--FEEFRIVDLTGLDKEhKAFNASLGTYHDLKKIL-DK SFLDDKANEKTIEDIIQTLTLFEDREMIE  634
WP_048800889   562  DKLLNYLNKE--FEEFRIVDLTGLDKEhKAFNASLGTYHDLLKIL-DK DELDNEENEDILEDIVLILTLFEDKEMIE  635
WP_012767106   562  KQLKEDYFKK--IECFDSVEISGVEDR---FNASLGTYHDLLKIIKDK DELDNEENEDILEDIVLILTLFEDKEMIE  633
WP_014612333   562  KQLKEDYFKK--IECFDSVEISGVEDR---FNASLGTYHDLLKIIKDK DELDNEENEDILEDIVLILTLFEDKEMIE  633
WP_015017095   562  KQLKEDYFKK--IECFDSVEISGVEDR---FNASLGTYHDLLKIIKDK DELDNEENEDILEDIVLILTLFEDKEMIE  633
WP_015057649   562  KQLKEDYFKK--IECFDSVEISGVEDR---FNASLGTYHDLLKIIKDK DELDNEENEDILEDIVLILTLFEDKEMIE  633
WP_048327215   562  KQLKEDYFKK--IECFDSVEISGVEDR---FNASLGTYHDLLKIIKDK DELDNEENEDILEDIVLILTLFEDKEMIE  633
WP_049519324   562  KQLKENYFKK--IECWDSVEITGVEDS---FNASLGTYHDLLKIIQDK DFLDNPDNQKIIEDIILTLTLFEDKKMIS  633
WP_012515931   562  KQLKENYFKK--IECWDSVEITGVEDS---FNASLGTYHDLLKIIQDK DFLDNPDNQKIIEDIILTLTLFEDKKMIS  633
WP_021320964   562  KQLKENYFKK--IECWDSVEITGVEDS---FNASLGTYHDLLKIIQDK DFLDNPDNQKIIEDIILTLTLFEDKKMIS  633
WP_037581760   561  KQLKENYFKK--IECWDSVEITGVEDS---FNASLGTYHDLLKIIQDK DFLDNPDNQKIIEDIILTLTLFEDKKMIS  633
WP_004232481   561  AKLLSYLNNE--FEEFRINDLIGLDKDsKSFNASLGTYHDLLKIIKDK SFLDDKTNEQIIEDIVLTLTLFEDRDMIH  634
WP_009854540   562  EKLLNYLNNE--FPEYRIKDLIGLDKEhKSFNASLGTYHDLLKILL-DK DELDNSKNEKILEDIVLILTLFEDKDMIH  635
WP_012962174   562  DKFLNYLNNE--FPEYRIQDLIGLDKEhKSFNASLGTYHDLLKIL-DK AFLDDKTNETIEDIIQTLTLFEDREMIR  635
WP_039695303   564  EKLLNYLNNE--FPEYRIKDLIGLDKEhKSFNASLGTYHDLLKIL-DK AFLDDKVNEEVIEDIIKTLTLFEDKDMIH  637
WP_014334983   561  AKLLSYLNNE--FEEFRINDLIGLDKDsKSFNASLGTYHDLLKIL-DK SELDDKINGQIIEDIVLIITLFEDRDMIH  634
WP_030099269   562  KQLKEEYESK--MKCFHTVTILGVEDR---FNASLGTYHDLLKIFKDK AFLDDEANQDILEEIWTLLTLFEDQAMIE  634
AHY15608       562  KQLKEEYESK--MKCFHTVTILGVEDR---FNASLGTYHDLLKIFKDK AFLDDEANQDILEEIWTLLTLFEDQAMIE  633
AHY17476       562  KQLKEEYESK--MKCFHTVTILGVEDR---FNASLGTYHDLLKIFKDK AFLDDEANQDILEEIWTLLTLFEDQAMIE  633
ESR09100       ---  ---------------------------------------------  ---------------------------   ---
AGM98575       562  KQLKEYESK---MKCFHTVTILGVEDR---FNASLGTYHDLLKIFKDK AFLDDEANQDILEEIWTLLTLFEDQAMIE  633
ALF27331       561  DKLMDFLEKE--FDEFRIVDLTGLDKEhKAFNASLGTYHDLRKIL-DK DELDNSKNEKILEDIVLILTLFEDREMIR  634
WP_018372492   574  RKLKDFIEKElgYGYIDIDNIKGVEEQ---FNASYTTYQDLLKIIGDK EFLDNEENKDLLEEIIYILTVFEDRKMIE  647
WP_045618028   563  KDIIQYLHN---VDSYDGIELKGIEKQ---FNASLSTYHDLLKIIKDK EFMDDSKNEAILENIVHTLTIFEDREMIK  633
WP_045635197   562  KDIIHYLHN---VDGYDGIELKGIEKQ---FNASLSTYHDLCKIL-DK EFMDDAKNEAILENIVHTLTIFEDREMIK  632
WP_002263549   561  DKLMDFLEKE--FDEFRIVDLTGLDKEhKvFNASYGTYHDLLKIL-DK DELDNSKNEKILEDIVLILTLFEDREMIR  634
WP_002263887   561  DKLMDFLEKE--FDEFRIVDLTGLDKEhKAFNASYGTYHDLCKIL-DK DELDNSKNEKILEDIVLILTLFEDREMIR  634
WP_002264920   561  DKLMDFLEKE--FDEFRIVDLTGLDKEhKvFNASYGTYHDLLKIL-DK DELDNSKNEKILEDIVLILTLFEDREMIR  634
WP_002269043   561  DKLMDFLEKE--FDEFRIVDLTGLDKEhKAFNASYGTYHDLRKIL-DK DELDNSKNEKILEDIVLILTLFEDREMIR  634
WP_002269448   561  DKLMDFLEKE--FDEFRIVDLTGLDKEhKvFNASYGTYHDLCKIL-DK DELDNSKNEKILEDIVLILTLFEDREMIR  634
```

-continued

```
WP_002271977  561  DKLMDFLEKE--FDEFRIVDLTGLDKEnkVFNASYGTYHDLCKIL-DK  DELDNSKNEKILEDIVLILTLFEDREMIR  634
WP_002272766  561  DKLMDFLEKE--FDEFRIVDLTGLDKEnkVFNASYGTYHDLCKIL-DK  DELDNSKNEKILEDIVLILTLFEDREMIR  634
WP_002273241  561  DKLMDFLEKE--FDEFRIVDLTGLDKEnkVFNASYGTYHDLCKIL-DK  DELDNSKNEKILEDIVLILTLFEDREMIR  634
WP_002275430  561  DKLMDFLEKE--FDEFRIVDLTGLDKEnkAFNASYGTYHDLCKIL-DK  DELDNSKNEKILEDIVLILTLFEDREMIR  634
WP_002276448  561  KKLRTFLDKN--FDEFRIVDLTGLDKEteTENASYATYQDLLKVIKDK  VFMDNPENAEILENIVLTLTLFEDREMIR  635
WP_002277050  561  DKLMDFLEKE--FDEFRIVDLTGLDKEnkAFNASYGTYHDLRKIL-DK  DELDNSKNEKILEDIVLILTLFEDREMIR  634
WP_002277364  561  DKLMDFLEKE--FDEFRIVDLTGLDKEnkAFNASYGTYHDLRKIL-DK  DELDNSKNEKILEDIVLILTLFEDREMIR  634
WP_002279025  561  DKLMDFLEKE--FDEFRIVDLTGLDKEnkVFNASYGTYHDLRKIL-DK  DELDNSKNEKILEDIVLILTLFEDREMIR  634
WP_002279859  561  DKLMDFLEKE--FDEFRIVDLTGLDKEnkVFNASYGTYHDLRKIL-DK  DELDNSKNEKILEDIVLILTLFEDREMIR  634
WP_002280230  561  DKLMDFLEKE--FDEFRIVDLTGLDKEnkVFNASYGTYHDLRKIL-DK  DELDNSKNEKILEDIVLILTLFEDREMIR  634
WP_002281696  561  DKLMDFLEKE--FDEFRIVDLTGLDKEnkAFNASYGTYHDLCKIL-DK  DELDNSKNEKILEDIVLILTLFEDREMIR  634
WP_002282247  561  KKLRTFLDKN--FDEFRIVDIQGLDKEteTENASYATYQDLLKVIKDK  VFMDNPENAEILENIVLTLTLFEDREMIR  635
WP_002282906  561  DKLMDFLEKE--FDEFRIVDLTGLDKEnkAFNASYGTYHDLCKIL-DK  DELDNSKNEKILEDIVLILTLFEDREMIR  634
WP_002283846  561  DKLMDFLEKE--FDEFRIVDLTGLDKEnkAFNASYGTYHDLRKIL-DK  DELDNSKNEKILEDIVLILTLFEDREMIR  634
WP_002287255  561  DKLMDFLEKE--FDEFRIVDLTGLDKEnkAFNASYGTYHDLRKIL-DK  DELDNSKNEKILEDIVLILTLFEDREMIR  634
WP_002288990  561  DKLMDFLEKE--FDEFRIVDLTGLDKEnkAFNASYGTYHDLRKIL-DK  DELDNSKNEKILEDIVLILTLFEDREMIR  634
WP_002289641  561  DKLMDFLEKE--FDEFRIVDLTGLDKEnkVFNASYGTYHDLCKIL-DK  DELDNSKNEKILEDIVLILTLFEDREMIR  634
WP_002290427  561  DKLMDFLEKE--FDEFRIVDLTGLDKEnkAFNASYGTYHDLRKIL-DK  DELDNSKNEKILEDIVLILTLFEDREMIR  634
WP_002295753  561  DKLMDFLEKE--FDEFRIVDLTGLDKEnkVFNASYGTYHDLRKIL-DK  DELDNSKNEKILEDIVLILTLFEDREMIR  634
WP_002296423  561  DKLMDFLEKE--FDEFRIVDLTGLDKEnkAFNASYGTYHDLRKIL-DK  DELDNSKNEKILEDIVLILTLFEDREMIR  634
WP_002304487  571  DKLLNYLNKE--FEEFRIVNLTGLDKEVENSSLGTYHDLRKIL-NK  SFLDNKENEQIIEDIIQTLTLFEDREMIR  644
WP_002305844  561  DKLMDFLEKE--FDEFRIVDLTGLDKEnkAFNASYGTYHDLRKIL-DK  DELDNSKNEKILEDIVLILTLFEDREMIR  634
WP_002307203  561  DKLMDFLEKE--FDEFRIVDLTGLDKEnkAFNASYGTYHDLRKIL-DK  DELDNSKNEKILEDIVLILTLFEDREMIR  634
WP_002310390  561  DKLMDFLEKE--FDEFRIVDLTGLDKEnkAFNASYGTYHDLRKIL-DK  DELDNSKNEKILEDIVLILTLFEDREMIR  634
WP_002352408  561  DKLMDFLEKE--FDEFRIVDLTGLDKEnkAFNASYGTYHDLRKIL-DK  DELDNSKNEKILEDIVLILTLFEDREMIR  634
WP_012997688  561  DKLMDFLEKE--FDEFRIVDLTGLDKEnkVFNASYGTYHDLCKIL-DK  DELDNSKNEKILEDIVLILTLFEDREMIR  634
WP_014677909  561  DKLMDFLEKE--FDEFRIVDIQGLDKEnkVFNASYGIYHDLCKIL-DK  DELDNSKNEKILEDIVLILTLFEDREMIR  634
WP_019312892  561  DKLMDFLEKE--FDEFRIVDLTGLDKEnkVFNASYGIYHDLRKIL-DK  DELDNSKNEKILEDIVLILTLFEDREMIR  634
WP_019313659  561  DKLMDFLEKE--FDEFRIVDLTGLDKEnkAFNASYGTYHDLCKIL-DK  DELDNSKNEKILEDIVLILTLFEDREMIR  634
WP_019314093  561  DKLMDFLEKE--FDEFRIVDLTGLDKEnkAFNASYGTYHDLRKIL-DK  DELDNSKNEKILEDIVLILTLFEDREMIR  634
WP_019315370  561  DKLMDFLEKE--FDEFRIVDLTGLDKEnkAFNASYGTYHDLRKIL-DK  DELDNSKNEKILEDIVLILTLFEDREMIR  634
WP_019803776  561  DKLMDFLEKE--FDEFRIVDLTGLDKEnkAFNASYGTYHDLRKIL-DK  DELDNSKNEKILEDIVLILTLFEDREMIR  634
WP_019805234  561  DKLMDFLEKE--FDEFRIVDLTGLDKEnkAFNASYGTYHDLCKIL-DK  DELDNSKNEKILEDIVLILTLFEDREMIR  634
WP_024783594  561  DKLMDFLEKE--FDEFRIVDLTGLDKEnkAFNASYGTYHDLCKIL-DK  DELDNSKNEKILEDIVLILTLFEDREMIR  634
WP_024784288  561  KKLRTFLDKN--FDEFRIVDLTGLDKEteTENASYATYQDLLKVIKDK  VFMDNPENAEILENIVLTLTLFEDREMIK  635
WP_024784666  561  DKLMDFLEKE--FDEFRIVDLTGLDKEnkAFNASYGTYHDLRKIL-DK  DELDNSKNEKILEDIVLILTLFEDREMIR  634
WP_024784894  561  DKLMDFLEKE--FDEFRIVDLTGLDKEnkAFNASYGTYHDLRKIL-DK  DELDNSKNEKILEDIVLILTLFEDREMIR  634
WP_024786433  561  KKLRTFLDKN--FDEFRIVDIQGLDKEteTENASYATYQDLLKVIKDK  VFMDNPENAEILENIVLTLTLFEDREMIK  635
WP_049473442  561  DKLMDFLEKE--FDEFRIVDLTGLDKEnkVFNASYGIYHDLCKIL-DK  DFLDNSKNEKILEDIVLTLTLFEDREMIR  634
WP_049474547  554  DKLMDFLEKE--FDEFRIVDLTGLDKEnkAFNASYGIYHDLCKIL-DK  DFLDNSKNEAILENIVHTLTLFEDREMIR  627
EMC03581      565  KDIIQYLHT---VDGYDGIELKGIEKQ---FNASLSTYHDLLKIIKDK  EFMDDPNNEEILENIVHTLTIFEDREMIK  635
WP_000428612  563  KDIIQFLHN---VDGYDGIELKGIEKQ---FNASLSTYHDLLKIIKDN  EFMDDSKNEEILENIVHTLTIFEDREMIK  633
WP_000428613  562  KDIHYLHN----VDGYDGIELKGIEKH---FNSSLSTYHDLLKIIKDK  EFMDDPKNEEIFENIVHTLTIFEDRVMIK  632
WP_049523028  531  KQLKENYFNK--IRCLDSITISGVEDK---FNASLGTYHDLLNIIKNQ  KILDDEQNQDSLEDIVLTLTLFEDREKMIA  602
WP_003107102  564  KQLKEDFFSK--IECFDTVDISGVEDK---FNASLGTYHDLLKIIKDK  AFLDNSENENIIEDILILTLFEDREMIA  635
WP_054279288  563  KDLIHYLHN---VDGYDGIELKGIEKQ---FNASLGTYHDLLKIIKDK  RFMDEPKNQEILENIVHTLTIFEDREMIK  633
WP_049531101  563  KDIIQYLHN---VDGYDGIELKGIEKQ---FNASLGTYHDLLKIIKDK  EFMDDSKNEEILENIVHTLTIFEDREMIK  633
WP_049538452  565  KDIHYLHT----VDGYDGIELKGIEKQ---FNASLGTYNDLLKIIKDK  EFMDDSKNEAILENIVHTLTIFEDREMIK  636
WP_049549711  517  KDLKEKYFSQ--IEGLENVDTGVEGA---FNASLGTYNDLLKIIKDK  AFLDDEANAEILEEIVLILTLFQDEKLIE  588
WP_007896501  562  KDLKEKYFSQ--IRGLENDVTGVEGA---FNASLGTYNDLLKIKTKDK  AFLDDEANAEILEEIVLILTLFQDEKLIE  632
EFR44625      562  KDIHYLHN----VDGYDGIELKGIEKQ---FNANLSTYHDLLKITKDK  EFMDDPKNEEILENIVHTLTIFEDREMIK  632
WP_002897477  562  KDIHYLHN----VDGYDGIELKGIEKQ---FNASLSTYHDLLKIIKDK  EFMDNPKNGEILENIIHTLTIFEDREMIK  632
WP_002906454
```

```
-continued

WP_009729476  563  KDIIQFLHN---VDGYDGIELKGIEKQ---FNASLSTYHDLLKIIKDK AFMDDAKNEAILENIVHTLTIFEDREMIK  633
CQR24647      562  KKILNFLDKN---FDEFRITDIQGLDNEtgNFNASYGIYHDLLKIIGDK EFMDSSDNVDVLEDIVLSLTLFEDREMIK  636
WP_000066813  565  KDIIHYLHN----VDGYDGIELKGIEKQ---FNASLSTYHDLLKIIKDK AFMDDSKNEEILENIIHTLTIFEDREMIK  635
WP_009754323  563  KDIIHYLHN----VDGYDGIELKGIEKQ---FNASLSTYHDLLKIIKDK EFMDNHKNQEILENIVHTLTIFEDREMIK  633
WP_044674937  562  KDIKAYL-EN---SNGYAGVELKGLEEQ---FNASLPTYHDLLKKIV-SK AFIDAEENQEILEDIVLTLTLFEDREMIR  632
WP_044676715  561  EKLMDFLGKE---FDEFRIVDLLGLDKDhkSFNASLGTYHDLKKIV-SK DLLDNPENEDILENVVLTLTLFEDREMIR  634
WP_044680361  561  EKLMDFLGKE---FDEFRIVDLLGLDKDnkSFNASLGTYHDLKKIV-SK DLLDNPENEDILENVVLTLTLFEDREMIR  634
WP_044681799  562  KDIKAYL-EN---SNGYAGVELKGLEEQ---FNASLPTYHDLLKKIV-SK AFIDAEENQEILEDIVLTLTLFEDREMIR  632
WP_049533112  561  DKLLNYLGKE---FDEFRIVDLTGLDKEnkVFNSSLGTYHDLRKIL-DK SFLDNKENEQIIEDIIQTLTLFEDREMIR  634
WP_029090905  541  TSLKKWLAEH---EHMTVSVVQGTQKEt-EFATSLQAFHRFVKIF-DR ETVSNPANEEMFEKIIYWSTVFEDKKIMR  612
WP_006506696  562  KKLKNWLVNNgcCS--KDAEIKGFQKEn-QESTSLIPWIDETNIFGKI ---DQSNFDLIENIIYDLTVFEDKKIMK   637
AIT42264      568  KQLKEDYFKK---IECFDSVEISGVEDR---FNSNYSTYIDLSKIPDMK ---LLEKDEDEILEEIIKILTIFEDRKMRK  633
WP_034440723  562  NQLVKYIENK---EQIIAPEIKGIEDS---FNASLGTYHDLLKIIKDK DFLDNEENEDILEDIVLTLTLFEDREMIE  637
AKQ21048      563  KQLKEDYFKK---IECFDSVEISGVEDR---FNASLGTYHDLLKIIKDK DFLDNEENEDILEDIVLTLTLFEDREMIE  633
WP_004636532  570  KDIANYLEQ----YGVVDGTDIKGVEDK---FNALSTYNDLAKIDGAK AYLDDPEYADVWEDIIKILTIFEDKAMRK  633
WP_002378009  570  KDIIQFYRNE---YN-TEIVILSGLEED---QFNASFSTYQDLLKCGLIR AELDHPDNAEKLEDIIKILTIFEDRQRIR  641
WP_002407324  572  KDIIQFYRNE---YN-TEIVILSGLEED---QFNASFSTYQDLLKCGLIR AELDHPDNAEKLEDIIKILTIFEDRQRIR  641
WP_002413717  570  KDIIQFYRNE---YN-TEIVILSGLEED---QFNASFSTYQDLLKCGLIR AELDHPDNAEKLEDIIKILTIFEDRQRIR  641
WP_010775580  521  KDIIQFYRNE---YN-TEIVILSGLEED---QFNASFSTYQDLLKCGLIR AELDHPDNAEKLEDIIKILTIFEDRQRIR  643
WP_002364836  306  KDIIQFYRNE---YN-TEIVILSGLEED---QFNASFSTYQDLLKCGLIR AELDHPDNAEKLEDIIKILTIFEDRQRIR  592
WP_016631044  570  KDIIQFYRNE---YN-TEIVILSGLEED---QFNASFSTYQDLLKCGLIR AELDHPDNAEKLEDIIKILTIFEDRQRIR  381
EMS75795      570  KKLQQFLSAN---YN-IEDAEILGVDKA---FNSSYATYHDFLDLAKPN ELLEQPEMNAMFEDIVKILTIFEDREMIR  641
WP_002373311  570  KDIIQFYRNE---YN-TEIVILSGLEED---QFNASFSTYQDLLKCGLIR AELDHPDNAEKLEDIIKILTIFEDRQRIR  641
WP_010818269  570  KDIIQFYRNE---YN-TEIVILSGLEED---QFNASFSTYQDLLKCGLIR AELDHPDNAEKLEDIIKILTIFEDRQRIR  641
WP_010824395  570  KDIIQFYRNE---YN-TEIVTLSGLEED---QFNASFSTYQDLLKCGLTR AELDHPDNAEKLEDIIKILTIFEDRQRIR  641
WP_016622645  570  KDIIQFYRNE---YN-TEIVTLSGLEED---QFNASFSTYQDLLKCGLTR AELDHPDNAEKLEDIIKILTIFEDRQRIR  641
WP_033624816  570  KDIIQFYRNE---YN-TEIVTLSGLEED---QFNASFSTYQDLLKCGLTR AELDHPDNAEKLEDIIKILTIFEDRQRIR  641
WP_033625576  570  KDIIQFYRNE---YN-TEIVTLSGLEED---QFNASFSTYQDLLKCGLTR AELDHPDNAEKLEDIIKILTIFEDRQRIR  641
WP_033789179  570  KDIIQFYRNE---YN-TEIVTLSGLEED---QFNASFSTYQDLLKCGLTR AELDHPDNAEKLEDIIKILTIFEDRQRIR  641
WP_002310644  567  KDLQEFLYLK---YD-IKHAELSGIEKA---FNASYTTYHDFLTMSENK QWLEDPELASMFEEIIKILTVFEDREMIK  641
WP_002312694  568  KDLQEFLYLK---YD-IKHAELSGIEKA---FNASYTTYHDFLTMSENK QWLEDPELASMFEEIIKILTVFEDREMIK  642
WP_002314015  568  KDLQEFLYLK---YD-IKHAELSGIEKA---FNASYTTYHDFLTMSENK QWLEDPELASMFEEIIKILTVFEDREMIK  642
WP_002320716  568  KDLQEFLYLK---YD-IKHAELSGIEKA---FNASYTTYHDFLTMSENK QWLEDPELASMFEEIIKILTVFEDREMIK  642
WP_002330729  567  KDLQEFLYLK---YD-IKHAELSGIEKA---FNASYTTYHDFLTMSENK QWLEDPELASMFEEIIKILTVFEDREMIK  641
WP_002335161  568  KDLQEFLYLK---YD-IKHAELSGIEKA---FNASYTTYHDFLTMSENK QWLEDPELASMFEEIIKILTVFEDREMIK  642
WP_002345439  568  KDLQEFLYLK---YD-IKHAELSGIEKA---FNASYTTYHDFLTMSENK QWLEDPELASMFEEIIKILTVFEDREMIK  642
WP_034867970  562  KKLQNFLYTH---YH-IENAQIFGIEKA---FNASYSTYHDFMKLAKTN EWLEQPEMEPIFEDIVKILTIFEDRQMIK  637
WP_047937432  568  KDLQEFLYLK---YD-IKHAELSGIEKA---FNASYTTYHDFLTMSENK QWLEDPELASMFEEIIKILTVFEDREMIK  642
WP_010720994  562  KKLQNFLYTH---YH-IENAQIFGIEKA---FNASYSTYHDFMKLAKTN EWLEQPEMEPIFEDIVKILTIFEDRQMIK  637
WP_010737004  562  KKLQNFLYTH---YH-IENAQIFGIEKA---FNASYSTYHDFMKLAKTN EWLEQPEMEPIFEDIVKILTIFEDRQMIK  637
WP_034700478  564  KKLENYLRIEl---SISSPSVKGIEEQ---FNANFPGTYLDLKKFDELH PYLDDEKYQDTLEEVIKVLTVFEDRSMIQ  634
WP_007209003  560  KQLRKFLELN---EQ-IDSTEIKGIETS---FNASYSTYHDLLKlLS---  ILLDPDMITMFEEIIKILTIFEDREMIR  631
WP_023519917  564  KLLEKFLSNE---FG-LVDVAIKGIE-T---SFNAGYGTYHDFLKIGITR EQLDKEENSETLEEIVKILTVFEDRKMIR  634
WP_010770040  560  KDLSNFLRNE---YN-LDDVIIDGIE-N---KFNASRNTYHDLLKLKIDP KVLDDPANEPMFEEIVKILTIFEDRKMLR  634
WP_048604708  561  KKLQHFLSAN---YN-IEDAEILGVDKV---FNSSYATYHDFLELAKPY ELLEQPEMEEMFEDIVKITTIFEDREMVR  630
WP_010750235  601  KQLKEDYFKK---IECFDSVEISGVEDR---FNASLGTYHDLLKIIKDK DFLDNEENEDILEDIVLTLTLFEDREMIE  636
AII16583      576  NAMKKWLVKNgyFSNIDDIKIEGFQKEn-ACSTSLIPWIDETKIFGEI ---NNSNYELIEKIIYDVVFEDKKILR    672
WP_029073316  576  NAMKKWLVKNgyFSNIDDIKIEGFQKEn-ACSTSLIPWIDETKIFGKI ---NESNYDFIEKIIYDVTVFEDKKILR   647
WP_031589969  558  KMVIKHLKVV---MPAIRIQALKGLDNGk--FNASYGTYKDLVDMGVAP ELLNDEVNSEKWEDIIKTLTIFEGRKLIK  647
KDA45870      579  KNIQDYLVSEk--RYASRPAITGLSDEnk-FNSRLSTYHDLKTIVGDA ---VDDVDKQADLEKCIEWSTIFEDGKIYS  630
WP_039099354  561  KKLIKWLIAQg----YYKNPILIGLSQKQ-EFNSTLITYLDMKKIFGSS ---FMENNKNYNQIEEELIEWLTIFEDKQILN  650
AKP02966      567  KDLELFLRNM---SH-VESPTIEGLE-D---SFNSSYSTYHDLLKVGIKQ EILDNPVNTEMLENIVKILTIFEDKRMIK  632
WP_010991369           637
```

-continued

| | | | | |
|---|---|---|---|---|
| WP_033838504 | 567 | KDLELFLRNM--SH-VESPTIEGLE-D-SFNSSYSTYHDLLKVGIKQ | EILDNPVNTEMLENIVKILTVFEDKRMIK | 637 |
| EHN60060 | 570 | KDLELFLRNM--SH-VESPTIEGLE-D-SFNSSYSTYHDLLKVGIKQ | EILDNPVNTEMLENIVKILTVFEDKRMIK | 640 |
| EFR89594 | 336 | KDLELFLRNM--SH-VESPTIEGLE-D-SFNSSYSTYHDLLKVGIKQ | EILDNPVNTEMLENIVKILTVFEDKRMIK | 406 |
| WP_038409211 | 567 | KDLERFLYTI--NH-IESPTIEGVE-D-AFNSSFATYHDLLQKGGVTQ | EILDNPLNADMLEEIVKILTVFEDKRMIK | 637 |
| EFR95520 | 186 | KDLERFLYTI--NH-IESPTIEGVE-D-AFNSSFATYHDLLQKGGVTQ | EILDNPLNADMLEEIVKILTVFEDKRMIK | 256 |
| WP_003723650 | 567 | KDLELFLRNI--NH-IESPTIEGLE-D-SFNASYATYHDLLKVGMKQ | EILDNPLNTEMLEDIVKILTVFEDKPMIK | 637 |
| WP_003727705 | 567 | KDLELFLRNI--NH-IESPTIEGLE-D-SFNASYATYHDLLKVGLKQ | EILDNPLNTEILEDIVKILTVFEDKPMIK | 637 |
| WP_003730785 | 567 | KDLELFLRNI--NH-IESPTIEGLE-D-SFNASYATYHDLLKVGLKQ | EILDNPLNTELEDIVKILTVFEDKPMIK | 637 |
| WP_003733029 | 567 | KDLELFLRNI--NQ-IESPTIEGLE-D-SFNASYATYHDLLKVGMKQ | EILDNPLNTEMLEDIVKILTVFEDKRMIK | 637 |
| WP_003739838 | 567 | KDLEQFLRNM--SH-IESPTIEGLE-D-SENSSYATYHDLLKVGIKQ | EVLENPLNTEMLEDIVKILTVFEDKRMIK | 637 |
| WP_014601172 | 567 | KDLELFLRNI--NH-IESPTIEGLE-D-SFNASYATYHDLLKVGMKQ | EILDNPLNTEMLEDIVKILTVFEDKPMIK | 637 |
| WP_023548323 | 567 | KDLELFLRNI--NH-VESPTIEGLE-D-SFNASYATYHDLMKVGIKQ | EILDNPLNTEMLEDIVKILTVFEDKPMIK | 637 |
| WP_031665337 | 567 | KDLELFLRNI--NQ-IESPTIEGLE-D-SFNASYATYHDLLKVGMKQ | EILDNPLNTEMLEDIVKILTVFEDKPMIK | 637 |
| WP_031669209 | 567 | KDLELFLRNI--NQ-IESPTIEGLE-D-SFNASYATYHDLMKVGIKQ | EILDNPLNTEMLEDIVKILTVFEDKPMIK | 637 |
| WP_033920898 | 567 | KDLELFLRNI--NH-IESPTIEGLE-D-SFNASYATYHDLLMKVGIKQ | EILDNPLNTEMLEDIVKILTVFEDKPMIK | 637 |
| AKI42028 | 570 | KDLELFLRNI--NH-IESPTIEGLE-D-SFNASYATYHDLLKVGMKQ | EILDNPLNTEMLEDIVKILTVFEDKPMIK | 640 |
| AKI50529 | 570 | KDLELFLRNI--NQ-IESPTIEGLE-D-SFNASYATYHDLLKVGMKQ | EILDNPLNTEMLEDIVKILTVFEDKPMIK | 640 |
| EFR83390 | 15 | KDLELFLYNM--NH-VESPTVEGVE-D-AFNSSFTTYHDLQKVGVPQ | EILDDPLNTEMLEEIIKILTVFEDKRMIK | 85 |
| WP_046323366 | 567 | KDLELFLRNI--NH-VESPTIEGLE-D-SFNASYATYHDLLKVGMKQ | EILDDPLNTEMLEDIVLILTLFEDREMIE | 637 |
| AKE81011 | 578 | KQLKEDYFKK--IECFDSVEISGVEDR--FNASLGTYHDLLKIIKDK | DELDNEENEDILEDIVLIILTLFEDREMIE | 649 |
| CUO82355 | 572 | KKLKNWLVNNqcCR--KDAEIKGFqKeN-QESTSLTPWIDETNIFGKI | ---DQSNFDLIEKIIYDLTVFEDKKIMK | 641 |
| WP_033162887 | 573 | KKLKDWLVTHqyYDINEELKIEGYQKDI-QESTSLAPWIDETKIFGEI | ----NASNYQLIEKIIYDISIFEDKKILK | 644 |
| AGZ01981 | 595 | KQLKEDYFKK--IECFDSVEISGVEDR---FNASLGTYHDLLKIIKDK | DELDNEENEDILEDIVLIILTLFEDREMIE | 666 |
| AKA60242 | 562 | KQLKEDYFKK--IECFDSVEISGVEDR---FNASLGTYHDLLKIIKDK | DELDNEENEDILEDIVLIILTLFEDREMIE | 633 |
| AKS40380 | 566 | KQLKEDYFKK--IECFDSVEISGVEDR---FNASLGTYHDLLKIIKDK | DELDNEENEDILEDIVLIILTLFEDREMIE | 637 |
| 4UN5_B | 634 | KQLKEDYFKK--IECFDSVEISGVEDR---FNASLGTYHDLLKIIKDK | QSGKTILDFLK ---ANRNFMQLIHDDSL | 702 |
| WP_010922251 | 638 | ERLKTYAHLFDDKVMKQLKR--RRYTGWGRLSRKLINGIRDK | QSGKTILDFLK DGf---ANRNFMQLIHDDIL | 706 |
| WP_039695303 | 633 | ERLQKYSDIFTANQLKKLER-RHYTGWGRLSYKLINGIRNK | ENNKTILDYLI DDG---SANRNFMQLINDDIL | 701 |
| WP_045635197 | 369 | QRLAQYDSLFDEKVIKALTR-RHYTGWGRLSAKLINGICDK | QTGNTILDYLI DDG---KINRNFMQLINDDGL | 426 |
| 5AXW_A | 318 | EELTNLNSELTQEEIEQISNIKGYIGTHNLSLKAINLIIDE | -------LW- ---TNDNQIAIFNRLKL | 386 |
| WP_009880683 | 634 | ERLKTYAHLFDDKVMKQLKR-RHYTGWGRLSRKLINGIRDK | QSGKTILDFLK -DGf---ANRNFMQLIHDDSL | 702 |
| WP_010922251 | 634 | ERLKTYAHLFDDKVMKQLKR-RHYTGWGRLSRKLINGIRDK | QSGKTILDFLK -DGf---ANRNFMQLIHDDSL | 702 |
| WP_011054416 | 634 | ERLKTYAHLFDDKVMKQLKR-RHYTGWGRLSRKLINGIRDK | QSGKTILDFLK -DGf---ANRNFMQLIHDDSL | 702 |
| WP_011284745 | 634 | ERLKTYAHLFDDKVMKQLKR-RHYTGWGRLSRKLINGIRDK | QSGKTILDFLK -DGf---ANRNFMQLIHDDSL | 702 |
| WP_011285506 | 634 | ERLKTYAHLFDDKVMKQLKR-RHYTGWGRLSRKLINGIRDK | QSGKTILDFLK -DGf---ANRNFMQLIHDDSL | 702 |
| WP_011527619 | 634 | ERLKTYAHLFDDKVMKQLKR-RRYTVWGRLSRKLINGIRDK | QSGKTILDFLK -DGf---ANRNFMQLIHDDSL | 702 |
| WP_012560673 | 634 | ERLKTYAHLFDDKVMKQLKR-RRYTGWGRLSRKLINGIRDK | QSGKTILDFLK -DGf---ANRNFMQLIHDDSL | 702 |
| WP_014407541 | 634 | ERLKTYAHLFDDKVMKQLKR-RRYTGWGRLSRKLINGIRDK | QSGKTILDFLK -DGf---ANRNFMQLIHDDSL | 702 |
| WP_020905136 | 634 | ERLKTYAHLFDDKVMKQLKR-RRYTGWGRLSRKLINGIRDK | QSGKTILDFLK -DGf---ANRNFMQLIHDDSL | 702 |
| WP_023080005 | 634 | ERLKTYAHLFDDKVMKQLKR-RRYTGWGRLSRKLINGIRDK | QSGKTILDFLK -DGf---ANRNFMQLIHDDSL | 702 |
| WP_023610282 | 634 | ERLKTYAHLFDDKVMKQLKR-RRYTGWGRLSRKLINGIRDK | QSGKTILDFLK -DGf---ANRNFMQLIHDDSL | 702 |
| WP_030125963 | 634 | ERLKTYAHLFDDKVMKQLKR-RRYTGWGRLSRKLINGIRDK | QSGKTILDFLK -DGf---ANRNFMQLIHDDSL | 702 |
| WP_030126706 | 634 | ERLKTYAHLFDDKVMKQLKR-RRYTGWGRLSRKLINGIRDK | QSGKTILDFLK -DGf---ANRNFMQLIHDDSL | 702 |
| WP_031488318 | 634 | ERLKTYAHLFDDKVMKQLKR-RRYTGWGRLSRKLINGIRDK | QSGKTILDFLK -DGf---ANRNFMQLIHDDSL | 702 |
| WP_032460140 | 634 | ERLKKYAHLFDDKVMKQLKR-RRYTGWGRLSRKLINGIRDK | QSGKTILDFLK -DGf---ANRNFMQLIHDDSL | 702 |
| WP_032461047 | 634 | ERLKTYAHLFDDKVMKQLKR-RRYTGWGRLSRKLINGIRDK | QSGKTILDFLK -DGf---ANRNFMQLIHDDSL | 702 |
| WP_032462016 | 634 | ERLKKYAHLFDDKVMKQLKR-RRYTGWGRLSRKLINGIRDK | QSGKTILDFLK -DGf---ANRNFMQLIHDDSL | 702 |
| WP_032462936 | 634 | ERLKKYAHLFDDKVMKQLKR-RRYTGWGRLSRKLINGIRDK | QSGKTILDFLK -DGf---ANRNFMQLIHDDSL | 702 |
| WP_032464890 | 459 | ERLKTYAHLFDDKVMKQLKR-RRYTGWGRLSRKLINGIRDK | QSGKTILDFLK -DGf---ANRNFMQLIHDDSL | 527 |
| WP_033888930 | 634 | ERLKTYAHLFDDKVMKQLKR-RRYTGWGRLSRKLINGIRDK | QSGKTILDFLK -DGf---ANRNFMQLIHDDSL | 702 |
| WP_038431314 | 634 | ERLKKYAHLFDDKVMKQLKR-RRYTGWGRLSRKLINGIRDK | QSGKTILDFLK -DGf---ANRNFMQLIHDDSL | 702 |
| WP_038432938 | 634 | ERLKTYANLFDDKVMKQLKR-RHYTGWGRLSRKLINGIRDK | QSGKTILDFLK -DGf---ANRNFMQLIHDDSL | 702 |

| | | | | |
|---|---|---|---|---|
| WP_038434062 | 634 | ERLKTYAHLFDDKVMKQLKR-RRYTGWGRLSRKLINGIRDK | QSGKTILDFLK-DGf---ANRNFMQLIHDDSL | 702 |
| BAQ51233 | 545 | ERLKTYAHLFDDKVMKQLKR-RRYTGWGRLSRKLINGIRDK | QSGKTILDFLK-DGf---ANRNFMQLIHDDSL | 613 |
| KGE60162 | | | | |
| KGE60856 | | | | |
| WP_002989955 | 634 | QRLQKYSDIFTKAQLKKLER-RHYTGWGRLSYKLINGIRNK | ENKKTILDYLI-DDG---YANRFMQLINDDAL | 702 |
| WP_003030002 | 635 | ERLQKYSDIFTADQLKKLER-RHYTGWGRLSYKLINGIRNK | ENNKTILDYLI-DDG---SANRFMQLINDDIL | 703 |
| WP_003065552 | 638 | KRLDIYKDFFTESQLKKLYR-RHYTGWGRLSAKLINGIRNK | ENQKTILDYLI-DDG---SANRNFMQLINDDGL | 706 |
| WP_001040076 | 633 | KRLENYKDLFTESQLKKLYR-RHYTGWGRLSAKLINGIRDK | ESQKTILDYLI-DDG---RSNRNFMQLINDDGL | 701 |
| WP_001040078 | 636 | KRLENYKDLFTESQLKKLYR-RHYTGWGRLSAKLINGIRDK | ESQKTILDYLI-DDG---RSNRNFMQLINDDGL | 704 |
| WP_001040080 | 636 | KRLENYKDLFTESQLKKLYR-RHYTGWGRLSAKLINGIRDK | ESQKTILDYLI-DDG---RSNRNFMQLINDDGL | 704 |
| WP_001040081 | 636 | KRLENYKDLFTESQLKKLYR-RHYTGWGRLSAKLINGIRDK | ESQKTILDYLI-DDG---RSNRNFMQLINDDGL | 704 |
| WP_001040083 | 636 | KRLENYKDLFTESQLKKLYR-RHYTGWGRLSAKLINGIRDK | ESQKTILDYLI-DDG---RSNRNFMQLINDDGL | 704 |
| WP_001040085 | 636 | KRLENYKDLFTESQLKKLYR-RHYTGWGRLSAKLINGIRNK | ENQKTILDYLI-DDG---SANRNFMQLINDDGL | 704 |
| WP_001040087 | 636 | KRLENYKDLFTESQLKKLYR-RHYTGWGRLSAKLINGIRDK | ESQKTILDYLI-DDG---RSNRNFMQLINDDGL | 704 |
| WP_001040088 | 636 | KRLENYKDLFTESQLKKLYR-RHYTGWGRLSAKLINGIRDK | ESQKTILDYLI-DDG---RSNRNFMQLINDDGL | 704 |
| WP_001040089 | 636 | KRLENYKDLFTESQLKKLYR-RHYTGWGRLSAKLINGIRDK | ESQKTILDYLI-DDG---RSNRNFMQLINDDGL | 704 |
| WP_001040090 | 636 | KRLENYKDLFTESQLKKLYR-RHYTGWGRLSAKLINGIRDK | ESQKTILDYLI-DDG---RSNRNFMQLINDDGL | 704 |
| WP_001040091 | 633 | KRLDIYKDFFTESQLKKLYR-RHYTGWGRLSAKLINGIRDR | ESQKTILDYLI-DDG---RSNRNFMQLINDDGL | 701 |
| WP_001040092 | 633 | KRLDIYKDFFTESQLKKLYR-RHYTGWGRLSAKLINGIRNK | ENQKTILDYLI-SDG---SANRNFMQLIKDAGL | 701 |
| WP_001040094 | 636 | KRLENYKDLFTESQLKKLYR-RHYTGWGRLSAKLINGIRDK | ESQKTILDYLI-DDG---SANRNFMQLIKDAGL | 704 |
| WP_001040095 | 633 | KRLDIYKDFFTESQLKKLYR-RHYTGWGRLSAKLINGIRNK | ENQKTILDYLI-DDG---SANRNFMQLIKDAGL | 701 |
| WP_001040096 | 633 | KRLDIYKDFFTESQLKKLYR-RHYTGWGRLSAKLINGIRNK | ENQKTILDYLI-DDG---SANRNFMQLIKDAGL | 701 |
| WP_001040097 | 636 | KRLENYKDLFTESQLKKLYR-RHYTGWGRLSAKLINGIRNK | ENQKTILDYLI-DDG---SANRNFMQLIKDAGL | 704 |
| WP_001040098 | 633 | KRLDIYKDFFTESQLKKLYR-RHYTGWGRLSAKLINGIRNK | ENQKTILDYLI-DDG---SANRNFMQLINDDGL | 701 |
| WP_001040099 | 633 | KRLDIYKDFFTESQLKKLYR-RHYTGWGRLSAKLINGIRNK | ENQKTILDYLI-DDG---SANRNFMQLINDDGL | 701 |
| WP_001040100 | 636 | KRLENYKDLFTESQLKKLYR-RHYTGWGRLSAKLINGIRDK | ESQKTILDYLI-DDG---RSNRNFMQLINDDGL | 704 |
| WP_001040104 | 636 | KRLENYKDLFTESQLKKLYR-RHYTGWGRLSAKLINGIRDK | ESQKTILDYLI-SDG---RANRNFMQLIHDDGL | 704 |
| WP_001040105 | 636 | KRLENYKDLFTESQLKKLYR-RHYTGWGRLSAKLINGIRDK | ESQKTILDYLI-DDG---RANRNFMQLIHDDGL | 704 |
| WP_001040106 | 636 | KRLENYKDLFTESQLKKLYR-RHYTGWGRLSAKLINGIRDK | ESQKTILDYLI-DDG---RANRNFMQLIHDDGL | 704 |
| WP_001040107 | 636 | KRLENYKDLFTESQLKKLYR-RHYTGWGRLSAKLINGIRDK | ESQKTILDYLI-SDG---RANRNFMQLIHDDGL | 704 |
| WP_001040108 | 636 | KRLENYKDLFTESQLKKLYR-RHYTGWGRLSAKLINGIRDK | ESQKTILDYLI-SDG---RANRNFMQLIHDDGL | 704 |
| WP_001040109 | 636 | KRLENYKDLFTESQLKKLYR-RHYTGWGRLSAKLINGIRDK | ESQKTILDYLI-DDG---RANRNFMQLIHDDGL | 704 |
| WP_001040110 | 636 | KRLENYKDLFTESQLKKLYR-RHYTGWGRLSAKLINGIRDR | ESQKTILDYLI-SDG---RANRNFMQLIHDDGL | 704 |
| WP_015058523 | 636 | KRLDIYKDFFTESQLKKLYR-RHYTGWGRLSAKLINGIRDK | ESQKTILDYLI-DDG---SANRNFMQLIKDAGL | 704 |
| WP_017643650 | 636 | KRLENYKDLFTESQLKKLYR-RHYTGWGRLSAKLINGIRNK | ENQKTILDYLI-DDG---SANRNFMQLIHDDGL | 704 |
| WP_017647151 | 636 | KRLENYKDLFTESQLKKLYR-RHYTGWGRLSAKLINGIRDK | ESQKTILDYLI-DDG---KSNRNFMQLIHDDGL | 701 |
| WP_017648376 | 636 | KRLENYKDLFTESQLKKLYR-RHYTGWGRLSAKLINGIRDK | ESQKTILDYLI-DDG---KSNRNFMQLINDDGL | 704 |
| WP_017649527 | 636 | KRLENYKDLFTESQLKKLYR-RHYTGWGRLSAKLINGIRDK | ESQKTILDYLI-DDG---RSNRNFMQLINDDGL | 704 |
| WP_017771611 | 636 | KRLENYKDLFTESQLKKLYR-RHYTGWGRLSAKLINGIRDK | ESQKTILDYLI-SDG---RSNRNFMQLIHDDGL | 704 |
| WP_017771984 | 633 | KRLDIYKDFFTESQLKKLYR-RHYTGWGRLSAKLINGIRNK | ENQKTILDYLI-DDG---SANRNFMQLINDDGL | 701 |
| CFQ25032 | 636 | KRLENYKDLFTESQLKKLYR-RHYTGWGRLSAKLINGIRNK | ENQKTILDYLI-DDG---KSNRNFMQLINDDGL | 704 |
| CFV16040 | 636 | KRLENYKDLFTESQLKKLYR-RHYTGWGRLSAKLINGIRDK | ESQKTILDYLI-DDG---RSNRNFMQLINDDGL | 704 |
| KLJ37842 | 636 | KRLENYKDLFTESQLKKLYR-RHYTGWGRLSAKLINGIRDK | ESQKTILDYLI-DDG---RSNRNFMQLINDDGL | 704 |
| KLJ72361 | 636 | KRLENYKDLFTESQLKKLYR-RHYTGWGRLSAKLINGIRDK | ESQKTILDYLI-DDG---RSNRNFMQLINDDGL | 704 |
| KLL20707 | 636 | KRLENYKDLFTESQLKKLYR-RHYTGWGRLSAKLINGIRDK | ESQKTILDYLI-DDG---RSNRNFMQLINDDGL | 718 |
| KLL42645 | 636 | KRLENYKDLFTESQLKKLYR-RHYTGWGRLSAKLINGIRDK | ESQKTILDYLI-DDG---RSNRNFMQLINDDGL | 704 |
| WP_047207273 | 636 | KRLENYKDLFTESQLKKLYR-RHYTGWGRLSAKLINGIRNK | ENQKTILDYLI-DDG---RSNRNFMQLINDDGL | 704 |
| WP_047209694 | 633 | KRLDIYKDFFTESQLKKLYR-RHYTGWGRLSAKLINGIRNK | ENQKTILDYLI-DDG---SANRNFMQLINDDGL | 701 |
| WP_050198062 | 636 | KRLENYKDLFTESQLKKLYR-RHYTGWGRLSAKLINGIRDK | ESQKTILDYLI-DDG---RSNRNFMQLINDDGL | 704 |
| WP_050201642 | 636 | KRLENYKDLFTESQLKKLYR-RHYTGWGRLSAKLINGIRDK | ESQKTILDYLI-DDG---RSNRNFMQLINDDGL | 704 |
| WP_050204027 | 636 | KRLENYKDLFTESQLKKLYR-RHYTGWGRLSAKLINGIRDK | ESQKTILDYLI-SDG---RANRNFMQLINDDGL | 704 |
| WP_050881965 | 636 | KRLENYKDLFTESQLKKLYR-RHYTGWGRLSAKLINGIRDK | ESQKTILDYLI-DDG---RSNRNFMQLINDDGL | 704 |
| WP_050886065 | 636 | KRLENYKDLFTESQLKKLYR-RHYTGWGRLSAKLINGIRDK | ESQKTILDYLI-DDG---RSNRNFMQLINDDGL | 704 |

-continued

| | | | |
|---|---|---|---|
| AHN30376 | 636 | KRLENYKDLFTESQLKKLYR-RHYTGWGRLSAKLINGIRDR ESQKILDYLI SDG--RANRNFMQLINDDGL | 704 |
| EAO78426 | 636 | KRLENYKDLFTESQLKKLYR-RHYTGWGRLSAKLINGIRDK ESQKTILDYLI DDG--RSNRNFMQLINDDGL | 704 |
| CCW42055 | 636 | KRLDIYKDFFTESQLKKLYR-RHYTGWGRLSAKLINGIRNK ENQKTILDYLI DDG--SANRNFMQLIKDAGL | 704 |
| WP_003041502 | 636 | QRLQKYSDIFTKAQLKKLER-RHYTGWGRLSYKLINGIRNK ENKKTILDYLI DDG--YANRNFMQLINDDAL | 703 |
| WP_037593752 | 636 | QRLQKYSDIFTKAQLKKLER-RHYTGWGRLSYKLINGIRNK ENKKTILDYLI DDG--YANRNFMQLINDDAL | 704 |
| WP_049516684 | 635 | QRLQKYSDIFTTQQLKKLER-RHYTGWGRLSYKLINGIRNK ENKKTILDYLI DDG--YANRNFMQLINDDAL | 703 |
| GAD46167 | 636 | QRLQKYSDIFTKAQLKKLER-RHYTGWGRLSYKLINGIRNK ENKKTILDYLI DDG--YANRNFMQLINDDAL | 704 |
| WP_018363470 | 635 | QRLQKYSDIFTKQQLKKLER-RHYTGWGRLSYKLINGIRNK ENNKTILDYLI DDG--SANRNFMQLINDDAL | 703 |
| WP_003043819 | 644 | ERLKTYAHLFDDKVMKQLKR-RHYTGWGRLSRKMINGIRDK QSGKTILDFLK -Dgf--SNRNFMQLIHDDSL | 712 |
| WP_066269658 | 635 | QRLQKYSDIFTKAQLKKLER-RHYTGWGRLSYKLINGIRNK ENKKTILDYLI DDG--YANRNFMQLINDDAL | 703 |
| WP_048800889 | 635 | QRLQKYSDIFTKAQLKKLER-RHYTGWGRLSYKLINGIRNK ENNKTILEYLV DDG--YANRNFMQLINDDIL | 703 |
| WP_012767106 | 634 | ERLKKYANLFDDKVMKQLKR-RHYTGWGRLSRKLINGIRDK QSGKTILDFLK -Dgf--ANRNFMQLINDDSL | 702 |
| WP_014612333 | 634 | ERLKKYANLFDDKVMKQLKR-RHYTGWGRLSRKLINGIRDK QSGKTILDFLK -Dgf--ANRNFMQLINDDSL | 702 |
| WP_015017095 | 634 | ERLKKYANLFDDKVMKQLKR-RHYTGWGRLSRKLINGIRNK ENGKTILDFLK -Dgf--ANRNFMQLIHDDSL | 702 |
| WP_015057649 | 634 | ERLKKYANLFDDKVMKQLKR-RHYTGWGRLSRKLINGIRNK QSGKTILDFLK -Dgf--ANRNFIQLIHDDSL | 702 |
| WP_048327215 | 634 | ERLKTYAHLFDDKVMKQLKR-RHYTGWGRLSRKLINGIRNK QSGKTILDFLK -Dgf--ANRNFMQLIHDDSL | 702 |
| WP_049519324 | 634 | ERLKTYAHLFDDKVMKQLKR-RHYTGWGRLSRKMINGIRDK QSGKTILDFLK -Dgf--ANRNFIQLIHDDSL | 702 |
| WP_012515931 | 634 | KRLDQYAHLFDKVLNKLER-HHYTGWGRLSGKLINGIRDK QSGKTILDFLK -Dgf--ANRNFMQLIHDSEL | 702 |
| WP_021320964 | 634 | KRLDQYAHLFDKVLNKLER-HHYTGWGRLSGKLINGIRDK QSGKTILDFLK -Dgf--ANRNFMQLIHDSEL | 702 |
| WP_037581760 | 635 | KRLDQYAHLFDKVLNKLER-HHYTGWGRLSGKLINGIRDK QSGKTILEYLV -Dgf--ANRNFMQLIHDSEL | 703 |
| WP_004232481 | 636 | ERLQKYSDIFTSQQLKKLER-RHYTGWGRLSYKLINGIRNK ENNKTILDFLI DDG--DANRNFMQLINDDSL | 704 |
| WP_009854540 | 636 | ERLQKYSDIFTANQLKKLER-RHYTGWGRLSYKLINGIRNK ENKKTILDYLI DDG--SANRNFMQLINDDIL | 704 |
| WP_012962174 | 638 | QRLQKYSDIFTPQQLKKLER-RHYTGWGRLSYKLINGIRNK ENGKSILDYLI DDG--YANRNFMQLISDDTL | 706 |
| WP_039695303 | 635 | ERLQKYSDIFTANQLKKLER-RHYTGWGRLSYKLINGIRNK ENNKTILDYLI DDG--SANRNFMQLINDDIL | 703 |
| WP_014334983 | 634 | ERLQKYSDFFTSQQLKKLER-RHYTGWGRLSYKLINGIRNK ENNKTILDFLI DDG--HANRNFMQLINDESL | 702 |
| WP_003099269 | 634 | RRLVKYADVFEKSVLKKLKR-RHYTGWGRLSQKLINGIKDK QTGKTILGFLK -Dgv--ANRNFMQLINDSSL | 702 |
| AHY15608 | 634 | RRLVKYADVFEKSVLKKLKK-RHYTGWGRLSQKLINGIKDK QTGKTILGFLK -Dgv--ANRNFMQLIHDSEL | 702 |
| AHY17476 | 634 | RRLVKYADVFEKSVLKKLKK-RHYTGWGRLSQKLINGIKDK QTGKTILGFLK -Dgv--ANRNFMQLINDDSL | 702 |
| ESR09100 | | | |
| AGM98575 | 634 | RRLVKYADVFEKSVLKKLKK-RHYTGWGRLSQKLINGIKDK QTGKTILGFLK -Dgv--ANRNFMQLINDSSL | 702 |
| ALF27331 | 635 | KRLENYSDLLTKEQVKKLER-RHYTGWGRLSAELIHGIRNK ESRKTILDYLI DDGf--NSNRNFMQLINDDGL | 703 |
| WP_018372492 | 648 | KRLSELNIPENKIIKKLAR-KKYTGWGNLSRKLIHGIRNK ETNRTILGHLI DDGf--SNRNLMQLINDDGL | 716 |
| WP_045618028 | 634 | QRLAHYASIPDEKVIKALTR-RHYTGWGKLSAKLINGIYDK QSKKTILDYLI DDG--EINRNFMQLINDDGL | 702 |
| WP_045635197 | 633 | QRLAQYDSLFDEKVIKALTR-RHYTGWGKLSAKLINGICDK QTGNTILDYLI DDG--KINRNFMQLINDDGL | 701 |
| WP_002263549 | 635 | KRLENYSDLLTKEQVKKLER-RHYTGWGRLSAELIHGIRNK ESRKTILDYLI DDG--NSNRNFMQLINDDAL | 703 |
| WP_002263887 | 635 | KRLENYSDLLTKEQVKKLER-RHYTGWGRLSAELIHGIRNK ESRKTILDYLI DDG--NSNRNFMQLINDDAL | 703 |
| WP_002264920 | 635 | KRLENYSDLLTKEQVKKLER-RHYTGWGRLSAELIHGIRNK ESRKTILDYLI DDG--NSNRNFMQLINDDAL | 703 |
| WP_002269043 | 635 | KRLENYSDLLTKEQVKKLER-RHYTGWGRLSAELIHGIRNK ESRKTILDYLI DDG--NSNRNFMQLINDDAL | 703 |
| WP_002269448 | 635 | KRLENYSDLLTKEQVKKLER-RHYTGWGRLSAELIHGIRNK ESRKTILDYLI DDG--NSNRNFMQLINDDAL | 703 |
| WP_002271977 | 635 | KRLENYSDLLTKEQVKKLER-RHYTGWGRLSAELIHGIRNK ESRKTILDYLI DDG--NSNRNFMQLINDDAL | 703 |
| WP_002272766 | 635 | KRLENYSDLLTKEQVKKLER-RHYTGWGRLSAELIHGIRNK ESRKTILDYLI DDG--NSNRNFMQLINDDAL | 703 |
| WP_002273241 | 635 | KRLENYSDLLTKEQVKKLER-RHYTGWGRLSAELIHGIRNK ESRKTILDYLI DDG--NSNRNFMQLINDDAL | 703 |
| WP_002275430 | 635 | KRLENYSDLLTKEQVKKLER-RHYTGWGRLSAELIHGIRNK ESCKTIMDYLI DDG--NSNRNFMQLINDDAL | 703 |
| WP_002276448 | 636 | KRLENYSDLLTKEQVKKLER-RHYTGWGRLSAELIHGIRNK ESCKTIMDYLI DDG--NSNRNFMQLINDDAL | 704 |
| WP_002277050 | 636 | QRLAKYADVFDDKVIDQLAR-RHYTGWGRLSAKLNGIRDK QSCKTIMDYLI DDA--QSNRNLMQLITDDNL | 704 |
| WP_002277364 | 635 | KRLENYSDLLTKEQVKKLER-RHYTGWGRLSAELIHGIRNK ESRKTILDYLI DDG--NSNRNFMQLINDDAL | 703 |
| WP_002279025 | 635 | KRLENYSDLLTKEQVKKLER-RHYTGWGRLSAELIHGIRNK ESRKTILDYLI DDG--NSNRNFMQLINDDAL | 703 |
| WP_002279859 | 635 | KRLENYSDLLTKEQVKKLER-RHYTGWGRLSAELIHGIRNK ESRKTILDYLI DDG--NSNRNFMQLINDDAL | 703 |
| WP_002280230 | 636 | KRLENYSDLLTKEQVKKLER-RHYTGWGRLSAELIHGIRNK ESRKTILDYLI DDG--NSNRNFMQLINDDAL | 704 |
| WP_002281696 | 635 | QRLAKYADVFDDKVIDQLAR-RHYTGWGRLSAKLLNGIRDK QSCKTIMDYLI DDA--QSNRNLMQLITDDNL | 703 |
| WP_002282247 | 636 | KRLENYSDLLTKEQVKKLER-RHYTGWGRLSAELIHGIRNK ESRKTILDYLI DDG--NSNRNFMQLINDDAL | 704 |
| WP_002282906 | 635 | KRLENYSDLLTKEQVKKLER-RHYTGWGRLSAELIHGIRNK ESRKTILDYLI DDG--NSNRNFMQLINDDAL | 703 |
| WP_002283846 | 635 | KRLKNYSDLLTKEQVKKLER-RHYTGWGRLSAELIHGIRNK ESRKTILDYLI DDG--NSNRNFMQLINDDAL | 703 |

-continued

```
WP_002287255  635  KRLENYSDLLTKEQVKKLER-RHYTGWGRLSAELIHGIRNK ESRKTILDYLI DDG---NSNRNFMQLINDDAL  703
WP_002288990  635  KRLKNYSDLLTKEQLKKLER-RHYTGWGRLSAELIHGIRNK ESRKTILDYLI DDG---NSNRNFMQLINDDAL  703
WP_002289641  635  KRLENYSDLLTKEQVKKLER-RHYTGWGRLSAELIHGIRNK ESRKTILDYLI DDG---NSNRNFMQLINDDAL  703
WP_002290427  635  KRLKNYSDLLTKEQVKKLER-RHYTGWGRLSAELIHGIRNK ESRKTILDYLI DDG---NSNRNFMQLINDDAL  703
WP_002295753  635  KRLENYSDLLTKEQVKKLER-RHYTGWGRLSAELIHGIRNK ESRKTILDYLI DDG---NSNRNFMQLINDDAL  703
WP_002296423  635  KRLENYSDLLTKEQVKKLER-RHYTGWGRLSYKLINGIRNK QSNKTILGYLI DDG---YSNRNFMQLINDDAL  703
WP_002304487  645  QRLQKYSDIFTKAQLKKLER-RHYTGWGRLSAELIHGIRNK QSNKTILGYLI DDG---YSNRNFMQLINDDAL  713
WP_002305844  635  KRLENYSDLLTKEQVKKLER-RHYTGWGRLSAELIHGIRNK ESRKTILDYLI DDG---NSNRNFMQLINDDAL  703
WP_002307203  635  KRLENYSDLLTKEQVKKLER-RHYTGWGRLSAELIHGIRNK ESRKTILDYLI DDG---NSNRNFMQLINDDAL  703
WP_002310390  635  KRLKNYSDLLTKEQVKKLER-RHYTGWGRLSAELIHGIRNK ESRKTILDYLI DDG---NSNRNFMQLINDDAL  703
WP_002352408  635  KRLENYSDLLTKEQVKKLER-RHYTGWGRLSAELIHGIRNK ESRKTILDYLI DDG---NSNRNFMQLINDDAL  703
WP_012997688  635  KRLENYSDLLTKEQVKKLER-RHYTGWGRLSAELIHGIRNK ESRKTILDYLI DDG---NSNRNFMQLINDDAL  703
WP_014677909  635  KRLKNYSDLLTKEQLKKLER-RHYTGWGRLSAELIHGIRNK ESRKTILDYLI DDG---NSNRNFMQLINDDAL  703
WP_019312892  635  KRLENYSDLLTKEQVKKLER-RHYTGWGRLSAELIHGIRNK ESRKTILDYLI DDG---NSNRNFMQLINDDAL  703
WP_019313659  635  KRLENYSDLLTKEQVKKLER-RHYTGWGRLSAELIHGIRNK ESRKTILDYLI DDG---NSNRNFMQLINDDAL  703
WP_019314093  635  KRLENYSDLLTKEQVKKLER-RHYTGWGRLSAELIHGIRNK ESRKTILDYLI DDG---NSNRNFMQLINDDAL  703
WP_019315370  635  KRLENYSDLLTKEQVKKLER-RHYTGWGRLSAELIHGIRNK ESRKTILDYLI DDG---NSNRNFMQLINDDAL  703
WP_019803776  635  KRLENYSDLLTKEQVKKLER-RHYTGWGRLSAELIHGIRNK ESRKTILDYLI DDG---NSNRNFMQLINDDAL  703
WP_019805234  635  KRLENYSDLLTKEQVKKLER-RHYTGWGRLSAELIHGIRNK ESRKTILDYLI DDG---NSNRNFMQLINDDAL  703
WP_024783594  635  KRLENYSDLLTKEQVKKLER-RHYTGWGRLSAELIHGIRNK ESRKTILDYLI DDG---NSNRNFMQLINDDAL  703
WP_024784288  636  QRLAKYADVFDDKVIDQLAR-RHYTGWGRLSAKLLNGIRDK QSCKTIMDYLI DDA---QSNRNLMQLITDDNL  704
WP_024784666  635  KRLENYSDLLTKEQVKKLER-RHYTGWGRLSAELIHGIRNK ESRKTILDYLI DDG---NSNRNFMQLINDDAL  703
WP_024784894  636  QRLAKYADVFDDKVIDQLAR-RHYTGWGRLSAKLLNGIRDK QSCKTIMDYLI DDA---QSNRNLMQLITDDNL  704
WP_024786433  635  KRLENYSDLLTKEQVKKLER-RHYTGWGRLSAELIHGIRNK ESRKTILDYLI DDG---NSNRNFMQLINDDAL  703
WP_049473442  636  NRLAVYEDLFDQNVLKQLKR-RHYTGWGRLSKQLINGMEDK HTGKTILDFLK -DGq---INRNFMQLINDDNL  704
WP_049474547  635  QRLAQYASIFDEKVIKTLTR-RHYTGWGRLSAELIHGIRNK KTGKTILDYLI DDG---YNNRNFMQLINDDGL  703
EMC03581     628  QRLAQYDSIFDEKVIKALTR-RHYGGWGRLSAKLLNGIRDK QTGNTILDYLM DDG---YNNRNFMQLINDDEL  696
WP_000428612  636  QRLAQYDSLFDEKVIKALTR-RHYTGWGRLSAKLIDGICDK QTGNTILDYLI DDG---KNNRNFMQLINDDGL  704
WP_000428613  634  QRLNQYDSIFDEKVIKALTR-RHYTGWGKLSAKLINGIRDK KTSKTILDYLI DDG---YSNRNFMQLINDDGL  702
WP_049523028  633  KRLSKYESIFDPSILKKLKK-RHYTGWGRLSQKLINGMEDK QTGKTILDFLI -DGqf--ANRNFMQLINDPSL  701
WP_003107102  603  NRLAVYEDLFDQNVLKQLKR-RHYTGWGRLSKQLINGMEDK HTGKTILDFLK -DGf--INRNFMQLINDDNL  671
WP_054279288  636  QRLAQYDSIFDEKVIKALTR-RHYTGWGRLSAKLINCIRDR KTGKTILDFLK DDG---YNNRNFMQLINDDGL  704
WP_049531101  634  QRLAQYDSLFDEKVIKALTR-RHYTGWGKLSAKLINGICDK QTGNTILDYLI DDG---YSNRNFMQLINDDGL  702
WP_049538452  634  QRLAQYDSLFDEKVIKALTR-RHYRGWGRLSAKLINGICDK QTGNTILDYLI DDG---EINRNFMQLINDDGL  702
WP_049549711  637  KRLAKYANLFEKSVLKKLRK-RHYRGWGRLSRQLIDGMKDK QTGKTILDYLI DDG---ANRNFIQLINDSSL  705
WP_007896501  589  KRLAKYANLPEKSVLKKLRK-RHYRGWGRLSRQLINRIKTP ASGKTILDFLK -DDf---ANRNFIQLINDSSL  657
EFR44625     633  QRLAQYDTLFDEKVIKALTR-RHYTGWGRLSAKLINGIRDK QSGKTILDFLK DDD---KINRNFMQLINDDGL  701
WP_002897477  633  QRLAQYDTLFDEKVIKALTR-RHYTGWGRLSAKLINGICDK QTGKTILEYLI DDG---DCNRNFMQLINDDGL  701
WP_002906454  634  QRLAQYDSIFDEKVIKALTR-RHYTGWGRLSAKLINGILDK QTGNTILDYLI DDG---EINRNFMQLINDDGL  702
WP_009729476  637  QRLLKYEDIFSKKVIANLTR-RHYTGWGRLSAKLINGIKDK HSRKTILDYLI DDG---HSNRNFMQLINDDNL  705
CQR24647     636  KRLEKYKDILTEEQRKKLER-RHYTGWGRLSAKLINGILDK KSGKTILDYLI DDG---YNNRNFMQLINDDGL  704
WP_000666813  634  KRLEKYKDILTEEQRKKLER-RHYTGWGRLSAKLINGILDK KTGKTILDYLI DDG---TSNRNFMQLINDDIL  702
WP_009754323  634  KRLEKYKDVLTEEQRKKLER-RHYTGWGRLSAKLINGIKDK VTRKTILGYLI DDG---TSNRNFMQLINDDIL  702
WP_044674937  635  KRLEKYKDVLTEEQRKKLER-RHYTGWGRLSAKLINGIKDK VTRKTILDYLI DDG---TSNRNFMQLINDDIL  703
WP_044676715  635  QRLEKYKDVLTEEQRKKLER-CHYTGWGRLSAKLINGILLDK VTRKTILGYLI DDG---TSNRNFMQLINDDIL  703
WP_044680361  633  QRLQKYSDIFTKAQLKKLER-CHYTGWGRLSYKLINGIRDK ENKKTILDYLI DDG---YANRNFMQLINDDAL  701
WP_044681799  635  RKLSEYPQLTEQQVQLAQV--RFRGWGRLSQRLINRIKTP EDHKLSINEIL ------QTMENFMQIIRNKDY  703
WP_049533112  613  ERLKTYAHLFDDKVMKQLKR-RRYTGWGRLSRKLINGIRDE QSGKTILDFLK -DGf---ANRNFMQLIHDDSL  682
WP_029090905  638  RQLMKFKDKLSEKAINQLSK-KHYTGWGQLSEKLINGIRDE QSNKTILDYLI DNGcpkNMNRNFMQLINDDIL  705
WP_006506696  634  ERLKTYAHLFDDKVMKQLKR-RRYTGWGRLSRKLINGIRDK QSGKTILDFLK -DGf---ANRNFMQLIHDDSL  702
AIT42264     638  RKLSEYPQLTEQQVQLAQV--RFRGWGRLSQRLINRIKTP SV--TVLDVLE ------SRLNLMEIINDKDL  705
WP_034440723  638  ERLKTYAHLFDDKVMKQLKR-RRYTGWGRLSRKLINGIRDE QSGKTILDFLK -DGf---ANRNFMQLIHDDSL  710
AKQ21048     634  ERLKTYAHLFDDKVMKQLKR-RRYTGWGRLSRKLINGIRDK QSGKTILDFLK -DGf---ANRNFMQLIHDDSL  702
```

-continued

| ID | Start | Sequence | End |
|---|---|---|---|
| WP_004636532 | 634 | KQLQTYSDTLSPEILKKLER-KHYTGWGRPSKKLINGLRDE GSNKTILDYLK DEGssgPINRNFMQLIRDNIL | 706 |
| WP_002364836 | 642 | TQLSTFKGQFSAEVLKKLER--KHYTGWGRLSKKLINGIYDK ESGKTILGYLI DDGvskHYNRNFMQLINDSQL | 714 |
| WP_016631044 | 593 | TQLSTFKGQFSAEVLKKLER--KHYTGWGRLSKKLINGIYDK ESGKTILDYLV DDGvskHYNRNFMQLINDSQL | 665 |
| EMS75795 | 382 | TQLKKYQSVLGDGFFKKLVK--KHYTGWGRLSERLINGIRDK KTNKTILDYLI DDDfpyNRNRNFMQLINDDSL | 454 |
| WP_002373311 | 642 | TQLSTFKGQFSAEVLKKLER--KHYTGWGRLSKKLINGIYDK ESGKTILDYLI DDGvskHYNRNFMQLINDSQL | 714 |
| WP_002378009 | 642 | TQLSTFKGQFSAEVLKKLER--KHYTGWGRLSKKLINGIYDK ESGKTILDYLI DDGvskHYNRNFMQLINDSQL | 714 |
| WP_024407324 | 642 | TQLSTFKGQFSAEVLKKLER--KHYTGWGRLSKKLINGIYDK ESGKTILDYLV DDGvskHYNRNFMQLINDSQL | 714 |
| WP_002413717 | 642 | TQLSTFKGQFSAEVLKKLER--KHYTGWGRLSKKLINGIYDK ESGKTILDYLV DDGvskHYNRNFMQLINDSQL | 714 |
| WP_010775580 | 644 | TQLSTFKGQFSEEVLKKLER--KHYTGWGRLSKKLINGIYDK ESGKTILDYLI DDGvskHYNRNFMQLINDSQL | 716 |
| WP_010818269 | 642 | TQLSTFKGQFSAEVLKKLER--KHYTGWGRLSKKLINGIYDK ESGKTILDYLI DDGvskHYNRNFMQLINDSQL | 714 |
| WP_010824395 | 642 | TQLSTFKGQFSAEVLKKLER--KHYTGWGRLSKKLINGIYDK ESGKTILGYLI DDGvskHYNRNFMQLINDSQL | 714 |
| WP_016622645 | 642 | TQLSTFKGQFSAEVLKKLER--KHYTGWGRLSKKLINGIYDK ESGKTILDYLV DDGvskHYNRNFMQLINDSQL | 714 |
| WP_033624816 | 642 | TQLSTFKGQFSAEVLKKLER--KHYTGWGRLSKKLINGIYDK ESGKTILDYLI DDGvskHYNRNFMQLINDSQL | 714 |
| WP_033625576 | 642 | TQLSTFKGQFSAEVLKKLER--KHYTGWGRLSKKLINGIYDK ESGKTILDYLI DDGvskHYNRNFMQLINDSQL | 714 |
| WP_033789179 | 642 | TQLSTFKGQFSEEVLKKLER--KHYTGWGRLSKKLINGIYDK ESGKTILDYLI DDGvskHYNRNFMQLINDSQL | 714 |
| WP_002310644 | 643 | TRLSHHEATLGKHIIKKLIK--KHYTGWGRLSKELIQGIRDK QSNKTILDYLI DDDfphHRNRNFMQLINDDSL | 715 |
| WP_002312694 | 644 | TRLSHHEATLGKHIIKKLIK--KHYTGWGRLSKELIQGIRDK QSNKTILDYLI DDDfphHRNRNFMQLINDDSL | 716 |
| WP_002314015 | 643 | TRLSHHEATLGKHIIKKLIK--KHYTGWGRLSKELIQGIRDK QSNKTILDYLI DDDfphHRNRNFMQLINDDSL | 715 |
| WP_002320716 | 643 | TRLSHHEATLGKHIIKKLIK--KHYTGWGRLSKELIQGIRDK QSNKTILDYLI DDDfphHRNRNFMQLINDDSL | 715 |
| WP_002330729 | 642 | TRLSHHEATLGKHIIKKLIK--KHYTGWGRLSKELIQGIRDK QSNKTILDYLI DDDfphHRNRNFMQLINDDSL | 714 |
| WP_002335161 | 643 | TRLSHHEATLGKHIIKKLIK--KHYTGWGRLSKELIQGIRDK QSNKTILDYLI DDDfphHRNRNCMQLINDDSL | 715 |
| WP_002345439 | 643 | TRLSHHEATLGKHIIKKLIK--KHYTGWGRPSAKLINGIRDR QSNKTILDYLI DDDvpaNRNRNLMQLINDEHL | 715 |
| WP_034867970 | 638 | HQLSKYQEVFGEKLLKEFAR--KHYTGWGRLSKELIQGIRDK QSNKTILDYLI DDDfphHRNRNFMQLINDDSL | 710 |
| WP_047937432 | 643 | TRLSHHEATLGKHIIKKLIK--KHYTGWGRPSAKLINGIRDR QSNKTILDYLI DDDvpaNRNRNLMQLINDEHL | 715 |
| WP_010720994 | 638 | HQLSKYQEVFGEKLLKEFAR--KHYTGWGRPSAKLINGIRDR KTNKTILDYLI DDDvpaNRNRNLMQLINDEHL | 710 |
| WP_010737004 | 638 | HQLSKYQEVFGEKLLKEFAR--KHYTGWGRPSAKLINGIRDR KTNKTILDYLI DDDvpaNRNRNLMQLINDEHL | 710 |
| WP_034700478 | 638 | HQLSKYQEVFGEKLLKEFAR--KHYTGWGRPSAKLINGIRDR KTNKTILDYLI DDDvpaNRNRNLMQLINDEHL | 710 |
| WP_072209003 | 635 | NQLEQLPLNLSTKTIKALSR--RKYTGWGRLSARLIDGIHDK NSGKTILDYLI DESdsyIVNRNFMQLINDDHL | 707 |
| WP_023519017 | 632 | EQLKPYETVLGLPAIKKKLAK--KHYTGWGRLSEKMIQGMREK QSRKTILDYLI DDDfpcNRNRNFMQLINDDHL | 704 |
| WP_010770040 | 635 | EQLKKYTYLFDEEVLKKLER--RHYTGWGRLSAKLLIGIKEK RTHKTILDYLI DDGkqPINRNFMQLINDDHL | 707 |
| WP_048604708 | 637 | EQLSKFSDRLSEKTIKDLER--KKYTGWGRLSAKLINGIHDX QSNKTILDYLI DDApkkNINRNFMQLINDNRL | 703 |
| WP_010750235 | 637 | TQLKKYQRILGEEIFKKLVK--KHYTGWGRLSAKLINGIRDQ KTNKTILDYLI DDDpyNRNRNFMQLINDDHL | 709 |
| AII16583 | 673 | ERLKTYAHLFDDKVMKQLKR--RRYTGWGRLSRKLINGIRDK QSGKTILDFLK -DGf--ANRNFMQLIHDDSL | 741 |
| WP_029073316 | 648 | RRLKKEYDLDEEKIKKILKL--KYSGWSRLSKKLLSGIKTK RTPETVLEVME ------TMWNLMQVINDEKL | 717 |
| WP_031589969 | 648 | RRLKKEYDLDEEKIKKILKL--KYSGWSRLSKKLLSGIKTK RTPETVLEVME ------TMWNLMQVINDEKL | 717 |
| KDA45870 | 631 | RRLENYRDFLGEDIIRKLSR--KKYTGWGRLSAKLLDGIYDK KTHKTILDCLM EDYs-QNFMQLINDDTY | 698 |
| WP_039099354 | 651 | AKLNEIDWLIGDQQRVQLAAK--RYRGWGRLSAKLLTQIVN- ANGQRIMDLLW -----TTDNFMRIVHSE-- | 712 |
| AKP02966 | 633 | EKLHSSNYSYTSDQIKKISN-MRYKGWGRLSKKILLICITTE TNTPKSLQLSN -DLm-wITNNNFISIISNDKY | 706 |
| WP_010991369 | 638 | EQLQQFSDVLDGVVLKKLER--RHYTGWGRLSAKLMGIRDK QSHLTILDYLM DDG------LNRNLMQLINDSNL | 706 |
| WP_033838504 | 638 | EQLQQFSDVLDGVVLKKLER--RHYTGWGRLSAKLMGIRDK QSHLTILDYLM DDG------LNRNLMQLINDSNL | 706 |
| EHN60060 | 641 | EQLQQFSDVLDGVVLKKLER--RHYTGWGRLSAKLMGIRDK QSHLTILDYLM DDG------LNRNLMQLINDSNL | 709 |
| EFR89594 | 407 | EQLQQFSDVLDGVVLKKLER--RHYTGWGRLSAKLMGIRDK QSHLTILDYLM DDG------LNRNLMQLINDSNL | 475 |
| WP_038409211 | 638 | EQLQQFSFSDVLDGTILKKLER--RHYTGWGRLSAKLTGIRDK HSHLTILDYLM DDG------LNRNLMQLINDSNL | 706 |
| EFR95520 | 257 | EQLSFSDVLDGTILKKLER--RHYTGWGRLSAKLTGIRDK HSHLTILDYLM DDG------LNRNLMQLINDSNL | 325 |
| WP_037723650 | 638 | EQLQQFSDVLDGGVLKKLER--RHYTGWGRLSAKLVGIREK QSHLTILDYLM DDG------LNRNLMQLINDSNL | 706 |
| WP_003727705 | 638 | EQLQQFSDVLDGVVLKKLER--RHYTGWGRLSAKLLVGIRDK QSHLTILDYLM DDG------LNRNLMQLINDSNL | 706 |
| WP_003730785 | 638 | EQLEQFSDVLDGVVLKKLER--RHYTGWGRLSAKLLVGIRDK QSHLTILDYLM DDG------LNRNLMQLINDSNL | 706 |
| WP_003730329 | 638 | EQLQQFSDVLDGAVLKKLER--RHYTGWGRLSAKLLVGIRDK QSHLTILDYLM DDG------LNRNLMQLINDSNL | 706 |
| WP_003739838 | 638 | EQLQQFSDVLDGAVLKKLER--RHYTGWGRLSAKLLVGIRDK QSHLTILDYLM DDG------LNRNLMQLINDSNL | 706 |
| WP_014601172 | 638 | EQLQQFSDVLDGGVLKKLER--RHYTGWGRLSAKLLVGIREK QSHLTILDYLM DDG------LNRNLMQLINDSNL | 706 |
| WP_023548323 | 638 | EQLQQFSDVLDGTVLKKLER--RHYTGWGRLSAKLLVGIRDK QSHLTILEYLM DDG------LNRNLMQLINDSNL | 706 |
| WP_031665337 | 638 | EQLQQFSDVLDGTVLKKLER--RHYTGWGRLSAKLLVGIRDK QSHLTILDYLM DDG------LNRNLMQLINDSNL | 706 |
| WP_031669209 | 638 | EQLQQFSDVLDGTVLKKLER--RHYTGWGRLSAKLLVGIRDK QSHLTILDYLM DDG------LNRNLMQLINDSNL | 706 |

| | | | |
|---|---|---|---|
| WP_033920898 | 638 | EQLQQFSDVLDGTVLKKKLER-RHYTGWGRLSAKLLVGIRDK QSHLTILDYLM DDG----LNRNLMQLINDSNL | 706 |
| AKI42028 | 641 | EQLQQFSDVLDGGVLKKKLER-RHYTGWGRLSAKLLVGIREK QSHLTILDYLM DDG----LNRNLMQLINDSNL | 709 |
| AKI50529 | 641 | EQLQQFSDVLDGTVLKKKLER-RHYTGWGRLSAKLLVGIRDK QSHLTILDYLM DDG----LNRNLMQLINDSNL | 709 |
| EFR83390 | 86 | ERLQEFSNVLDEAVLKKKLER-RHYTGWGRLSAKLLIGIRDK ESHLTILEYLM DDK----HNRNLMQLINDSNL | 154 |
| WP_046323366 | 638 | ERLKTYAHLFDDKVMKQLKR-RRYTGWGRLSRKLINGIRDK QSGKTILDFLK -Dgf----ANRNFMQLIHDDSL | 706 |
| AKE81011 | 650 | RRLKKKYALPDDKIKQILKL--RKDWSRLSKKLLDGIVAD SV--TVLDVLE ------SRLNLMEIINDKEL | 718 |
| CUO82355 | 642 | RRLKKVYQLDDLLVDKILKL--NYTGWSRLSEKLLTGMTAD KA--TVLFVLE ------SNKNLMEIINDEKL | 709 |
| WP_033162887 | 667 | ERLKTYAHLFDDKVMKQLKR-RRYTGWGRLSRKLINGIRDK QSGKTILDFLK -Dgf----ANRNFMQLIHDDSL | 712 |
| AGZ01981 | 634 | ERLKTYAHLFDDKVMKQLKR-RRYTGWGRLSRKLINGIRDK QSGKTILDFLK -Dgf----ANRNFMQLIHDDSL | 735 |
| AKA60242 | 634 | ERLKTYAHLFDDKVMKQLKR-RRYTGWGRLSRKLINGIRDK QSGKTILDFLK -Dgf----ANRNFMQLIHDDSL | 702 |
| AKS40380 | 638 | ERLKTYAHLFDDKVMKQLKR-RRYTGWGRLSRKLINGIRDK QSGKTILDFLK -Dgf----ANRNFMQLIHDDSL | 706 |
| 4UN5_B | 703 | TFKEDIQKAQVSG-QdDS-LHEHIANLAGSPAIKKGILQTVKVVDELVKVMGrHKPENIVIEMAR-ENQ TTQKGQKNS | 777 |
| WP_010922251 | 707 | PFKQIIQKSQVFG-DVDD-IEAVVHDLPGSPAIKKGILQSVKIVDELVKVMG-GNPDNIVIEMARENQ TTNRGRSQS | 780 |
| WP_039695303 | 702 | SFKEIIQKAQVIG-KTDD-VKQVVQELSGSPAIKKGILQSIKIVDELVKVMG-HAPESIVIEMARENQ TTARGKKNS | 775 |
| WP_045635197 | 427 | VPKKVDLSQQKEI---PT---TLVDDFILSPVVKRSFIQSIKVINAIIKKYG-LPNDIIIELAREKN ---------S | 487 |
| 5AXW_A | 387 | TFKEDLQKAQVSG-QGDS-LHEHIANLAGSPAIKKGILQTVKVVDELVKVMG-rHKPENIVIEMARENQ TTQKGQKNS | 461 |
| WP_099880683 | 703 | TFKEDIQKAQVSG-QGDS-LHEHIANLAGSPAIKKGILQTVKVVDELVKVMG-rHKPENIVIEMARENQ TTQKGQKNS | 777 |
| WP_010922251 | 703 | TFKEAIQKAQVSG-QGDS-LHEHIANLAGSPAIKKGILQTVKVVDELVKVMG-rHKPENIVIEMARENQ TTQKGQKNS | 777 |
| WP_023080005 | 703 | TFKEAIQKAQVSG-QGDS-LHEQIANLAGSPAIKKGILQTVKVVDELVKVMG-rHKPENIVIEMARENQ TTQKGQKNS | 777 |
| WP_023610282 | 703 | TFKEDIQKAQVSG-QGDS-LHEHIANLAGSPAIKKGILQTVKVVDELVKVMG-rHKPENIVIEMARENQ TTQKGQKNS | 777 |
| WP_011054416 | 703 | TFKEDIQKAQVSG-QGDS-LHEHIANLAGSPAIKKGILQTVKVVDELVKVMG-rHKPENIVIEMARENQ TTQKGQKNS | 777 |
| WP_030125963 | 703 | TFKEDIQKAQVSG-QGDS-LHEHIANLAGSPAIKKGILQTVKVVDELVKVMG-rHKPENIVIEMARENQ TTQKGQKNS | 776 |
| WP_030126706 | 703 | TFKEDIQKAQVSG-QGDS-LHEHIANLAGSPAIKKGILQTVKVVDELVKVMG-rHKPENIVIEMARENQ TTQKGQKNS | 777 |
| WP_011284745 | 703 | TFKEDIQKAQVSG-QGDS-LHEHIANLAGSPAIKKGILQTVKVVDELVKVMG-rHKPENIVIEMARENQ TTQKGQKNS | 777 |
| WP_011285506 | 703 | TFKEDIQKAQVSG-QGDS-LHEHIANLAGSPAIKKGILQTVKVVDELVKVMG-rHKPENIVIEMARENQ TTQKGQKNS | 777 |
| WP_011527619 | 703 | TFKEDIQKAQVSG-QGDS-LHEHIANLAGSPAIKKGILQTVKVVDELVKVMG-rHKPENIVIEMARENQ TTQKGQKNS | 777 |
| WP_012560673 | 703 | TFKEDIQKAQVSG-QGDS-LHEHIANLAGSPAIKKGILQTVKVVDELVKVMG-rHKPENIVIEMARENQ TTQKGQKNS | 777 |
| WP_014407541 | 703 | TFKEDIQKAQVSG-QGDS-LHEHIANLAGSPAIKKGILQTVKVVDELVKVMG-rHKPENIVIEMARENQ TTQKGQKNS | 776 |
| WP_020905136 | 703 | TFKEDLQKAQVSG-QGDS-LHEHIANLAGSPAIKKGILQTVKVVDELVKVMG-rHKPENIVIEMARENQ TTQKGQKNS | 777 |
| WP_031488318 | 703 | TFKEDIQKAQVSG-QGDS-LHEHIANLAGSPAIKKGILQTVKVVDELVKVMG-rHKPENIVIEMARENQ TTQKGQKNS | 777 |
| WP_032460140 | 703 | TFKEDIQKAQVSG-QGDS-LHEHIANLAGSPAIKKGILQTVKVVDELVKVMG-rHKPENIVIEMARENQ TTQKGQKNS | 777 |
| WP_032461047 | 703 | TFKEDIQKAQVSG-QGDS-LHEHIANLAGSPAIKKGILQTVKVVDELVKVMG-rHKPENIVIEMARENQ TTQKGQKNS | 777 |
| WP_032462016 | 703 | TFKEDIQKAQVSG-QGDS-LHEHIANLAGSPAIKKGILQTVKVVDELVKVMG-rHKPENIVIEMARENQ TTQKGQKNS | 777 |
| WP_032462936 | 703 | TFKEDIQKAQVSG-QGDS-LHEHIANLAGSPAIKKGILQTVKVVDELVKVMG-rHKPENIVIEMARENQ TTQKGQKNS | 777 |
| WP_032464890 | 703 | TFKEDIQKAQVSG-QGDS-LHEHIANLAGSPAIKKGILQTVKVVDELVKVMG-rHKPENIVIEMARENQ TTQKGQKNS | 777 |
| WP_033888930 | 528 | TFKEDIQKAQVSG-QGHS-LHEQIANLAGSPAIKKGILQTVKVVDELVKVMG-rHKPENIVIEMARENQ TTQKGQKNS | 602 |
| WP_038431314 | 703 | TFKEDIQKAQVSG-QGHS-LHEHIANLAGSPAIKKGILQTVKVVDELVKVMG-rHKPENIVIEMARENQ TTQKGQKNS | 777 |
| WP_038432938 | 703 | TFKEDIQKAQVSG-QGDS-LHEHIANLAGSPAIKKGILQTVKVVDELVKVMG-rHKPENIVIEMARENQ TTQKGQKNS | 776 |
| WP_038434062 | 703 | TFKEDIQKAQVSG-QGDS-LHEHIANLAGSPAIKKGILQTVKVVDELVKVMG-rHKPENIVIEMARENQ TTQKGQKNS | 777 |
| BAQ51233 | 614 | TFKEDIQKAQVSG-QGDS-LHEHIANLAGSPAIKKGILQTVKVVDELVKVMG-rHKPENIVIEMARENQ TTQKGQKNS | 688 |
| KGE60162 | | ------------------------------------------------------------------ --------- | |
| KGE60856 | | ------------------------------------------------------------------ --------- | |
| WP_002989955 | 703 | TFKEDIQKAQVSG-QGDS-LHEHIANLAGSPAIKKGILQTVKVVDELVKVMG-rHKPENIVIEMARENQ TTQKGQKNS | 777 |
| WP_003030002 | 704 | SEKEEIARAQIIG-DVDD-IANVVHDLPGSPAIKKGILQSVKIVDELVKVMG-HNPANIIIEMARENQ MTDKGRRNS | 778 |
| WP_003065552 | 707 | PFKQIIQKSQVVG-DVDD-IEAVVHDLPGSPAIKKGILQSVKIVDELVKVMG-DNPDNIVIEMARENQ TTNRGRSQS | 780 |
| WP_001040076 | 702 | SFKPIIDKARTGS-HSDN-LKEVVGELAGSPAIKKGILQSLKIVDELVKVMG-YEPEQIVVEMARENQ TTAKGLSRS | 775 |
| WP_001040078 | 705 | SFKSIISKAQAGS-HSDN-LKEVVGELAGSPAIKKGILQSLKIVDELVKVMG-YEPEQIVVEMARENQ TTNQGRRNS | 778 |
| WP_001040080 | 705 | SFKSIISKAQAGS-HSDN-LKEVVGELAGSPAIKKGILQSLKIVDELVKVMG-YEPEQIVVEMARENQ TTNQGRRNS | 778 |
| WP_001040081 | 705 | SFKSIISKAQAGS-HSDN-LKEVVGELAGSPAIKKGILQSLKIVDELVKVMG-YEPEQIVVEMARENQ TTNQGRRNS | 778 |
| WP_001040083 | 705 | SFKSIISKAQAGS-HSDN-LKEVVGELAGSPAIKKGILQSLKIVDELVKVMG-YEPEQIVVEMARENQ TTNQGRRNS | 778 |
| WP_001040085 | 705 | SFKSIISKAQAGS-HSDN-LKEVVGELAGSPAIKKGILQSLKIVDELVKVMG-YEPEQIVVEMARENQ TTNQGRRNS | 778 |
| WP_001040087 | 705 | SFKSIISKAQAGS-HSDN-LKEVVGELAGSPAIKKGILQSLKIVDELVKVMG-YEPEQIVVEMARENQ TTNQGRRNS | 778 |

| | | |
|---|---|---|
| WP_001040088 | 705 | SFKSIISKAQAGS-HSDN-LKEVVGELAGSPAIKKGILQSLKIVDELVKVMG-YEPEQIVVEMARENQ TTNQGRRNS 778 |
| WP_001040089 | 705 | SFKSIISKAQAGS-HSDN-LKEVVGELAGSPAIKKGILQSLKIVDELVKVMG-YEPEQIVVEMARENQ TTNQGRRNS 778 |
| WP_001040090 | 705 | SFKSIISKAQAGS-HSDN-LKEVVGELAGSPAIKKGILQSLKIVDELVKVMG-YEPEQIVVEMARENQ TTNQGRRNS 778 |
| WP_001040091 | 705 | SFKSIISKAQAGS-HSDN-LKEVVGELAGSPAIKKGILQSLKIVDELVKVMG-YEPEQIVVEMARENQ TTNQGRRNS 778 |
| WP_001040092 | 705 | SFKSIISKAQSGS-HSDN-LKEVVGELAGSPAIKKGILQSLKIVDELVKVMG-YEPEQIVVEMARENQ TTAKGLSRS 775 |
| WP_001040094 | 702 | SFKPIIDKARTGS-HSDN-LKEVVGELAGSPAIKKGILQSLKIVDELVKVMG-YEPEQIVVEMARENQ TTAKGLSRS 775 |
| WP_001040095 | 702 | SFKPIIDKARTGS-HLDN-LKEVVGELAGSPAIKKGILQSLKIVDELVKVMG-YEPEQIVVEMARENQ TTAKGLSRS 775 |
| WP_001040096 | 702 | SFKPIIDKARTGS-HSDN-LKEVVGELAGSPAIKKGILQSLKIVDELVKVMG-YEPEQIVVEMARENQ TTAKGLSRL 775 |
| WP_001040097 | 702 | SFKPIIDKARTGS-HSDN-LKEVVGELAGSPAIKKGILQSLKIVDELVKVMG-YEPEQIVVEMARENQ TTAKGLSRS 775 |
| WP_001040098 | 702 | SFKPIIDKARTGS-HSDN-LKEVVGELAGSPAIKKGILQSLKIVDELVKVMG-YEPEQIVVEMARENQ TTAKGLSRS 775 |
| WP_001040099 | 702 | SFKPIIDKARTGS-HSDN-LKEVVGELAGSPAIKKGILQSLKIVDELVKVMG-YEPEQIVVEMARENQ TTAKGLSRS 775 |
| WP_001040100 | 702 | SFKPIIDKARTGS-HSDN-LKEVVGELAGSPAIKKGILQSLKIVDELVKVMG-YEPEQIVVEMARENQ TTAKGLSRS 775 |
| WP_001040104 | 705 | SFKSIISKAQAGS-HSDN-LKEVVGELAGSPAIKKGILQSLKIVDELVKVMG-YEPEQIVVEMARENQ TTNQGRRNS 778 |
| WP_001040105 | 705 | SFKPIIDKAQAGS-HSDN-LKEVVGELAGSPAIKKGILQSLKIVDELVKVMG-YEPEQVVVEMARENQ TTNQGRRNT 778 |
| WP_001040106 | 705 | SFKPIIDKAQAGS-HSDN-LKEVVGELAGSPAIKKGILQSLKIVDELVKVMG-YEPEQIVVEMARENQ TTNQGRRNT 778 |
| WP_001040107 | 705 | SFKPIIDKAQAGS-HSDN-LKEVVGELAGSPAIKKGILQSLKIVDELVKVMG-YEPEQIVVEMARENQ TTNQGRRNT 778 |
| WP_001040108 | 705 | SFKPIIDKAQAGS-HSDN-LKEVVGELAGSPAIKKGILQSLKIVDELVKVMG-YEPEQIVVEMARENQ TTNQGRRNS 778 |
| WP_001040109 | 705 | SFKPIIDKAQAGS-HSDN-LKEVVGELAGSPAIKKGILQSLKIVDELVKVMG-YEPEQIVVEMARENQ TTNQGRRNT 778 |
| WP_001040110 | 705 | SFKSIISKAQSGS-HSDN-LKEVVGELAGSPAIKKGILQSLKIVDELVKVMG-YEPEQIVVEMARENQ TTNQGRRNS 778 |
| WP_015058523 | 705 | SFKPIIDKARTGS-HSDN-LKEVVGELAGSPAIKKGILQSLKIVDELVKVMG-YEPEQIVVEMARENQ TTAKGLSRL 775 |
| WP_017643650 | 702 | SFKPIIDKARTGS-HSDN-LKEVVGELAGSPAIKKGILQSLKIVDELVKVMG-YEPEQIVVEMARENQ TTNQGRRNS 778 |
| WP_017647151 | 705 | SFKPIIDKAQAGS-HSDN-LKEVVGELAGSPAIKKGILQSLKIVDELVKVMG-YEPEQIVVEMARENQ TTNQGRRNS 778 |
| WP_017648376 | 705 | SFKPIIDKAQAGS-HSDN-LKEVVGELAGSPAIKKGILQSLKIVDELVKVMG-YEPEQIVVEMARENQ TTNQGRRNS 778 |
| WP_017649527 | 705 | SFKPIIDKAQAGS-HSDN-LKEVVGELAGSPAIKKGILQSLKIVDELVKVMG-YEPEQIVVEMARENQ TTNQGRRNS 778 |
| WP_017771611 | 705 | SFKSIISKAQAGS-HSDN-LKEVVGELAGSPAIKKGILQSLKIVDELVKVMG-YEPEQIVVEMARENQ TTNQGRRNS 778 |
| WP_017771984 | 705 | SFKSIISKAQAGS-HSDN-LKEVVGELAGSPAIKKGILQSLKIVDELVKVMG-YEPEQIVVEMARENQ TTNQGRRNS 778 |
| CFQ25032 | 705 | SFKSIISKAQAGS-HSDN-LKEVVGELAGSPAIKKGILQSLKIVDELVKVMG-YEPEQIVVEMARENQ TTNQGRRNS 778 |
| CFV16040 | 705 | SFKSIISKAQAGS-HSDN-LKEVVGELAGSPAIKKGILQSLKIVDELVKVMG-YEPEQIVVEMARENQ TTNQGRRNS 778 |
| KLJ37842 | 705 | SFKSIISKAQAGS-HSDN-LKEVVGELAGSPAIKKGILQSLKIVDELVKVMG-YEPEQIVVEMARENQ TTNQGRRNS 778 |
| KLJ72361 | 705 | SFKSIISKAQAGS-HSDN-LKEVVGELAGSPAIKKGILQSLKIVDELVKVMG-YEPEQIVVEMARENQ TTNQGRRNS 778 |
| KLL20707 | 719 | SFKSIISKAQAGS-HSDN-LKEVVGELAGSPAIKKGILQSLKIVDELVKVMG-YEPEQIVVEMARENQ TTNKGRRNT 792 |
| KLL42645 | 705 | SFKPIIDKARTGS-HSDN-LKEVVGELAGSPAIKKGILQSLKIVDELVKVMG-YEPEQIVVEMARENQ TTNQGRRNS 778 |
| WP_047207273 | 702 | SFKSIISKAQAGS-HSDN-LKEVVGELAGSPAIKKGILQSLKIVDELVKVMG-YEPEQIVVEMARENQ TTAKGLSRS 775 |
| WP_047209694 | 705 | SFKSIISKAQAGS-HSDN-LKEVVGELAGSPAIKKGILQSLKIVDELVKVMG-YEPEQIVVEMARENQ TTNQGRRNS 778 |
| WP_050198062 | 705 | SFKPIIDKAQAGS-HSDN-IANVVHDLPGSPAIKKGILQSVKIVDELVKVMG-YEPEQIVVEMARENQ TTNQGRRNS 778 |
| WP_050201642 | 705 | SFKPIIDKAQAGS-HSDN-IANVVHDLPGSPAIKKGILQSVKIVDELVKVMG-YEPEQIVVEMARENQ TTNQGRRNS 778 |
| WP_050204027 | 705 | SEKEEIARAQIIG-DVDD-IANVVHDLPGSPAIKKGILQSVKIVDELVKVMG-YEPEQIVVEMARENQ TTNQGRRNS 778 |
| WP_050881965 | 705 | SEKEEIARAQIIG-DVDD-IANVVHDLPGSPAIKKGILQSVKIVDELVKVMG-YEPEQIVVEMARENQ TTNQGRRNS 778 |
| WP_050886065 | 705 | SFKPIIDKAQAGS-HSDN-LKEVVGELAGSPAIKKGILQSLKIVDELVKVMG-YEPEQIVVEMARENQ TTAKGLSRS 775 |
| AHN30376 | 705 | SFKSIISKAQAGS-HSDN-LKEVVGELAGSPAIKKGILQSLKIVDELVKVMG-YEPEQIVVEMARENQ TTNQGRRNS 778 |
| EAO78426 | 705 | SFKSIISKAQSGS-HSDN-LKEVVGELAGSPAIKKGILQSLKIVDELVKVMG-YEPEQIVVEMARENQ TTNQGRRNS 778 |
| CCW42055 | 705 | SFKSIISKAQSGS-HSDN-LKEVVGELAGSPAIKKGILQSLKIVDELVKVMG-YEPEQIVVEMARENQ TTNQGRRNS 778 |
| WP_003041502 | 704 | SFKQIIQEAQVVG-DVDD-IETVVHDLPGSPAIKKGILQTVKIVDELIKVMG-DNPDNIVIEMARENQ TTNQGRRNS 777 |
| WP_037593752 | 705 | TFKEEIEKAQVSG-QGDS-LHEQIADLAGSPAIKKGILQSVKIVDELVKVMG-HKPENIVIEMARENQ TTTKGLQQS 778 |
| WP_049516684 | 713 | TFKEEIEKAQVSG-QGDS-LHEQIADLAGSPAIKKGILQSVKIVDELVKVMG-HKPENIVIEMARENQ TTNRGRSQS 786 |
| GAD46167 | 704 | SEKEEIARAQIID-DVDD-IANVVHDLPGSPAIKKGILQSVKIVDELVKVMG-HNPANIIIEMARENQ TTDKGRRNS 777 |
| WP_018363470 | 704 | TFKEAIQKAQVSG-QGHS-LHEQIANLAGSPAIKKGILQSVKIVDELVKVMG-HNPANIIIEMARENQ TTDKGRRNS 777 |
| WP_003043819 | 703 | PFKQIIKDAQAID-DVDD-IELIVHDLPGSPAIKKGILQSIKIVDELVKVMG-YNPDNIVIEMARENQ TTTKGRRNS 776 |
| WP_006269658 | 704 | TFKEAIQKAQVSG-QGHS-LHEQIANLAGSPAIKKGILQSVKIVDELVKVMG-HKPENIVIEMARENQ TTDKGRRNS 777 |
| WP_048800889 | 703 | TFKEAIQKAQVSG-QGHS-LHEQIANLAGSPAIKKGILQSVKVVDELVKVMG-HKPENIVIEMARENQ TTQKGQKNS 776 |
| WP_012767106 | 703 | TFKEAIQKAQVSG-QGHS-LHEQIANLAGSPAIKKGILQSVKVVDELVKVMG-HKPENIVIEMARENQ TTQKGQKNS 776 |
| WP_014612333 | 703 | TFKEAIQKAQVSG-QGHS-LHEQIANLAGSPAIKKGILQSVKVVDELVKVMG-HKPENIVIEMARENQ TTQKGQKNS 776 |
| WP_015017095 | | |

```
WP_015057649   703  TFKEAIQKAQVSG-QGHS-LHEQIANLAGSPAIKKGILQSVKVVDELVKVMG-HKPENIVIEMARENQ TTQKGQKNS       776
WP_048327215   703  TFKEAIQKAQVSG-QGHS-LHEQIANLAGSPAIKKGILQSVKVVDELVKVMG-HKPENIVIEMARENQ TTQKGQKNS       776
WP_049519324   703  TFKEAIQKAQVSG-QGHS-LHEQIANLAGSPAIKKGILQSVKVVDELVKVMG-HKPENIVIEMARENQ TTQKGQKNS       776
WP_012515931   703  SFIDEIAKAQVIG-KTEY-SKDLVGNLAGSPAIKKGISQTIKIVDELVKIMG-YLPQQIVIEMARENQ TTAQGIKNA       776
WP_021320964   703  SFIDEIAKAQVIG-KTEY-SKDLVGNLASSPAIKKGISQTIKIVDELVKIMG-YLPQQIVIEMARENQ TTAQGIKNA       776
WP_037581760   703  SFKITIQEAQVVG-DVDD-IEAVVHDLPGSPAIKKGILQSVKIVDELVKVMG-HNPQNIVIEMARENQ ITGYGRNRS       777
WP_044232481   704  PFKQIIQKSQVVG-DVDD-IEAVVHDLPGSPAIKKGILQSVKIVDELVKVMG-HNPQNIVIEMARENQ ITGYGRNRS       777
WP_009854540   705  PFKQIIKDAQIIG-DIDD-VISVRELPGSPAIKKGILQSVKIVDELVKVMG-DNPDNIVIEMARENQ FTNRGRSQS       778
WP_012962174   705  PFKQIIQKSQVVG-DVDD-IEAVVHDLPGSPAIKKGILQSVKIVDELVKVMG-DNPDNIVIEMARENQ FTNRGRSQS       778
WP_039695303   707  SFKIIIQEAQVVG-DVDD-IEAVVHDLPGSPAIKKGILQSVKIVDELVKVMG-GNPDNIVIEMARENQ TTGYGRNKS       780
WP_014334983   704  DFAKIIKNEQEKTIKNES-LEETIANLAGSPAIKKGILQSIKIVDEIVKIMG-QNPDNIVIEMARENQ STMQGIKNS       777
WP_003099269   703  DFAKIIKNEQEKTIKNES-LEETIANLAGSPAIKKGILQSIKIVDEIVKIMG-QNPDNIVIEMARENQ STMQGIKNS       777
AHY15608       703  DFAKIIKNEQEKTIKNES-LEETIANLAGSPAIKKGILQSIKIVDEIVKIMG-QNPDNIVIEMARENQ STMQGIKNS       777
AHY17476       ---  -----------------------------------------------------------------  ---------        -
ESR09100       703  DFAKIIKNEQEKTIKNES-LEETIANLAGSPAIKKGILQSIKIVDEIVKIMG-QNPDNIVIEMARENQ STMQGIKNS       777
AGM98575       704  SFKEEIAKAQVIG-EIDN-LNQVVSDIAGSPAIKKGILQSLKIVDELVKIMG-HQPENIVVEMARENQ FTNQGRRNS       777
ALF27331       717  DFKEIIRKAQTIE-NIDT-NQALVSSLPGSPAIKKGILQSLNIVDEIIAIMG-YAPTNIVIEMARENQ TTQKGRDNS       790
WP_018372492   703  SFKEEIQKAQVVG-KIND-VKQVVQELPSGPAIKKGILQSIKIVDELVKVMG-HAPESTVIEMARENQ TTARGKKNS       776
WP_045618028   702  SFKEEIAKAQVIG-KTDD-VKQVVQELSSGPAIKKGILQSIKIVDELVKVMG-HAPESIVIEMARENQ TTARGKKNS       775
WP_046635197   704  SFKEEIAKAQVIG-EIDN-LNQVVSDIAGSPAIKKGILQSLKIVDELVKIMG-HQPENIVVEMARENQ FTNQGRRNS       777
WP_002263549   704  SFKEEIAKAQVIG-EIDN-LNQVVSDIAGSPAIKKGILQSLKIVDELVKIMG-HQPENIVVEMARENQ FTNQGRRNS       777
WP_002263887   704  SFKEEIAKAQVIG-EIDN-LNQVVSDIAGSPAIKKGILQSLKIVDELVKIMG-HQPENIVVEMARENQ FTNQGRRNS       777
WP_002264920   704  SFKEEIAKAQVIG-EIDN-LNQVVSDIAGSPAIKKGILQSLKIVDELVKIMG-HQPENIVVEMARENQ FTNQGRRNS       777
WP_002269043   704  SFKEEIAKAQVIG-ETDN-LNQVVSDIAGSPAIKKGILQSLKIVDELVKIMG-HQPENIVVEMARENQ FTNQGRRNS       777
WP_002269448   704  SFKEEIAKAQVIG-ETDN-LNQVVSDIAGSPAIKKGILQSLKIVDELVKIMG-HQPENIVVEMARENQ FTNQGRQNS       777
WP_002271977   704  SFKEEIAKAQVIG-ETDN-LNQVVQSLAGSPAIKKGILQSLKIVDELVKIMG-HQPENIVVEMARENQ FTNQGRRNS       777
WP_002272766   704  SFKEEIAKAQVIG-ETDN-LNQVVSDIAGSPAIKKGILQSLKIVDELVKIMG-HQPENIVVEMARENQ FTKQGRRNS       777
WP_002273241   704  SFKEEIAKAQVIG-ETDN-LNQVVSDIAGSPAIKKGILQSLKIVDELVKIMG-HQPENIVVEMARENQ FTKQGRRNS       777
WP_002275430   704  SFKEEIAKAQVIG-ETDN-LNQVVSDIAGSPAIKKGILQSLKIVDELVKIMG-HQPENIVVEMARENQ FTKQGRRNS       777
WP_002276448   705  SFKEEIAKAQVIG-ETDN-LNQVVSDIAGSPAIKKGILQSLKIVDELVKIMG-KEPEQIVVEMARENQ TTAKGRRNS       778
WP_002277050   704  TFKDDIVKAQVYD-NSDD-LHQVVQSLAGSPAIKKGILQSLKIVDELVKVMG-HQPENIVVEMARENQ FTNQGRRNS       777
WP_002277364   704  SFKEEIAKAQVIG-ETDN-LNQVVSDIAGSPAIKKGILQSLKIVDELVKIMG-HQPENIVVEMARENQ FTNQGRRNS       777
WP_002279025   704  SFKEEIAKAQVIG-ETDN-LNQVVSDIAGSPAIKKGILQSLKIVDELVKIMG-HQPENIVVEMARENQ FTNQGRRNS       777
WP_002279859   704  SFKEEIAKAQVIG-ETDN-LNQVVSDIAGSPAIKKGILQSLKIVDELVKIMG-HQPENIVVEMARENQ FTNQGRRNS       777
WP_002280230   704  SFKEEIAKAQVIG-ETDN-LNQVVSDIAGSPAIKKGILQSLKIVDELVKIMG-HQPENIVVEMARENQ FTKQGRRNS       777
WP_002281696   704  SFKEEIAKAQVIG-ETDN-LNQVVSDIAGSPAIKKGILQSLKIVDELVKIMG-HQPENIVVEMARENQ FTKQGRRNS       777
WP_002282247   705  TFKDDIVKAQVVD-NSDD-LHQVVQSLAGSPAIKKGILQSLKIVDELVKVMG-KEPEQIVVEMARENQ TTAKGRRNS       778
WP_002282906   704  SFKEEIAKAQVIG-ETDN-LNQVVSDIAGSPAIKKGILQSLKIVDELVKIMG-HQPENIVVEMARENQ FTNQGRRNS       777
WP_002283846   704  SFKEEIAKAQVIG-ETDN-LNQVVSDIAGSPAIKKGILQSLKIVDELVKIMG-HQPENIVVEMARENQ FTNQGRRNS       777
WP_002287255   704  SFKEEIAKAQVIG-ETDN-LNQVVSDIAGSPAIKKGILQSLKIVDELVKIMG-HQPENIVVEMARENQ FTNQGRRNS       777
WP_002288990   704  SFKEEIAKAQVIG-ETDN-LNQVVSDIAGSPAIKKGILQSLKIVDELVKIMG-HQPENIVVEMARENQ FTNQGRRNS       777
WP_002289641   704  SFKEEIAKAQVIG-ETDN-LNQVVSDIAGSPAIKKGILQSLKIVDELVKIMG-HQPENIVVEMARENQ FTNQGRRNS       777
WP_002290427   704  SFKEEIAKAQVIG-ETDN-LNQVVSDIAGSPAIKKGILQSLKIVDELVKIMG-HQPENIVVEMARENQ FTKQGRRNS       777
WP_002295753   704  SFKEEIAKAQVIG-ETDN-LNQVVSDIAGSPAIKKGILQSLKIVDELVKIMG-HQPENIVVEMARENQ FTNQGRRNS       777
WP_002296423   704  SFKEEIAKAQVIG-ETDN-LNQVVSDIAGSPAIKKGILQSLAIKKGILQSLKIVDELVKIMG-HQPENIVVEMARENQ FTNQGRRNS       777
WP_003304487   714  SFKEEIAKAQVIG-EMDG-LNQVVSDIAGSPAIKKGILQSLKIVDELVKVMG-HNPANIVIEMARENQ TTAKGRRSS       787
WP_002305844   704  SFKEEIAKAQVIG-ETDN-LNQVVSDIAGSPAIKKGILQSLKIVDELVKIMG-HQPENIVVEMARENQ FTKQGRRNS       777
WP_002307203   704  SFKEEIAKAQVIG-ETDN-LNQVVSDIAGSPAIKKGILQSLAIKKGILQSLKIVDELVKIMG-HQPENIVVEMARENQ FTNQGRRNS       777
WP_002310390   704  SFKEEIAKAQVIG-ETDN-LNQVVSDIAGSPAIKKGILQSLKIVDELVKIMG-HQPENIVVEMARENQ FTNQGRRNS       777
WP_002352408   704  SFKEEIAKAQVIG-ETDN-LNQVVSDIAGSPAIKKGILQSLKIVDELVKIMG-HQPENIVVEMARENQ FTNQGRRNS       777
WP_012997688   704  SFKEEIAKAQVIG-ETDN-LNQVVSDIAGSPAIKKGILQSLKIVDELVKIMG-HQPENIVVEMARENQ FTNQGRRNS       777
WP_014677909   704  SFKEEIAKAQVIG-ETDN-LNQVVSDIAGSPAIKKGILQSLKIVDELVKIMG-HQPENIVVEMARENQ FTNQGRRNS       777
WP_019312892   704  SFKEEIAKAQVIG-ETDN-LNQVVSDIAGSPAIKKGILQSLKIVDELVKIMG-HQPENIVVEMARENQ FTNQGRRNS       777
```

```
WP_019313659    704   SFKEEIAKAQVIG-ETDN-LNQVVSDIAGSPAIKKGILQSLKIVDELVKIMG-HQPENIVVEMARENQ FTNQGRRNS    777
WP_019314093    704   SFKEEIAKAQVIG-ETDN-LNQVVSDIAGSPAIKKGILQSLKIVDELVKIMG-HQPENIVVEMARENQ FTNQGRRNS    777
WP_019315370    704   SFKEEIAKAQVIG-ETDN-LNQVVSDIAGSPAIKKGILQSLKIVDELVKIMG-HQPENIVVEMARENQ FTNQGRRNS    777
WP_019803776    704   SFKEEIAKAQVIG-ETDN-LNQVVSDIAGSPAIKKGILQSLKIVDELVKIMG-HQPENIVVEMARENQ FTNQGRRNS    777
WP_019805234    704   SFKEEIAKAQVIG-ETDN-LNQVVSDIAGSLAIKKGILQNLKIVDELVKIMG-HQPENIVVEMARENQ FTNQGRRNS    777
WP_024783594    705   TFKDDIVKAQYVD-NSDD-LHQVVQSLAGSPAIKKGILQSLKIVDELVKVMG-KEPEQIVVEMARENQ TTAKGRRNS    778
WP_024784288    704   SFKEEIAKAQVIG-ETDN-LNQVVSDIAGSPAIKKGILQSLKIVDELVKIMG-KEPEQIVVEMARENQ FTNQGRRNS    777
WP_024784666    704   SFKEEIAKAQVIG-ETDN-LNQVVSDIAGSPAIKKGILQSLKIVDELVKIMG-HQPENIVVEMARENQ FTNQGRRNS    777
WP_024784894    705   TFKDDIVKAQYVD-NSDD-LHQVVQSLAGSPAIKKGILQSLKIVDELVKVMG-KEPEQIVVEMARENQ TTAKGRRNS    778
WP_024786433    704   SFKEEIAKAQVIG-EIDN-LNQVVSDIAGSPAIKKGILQSLKIVDELVKIMG-HQPENIVVEMARENQ FTNQGRRNS    777
WP_049473442    704   SFKEEIAKAQVIG-EIDN-LNQVVSDIAGSPAIKKGILQSLKIVDELVKIMG-HQPENIVVEMARENQ FTNQGRRNS    777
WP_049474547    697   SFKEEIAKAQVIG-EIDN-LNQVVSDIAGSPAIKKGILQSLKIVDELVKIMG-HQPENIVVEMARENQ FTNQGRRNS    770
EMC03581        705   SFKEIIKKAQVVG-KTDD-VKQVVQELPGSPAIKKGILQSIKIVDELVKVMG-HEPESIVIEMARENQ TTARGKKNS    778
WP_000428612    703   SFKEITQKAQVVG-KTDD-VKQVVQELPGSPAIKKGILQSIKIVDELVKVMG-HIPESIVIEMARENQ TTARGKKNS    776
WP_000428613    702   SFKETIQKAQVVG-BIND-VKQVVQELPGSPAIKKGILQSIKIVDELVKVMG-HAPESVVIEMARENQ TTNKGKSKS    775
WP_049523028    672   DFASIIKEAQEKTIKSEK-LEETIANLAGSPAIKKGILQSVKIVDEVVKVMG-YEPSNIVIEMARENQ STQRGINNS    746
WP_003107102    705   SFKEEIKKAQEEG-LKDS-INDQIRDLAGSPAIKKGILQIINIVDEIVKIMG-KAPQHIVVEMARDVQ KTDIGVKQS    778
WP_054279288    703   SFKEIIQESQVVG-KPDD-VKQIVQELPGSSAIKKGILQSIKIVDELVKVMG-HDPESIVIEMARENQ TTARGKKNS    776
WP_049531101    703   SFKEIIQKAQVFG-KIND-VKQVVQELPGSPAIKKGILQSIKIVDELVKVMG-HAPESIVIEMARENQ TTTRGKKNS    776
WP_049538452    706   SFKKIIQKSQVVG-ETDD-VKQQVVQELPGSPAIKKGILQSIKIVDELVKVMD-HAPESIVIEMARENQ TTARGKKNS    780
WP_049549711    658   DFEKLIDDAQKKAIKRES-LTEAVANLAGSPAIKKGILQSLKVDEIVKVMG-HNPDNIVIEMSRENQ TTAQLKNA     732
WP_007896501    702   SFKEIIQKAQVVG-KTDD-VKQVVQELPGSPAIKKGILQSIKIVDELVKVMG-YALESIVIEMARENQ TTARGKKNS    775
EFR44625        703   SFKEIIQKAQVVG-KIND-VKQVVQEIPGSPAIKKGILQSIKIVDELVKVMG-HNPESIVIEMARENQ TTAKGKKNS    776
WP_002897477    706   SFKDEIANSQVIG-DGDD-LHQVVQELPGSPAIKKGILQSIKIVDELVKVMG-HAPESIVIEMARENQ TTARGRNNS    779
WP_002906454    703   SFKEIIQKAQVVG-KTDD-LIQVVRELSGSPAIKKGILQSIKIVDELVKVMG-YAPESIVIEMARENQ TTARGKKNS    778
WP_009729476    702   SFVDEIRLAQGSG-EAED-YRAEVQNLAGSPAIKKGILQSIKIVDELIEVMG-YDEHIVVEMARENQ FTNQGRRNS     775
CQR24647        704   SFVDEIRLAQGSG-EAED-YRAEVQNLAGSPAIKKGILQSIKIVDELIEVMG-YDPEHIVVEMARENQ FTNQGRRNS    777
WP_000066813    702   SFVDEIRLAQGSG-EAED-YRAEVQNLAGSPAIKKGILQSIKIVDELIEVMG-YDPEHIVVEMARENQ FTNQGRRNS    775
WP_009754323    704   SFKEEIAKAQVIG-ETDD-LNQVVSDIAGSPAIKKGILQSLKIVDELVKVMG-YNPANIVIEMARENQ TTDKGRRNS    777
WP_044674937    683   LFKKIIEEQPFENE-ALLN--KQRIDELAASPANKKGIWQAIKVKELEKVLQ-QPAENIFFIEFARSDE ES----KRS   752
WP_044676715    706   GYAQMIEEATSCPeDGKF-TYEEVERLAGSPALKRGIWQSLQIVEEITKVMK-CRPKYIYIEFERSEE ----KERT    776
WP_044680361    703   TFKEDIQKAQVSG-QGDS-IKEIVKDLPGSPAIKKGIYQSIRIVDEIIRKMK-DRPKNIVIEMARENQ TTQEGKNKS    784
AIT42264        711   SFKEKIRKAQDIN-QVND-IKEIVKDLPGSPAIKKGIYQSIRIVDEIIRKMK-DRPKNIVIEMARENQ TTQEGKNKS    784
WP_034440723    703   TFKEDIKAQVSG-QGDS-LHEHIANLAGSPAIKKGIYQTVKVVDELVKVMGrHKPENIVIEMARESQ TTQKGQKNS     777
AKQ21048        707   TFKKKIEDAQTIE-DITH-IYDTVAELPGSPAIKKGIRQALKIVEEIIDIIG-YEPENIVVEMARESQ TTKKGKDLS    780
WP_004636532    715   SFKNAIQKAQSSE-HEET-LSETVNELAGSPAIKKGIYQSLKIVDELVAIMG-YAPKRIVVEMARENQ TTSTGKRRS    788
WP_002364836    717   SFKNAIQKAQSSE-HEET-LSETVNELAGSPAIKKGIYQSLKIVDELVAIMG-YAPKRIVVEMARENQ TTSTGKRRS    790
WP_016631044    666   SFKNAIQKAQSSE-HEET-LSETVNELAGSPAIKKGIYQSLKIVDELVAIMG-YAPKRIVVEMARENQ TTSTGKRRS    739
EMS75795        455   SEKNAIQKAQSSE-HEET-LSETVNELAGSPAIKKGIYQTLKIVEELIEIIG-YNPKNIVVEMARENQ RT----NRS   524
WP_002373311    715   SFKEELANELALA-GNQS-LLEVVEALLGSPAIKKGIWQTLKIVEELIEIIG-YNPKNIVVEMARENQ ES----KRS   788
WP_002378009    715   SFKNAIQKAQSSE-HEET-LSETVNELAGSPAIKKGIYQSLKIVDELVAIMG-YAPKRIVVEMARENQ TTSTGKRRS    788
WP_002407324    715   SFKNAIQKAQSSE-HEET-LSETVNELAGSPAIKKGIYQSLKIVDELVAIMG-YAPKRIVVEMARENQ TTSTGKRRS    788
WP_002413717    715   SFKNAIQKAQSSE-HEET-LSETVNELAGSPAIKKGIYQSLKIVDELVAIMG-YAPKRIVVEMARENQ TTSTGKRRS    788
WP_010775580    717   SFKNAIQKAQSSE-HEET-LSETVNELAGSPAIKKGIYQSLKIVDELVAIMG-YAPKRIVVEMARENQ TTSTGKRRS    790
WP_010818269    715   SFKNAIQKAQSSE-HEET-LSETVNELAGSPAIKKGIYQSLKIVDELVAIMG-YAPKRIVVEMARENQ TTSTGKRRS    788
WP_010824395    715   SEKNAIQKAQSSE-HEET-LSETVNELAGSPAIKKGIYQSLKIVDELVAIMG-YAPKRIVVEMARENQ TTSTGKRRS    788
WP_016622645    715   WP_016622645 SEKNAIQKAQSSE-HEET-LSETVNELAGSPAIKKGIYQSLKIVDELVAIMG-YAPKRIVVEMARENQ TTSTGKRRS    788
WP_033622816    715   SEKNAIQKAQSSE-HEET-LSETVNELAGSPAIKKGIYQSLKIVDELVAIMG-YAPKRIVVEMARENQ TTSTGKRRS    788
WP_033625576    715   SEKNAIQKAQSSE-HEET-LSETVNELAGSPAIKKGIYQSLKIVDELVAIMG-YAPKRIVVEMARENQ TTSTGKRRS    788
```

-continued

```
WP_033789179    715 SEKNAIQKAQSSE-HEET-LSETVNELAGSPAIKKGIYQSLKIVDELVAIMG-YAPKRIVVEMARENQ TTSTGKRRS     788
WP_002310644    715 SFKKEIKKAQMIT-DTEN-LEEIVKELIGSPAIKKGILQSLKIVDEIVGIMG-YEPANIVVEMARENQ TTGRGLKSS     788
WP_002312694    716 SFKKEIKKAQMIT-DTEN-LEEIVKELIGSPAIKKGILQSLKIVDEIVGIMG-YEPANIVVEMARENQ TTGRGLKSS     789
WP_002314015    716 SFKKEIKKAQMIT-DTEN-LEEIVKELIGSPAIKKGILQSLKIVDEIVGIMG-YEPANIVVEMARENQ TTGRGLKSS     789
WP_002320716    716 SFKKEIKKAQMIT-DTEN-LEEIVKELIGSPAIKKGILQSLKIVDEIVGIMG-YEPANIVVEMARENQ TTGRGLKSS     789
WP_002330729    715 SFKKEIKKAQMIT-DTEN-LEEIVKELIGSPAIKKGILQSLKIVDEIVGIMG-YEPANIVVEMARENQ TTGRGLKSS     788
WP_002335161    716 SFKKEIKKAQMIT-DTEN-LEEIVKELIGSPAIKKGILQSLKIVDEIVGIMG-YEPANIVVEMARENQ TTGRGLKSS     789
WP_002345439    716 SFKKEIKKAQMIT-DTEN-LEEIVKELIGSPAIKKGILQSLKIVDEIVGIMG-YEPANIVVEMARENQ TTGRGLKSS     789
WP_034867970    711 SEKEEIAKATVES-KHKS-LVDVIQDLPGSPAIKKGIWQSLKIVEELIAIIG-YKPKNIVIEMARENQ KT---HRT     780
WP_047937432    716 SFKKEIKKAQMIT-DTEN-LEEIVKELIGSPAIKKGILQSLKIVDEIVGIMG-YEPANIVVEMARENQ TTGRGLKSS     789
WP_010720994    711 SEKEEIAKATVES-KHKS-LVDVIQDLPGSPAIKKGIWQSLKIVEELIAIIG-YKPKNIVIEMARENQ KT---HRT     780
WP_010737004    711 SEKEEIAKATVES-KHKS-LVDVIQDLPGSPAIKKGIWQSLKIVEELIAIIG-YKPKNIVIEMARENQ KT---HRT     780
WP_034700478    711 SEKEEIAKATVES-KHKS-LVDVIQDLPGSPAIKKGIWQSLKIVDELVAIMG-YKPKNIVVEMARENQ TTGRGKQNS     780
WP_007209903    708 SFKKIIEDSOPYK-EQQS-AEEIVSELSGSPAIKKGIWQSIKIVEEIIGIIG-KAPKNIVIEMARENQ KT---HRT     781
WP_023519017    705 SEKETIANELIMS-DSNV-LLDQVKAIPGSPAVKKGIWQSIKIVEEIIGIIG-KAPKNIVIEMARENQ TTGRGKQNS     774
WP_010770040    708 SFKSIAEAQSDM-NTED-LHEVVQNLAGSPAIKKGIWQSLKIVDELVDIMG-SLPKNIVVEMARENQ TTSRGRTNS     781
WP_048604708    704 TEKEEIEKEQLKA-NSEES LIEIVQNLAGSPAIKKGIFQSLKIVDELVEIMG-YAPTNIVVEMARENQ TTANGRRNS     778
WP_010750235    710 SFKEEIAKELTLS-DKQS-LLEVVEAIPGSPAIKKGIWQTLKIVEELIAIIG-YKPKNIVIEMARENQ TTTGGKNRS     783
AII16583        742 TEKEDIQKAQVSG-QGDS-LHEHIANLAGSPAIKKGILQTVKVVDELVKVMGrHKPENIVIEMARENQ TTQKGQKNS     816
WP_029073316    718 GFKKTIDDANSTSvSGKF-SYAEVQELAGSPAIKRGIWQALLIVDEIKKIMK-HEPAHVYIEFARNED ----KERK     788
WP_031589969    718 GFKKTIDDANSTSvSGKF-SYAEVQELAGSPAIKRGIWQALLIVDEIKIMK-HEPAHVYIEFARNED ----KERK     788
KDA45870        699 SFKETIKNAQVIE-KEET-LAKTVQELPSPAIKKGILQSLEIVDEIIKVMG-YKPKSIVVEMARETQ ---THGTRKR     771
AKP02966        713 DFDKLITEANQMM-LAENGVQDVINDLYTSPQNKKALRQILLVVNDIQKAMKgQAPERILIEFAREDE VNPRLSVQR     788
AKE81011        707 DFKNYIENHNLNKnEDQN-ISNLVNDIHVSPALKRGITQSIKIVQEIVKFMG-HAPKYIFIEVIRETK TTSRGKRIQ     785
WP_010991369    707 SFKSIIEKEQVIT-ADKD-IQSIVADLAGSPAIKKGILQSLKIVDELVSVMG-YPPQTIVVEMARENQ TTGKGKNNS     780
WP_033838504    707 SFKSIIEKEQVIT-ADKD-IQSIVADLAGSPAIKKGILQSLKIVDELVSVMG-YPPQTIVVEMARENQ TTGKGKNNS     780
EHN60060        710 SFKSIIEKEQVIT-ADKD-IQSIVADLAGSPAIKKGILQSLKIVDELVSVMG-YPPQTIVVEMARENQ TTGKGKNNS     783
EFR89594        476 SFKSIIEKEQVST-ADKG-IQSIVAELAGSPAIKKGILQSLKIVDELVGIMG-YPPQTIVVEMARENQ TTGKGKNNS     549
WP_038409211    707 SFKSIIEKEQVST-ADKG-IQSIVAELAGSPAIKKGILQSLKIVDELVGIMG-YPPQTIVVEMARENQ TTGKGKNNS     780
EFR95520        326 SFKSIIEKEQVST-TDKD-LQSIVADLAGSPAIKKGILQSLKIVDELVSIMG-YPPQTIVVEMARENQ TTGKGKNNS     399
WP_003723650    707 SFKSIIEKEQVST-TDKD-LQSIVADLAGSPAIKKGILQSLKIVDELVSIMG-YPPQTIVVEMARENQ TTGKGKNNS     780
WP_003727705    707 SFKSIIEKEQVST-TDKD-LQSIVADLAGSPAIKKGILQSLKIVDELVSIMG-YPPQTIVVEMARENQ TTGKGKNNS     780
WP_003730785    707 SFKSIIEKEQVST-TDKD-LQSIVADLAGSPAIKKGILQSLKIVDELVSIMG-YPPQTIVVEMARENQ TTGKGKNNS     780
WP_003733029    707 SFKSIIEKEQVST-TDKD-LQSIVADLAGSPAIKKGILQSLKIVDELVSIMG-YPPQTIVVEMARENQ TTGKGKNNS     780
WP_003739838    707 SFKSIIEKEQVST-TDKD-LQSIVADLAGSPAIKKGILQSLKIVDELVSIMG-YPPQTIVVEMARENQ TTVKGKNNS     780
WP_014601172    707 SFKSIIEKEQVST-ADKD-LQSIVADLAGSPAIKKGILQSLKIVDELVSIMG-YPPQTIVVEMARENQ TTNKGKNNS     780
WP_023548323    707 SFKSIIEKEQVST-ADKD-LQSIVADLAGSPAIKKGILQSLKIVDELVSIMG-YPPQTIVVEMARENQ TTNKGKNNS     780
WP_031665337    707 SFKSIIEKEQVST-ADKD-LQSIVADLAGSPAIKKGILQSLKIVDELVSIMG-YPPQTIVVEMARENQ TTNKGKNNS     780
WP_031669209    707 SFKSIIEKEQVST-ADKD-LQSIVADLAGSPAIKKGILQSLKIVDELVSIMG-YPPQTIVVEMARENQ TTNKGKNNS     780
WP_033920898    710 SFKSIIEKEQVST-ADKD-LQSIVADLAGSPAIKKGILQSLKVVEELVSIMG-YPPQTIVVEMARENQ TTGKGKNNS     783
AKI42028        707 SFKSIIEKEQVST-ADKD-LQSIVADLAGSPAIKKGILQSLKIVDELVSIMG-YPPQTIVVEMARENQ TTVKGKNNS     780
AKI50529        155 EFR83390        SFKSIIEKEQVST-ADKD-LQSIVADLAGSPAIKKGILQSLKIVDELVSIMG-YPPQTIVVEMARENQ TTQKGQKNS     228
WP_046323366    707 TEKEDIQKAQVSG-QGDS-LHEHIANLAGSPAIKKGILQTVKVVDELVKVMGrHKPENIVIEMARENQ TTQKGQKNS     780
AKE81011        719 TEKEDIQKAQVSG-QGDS-LHEHIANLAGSPAIKKGILQTVKVVDELVKVMGrHKPENIVIEMARENQ TTQKGQKNS     793
CUO82355        710 GYAQMIEEASSCPkDGKF-TYEEVAKLAGSPALKRGIWQSLQIVEEITKVMK-CRPKYIYIEFERSEE ---KERT     780
WP_033162887    713 GYKQIIEESNMQDIEGPF-KYDEVKKLAGSPAIKRGIWQALLVVREITKFMK-HEPSHIYIEFAREEQ ---KVRK     783
AGZ01981        736 TEKEDIQKAQVSG-QGDS-LHEHIANLAGSPAIKKGILQTVKVVDELVKVMGrHKPENIVIEMARENQ TTQKGQKNS     810
AKA60242        703 TEKEDIQKAQVSG-QGDS-LHEHIANLAGSPAIKKGILQTVKVVDELVKVMGrHKPENIVIEMARENQ TTQKGQKNS     777
AKS40380        703 TEKEDIQKAQVSG-QGDS-LHEHIANLAGSPAIKKGILQTVKVVDELVKVMGrHKPENIVIEMARENQ TTQKGQKNS     777
4UN5_B          707 TEKEDIQKAQVSG-QGDS-LHEHIANLAGSPAIKKGILQTVKVVDELVKVMGrHKPENIVIEMARENQ TTQKGQKNS     781
```

| ID | Pos | Sequence | End |
|---|---|---|---|
| WP_010922251 | 778 | RERMKRIEEGIK ELGS QILKEHP --VE- --NTQLQNEKLYLYYLQNGREMYDQEL- -D- --INRLSDYDVDHI | 841 |
| WP_039695303 | 781 | QQRLKKLQNSLK PSYI E----DK--VE- --NSHLQNDQLFLYYIQNGKDMYTGDEL --D- --IDHLSDYDIDHI | 851 |
| WP_045635197 | 776 | QQRYKRIEDSLK ILAS NILKENP -TD- --NNQLQNDRLFLYYLQNGRDMYTGEAL --D- --INQLSSYDIDHI | 843 |
| 5AXW_A | 488 | KDAQKMINEMQK QTNE EIIRTIGk -E- --NAKYLIEKIKLHDMQEGKCLYSLEAIp1EdiLNNPFNYEVDHI | 561 |
| WP_009880683 | 462 | RERMKRIEEGIK ELGS DILKEYP --VE- --NTQLQNEKLYLYYLQNGRDMYVDQEL --D- --INRLSDYDVDHI | 525 |
| WP_010922251 | 778 | RERMKRIEEGIK ELGS QILKEHP --VE- --NTQLQNEKLYLYYLQNGRDMYVDQEL --D- --INRLSDYDVDHI | 841 |
| WP_011054416 | 778 | RERMKRIEEGIK ELGS QILKEHP --VE- --NTQLQNEKLYLYYLQNGRDMYVDQEL --D- --INRLSDYDVDHI | 841 |
| WP_011284745 | 778 | RERMKRIEEGIK ELGS QILKEHP --VE- --NTQLQNEKLYLYYLQNGRDMYVDQEL --D- --INRLSDYDVDHI | 841 |
| WP_011285506 | 778 | RERMKRIEEGIK ELGS QILKEHP --VE- --NTQLQNEKLYLYYLQNGRDMYVDQEL --D- --INRLSDYDVDHI | 841 |
| WP_011527619 | 778 | RERMKRIEEGIK ELGS QILKEHP --VE- --NTQLQNEKLYLYYLQNGRDMYVDQEL --D- --INRLSDYDVDHI | 841 |
| WP_012560673 | 778 | RERMKRIEEGIK ELGS QILKEHP --VE- --TTQLQNEKLYLYYLQNGRDMYVDQEL --D- --INRLSDYDVDHI | 841 |
| WP_014407541 | 777 | RERMKRIEEGIK ELGS DILKEYP --VE- --NTQLQNEKLYLYYLQNGRDMYVDQEL --D- --INRLSDYDVDHI | 840 |
| WP_020905136 | 778 | RERMKRIEEGIK ELGS QILKEHP --VE- --NTQLQNEKLYLYYLQNGRDMYVDQEL --D- --INRLSDYDVDHI | 841 |
| WP_023080005 | 777 | RERMKRIEEGIK ELGS QILKEHP --VE- --NTQLQNEKLYLYYLQNGRDMYVDQEL --D- --INRLSDYDVDHI | 840 |
| WP_023610282 | 777 | RERMKRIEEGIK ELGS DILKEYP --VE- --NTQLQNEKLYLYYLQNGRDMYVDQEL --D- --INRLSDYDVDHI | 840 |
| WP_030125963 | 778 | RERMKRIEEGIK ELGS QILKEHP --VE- --NTQLQNEKLYLYYLQNGRDMYVDQEL --D- --INRLSDYDVDHI | 841 |
| WP_030126706 | 778 | RERMKRIEEGIK ELGS QILKEHP --VE- --NTQLQNEKLYLYYLQNGRDMYVDQEL --D- --INRLSDYDVDHI | 841 |
| WP_031488318 | 778 | RERMKRIEEGIK ELGS QILKEHP --VE- --NTQLQNEKLYLYYLQNGRDMYVDQEL --D- --INRLSDYDVDHI | 841 |
| WP_032460140 | 778 | RERMKRIEEGIK ELGS QILKEHP --VE- --NTQLQNEKLYLYYLQNGRDMYVDQEL --D- --INRLSDYDVDHI | 841 |
| WP_032461047 | 778 | RERMKRIEEGIK ELGS QILKEHP --VE- --NTQLQNEKLYLYYLQNGRDMYVDQEL --D- --INRLSDYDVDHI | 841 |
| WP_032462016 | 778 | RERMKRIEEGIK ELGS DILKEYP --VE- --NTQLQNEKLYLYYLQNGRDMYVDQEL --D- --INRLSDYDVDHI | 841 |
| WP_032462936 | 778 | RERMKRIEEGIK ELGS QILKEHP --VE- --NTQLQNEKLYLYYLQNGRDMYVDQEL --D- --INRLSDYDVDHI | 841 |
| WP_032464890 | 778 | RERMKRIEEGIK ELGS QILKEHP --VE- --NTQLQNEKLYLYYLQNGRDMYVDQEL --D- --INRLSDYDVDHI | 841 |
| WP_033888930 | 603 | RERMKRIEEGIK ELGS DILKEYP --VE- --NTQLQNEKLYLYYLQNGRDMYVDQEL --D- --INRLSDYDVDHI | 666 |
| WP_038431314 | 778 | RERMKRIEEGIK ELGS QILKEHP --VE- --NTQLQNEKLYLYYLQNGRDMYVDQEL --D- --INRLSDYDVDHI | 841 |
| WP_038432938 | 777 | RERMKRIEEGIK ELGS QILKEHP --VE- --NTQLQNEKLYLYYLQNGRDMYVDQEL --D- --INRLSDYDVDHI | 840 |
| WP_038434062 | 778 | RERMKRIEEGIK ELGS QILKEHP --VE- --NTQLQNEKLYLYYLQNGRDMYVDQEL --D- --INRLSDYDVDHI | 841 |
| BAQ51233 | 689 | RERMKRIEEGIK ELGS ------- ---- ---------------------------QEL --D- --INRLSDYDVDHI | 752 |
| KGE60162 | 1 | ------------ ---- ------- ---- ----------------------------- --- -------------- | 16 |
| KGE60856 | | | |
| WP_002989955 | 778 | RERMKRIEEGIK ELGS QILKEHP --VE- --NTQLQNEKLYLYYLQNGRDMYVDQEL --D- --INRLSDYDVDHI | 841 |
| WP_003030002 | 778 | QQRLKKLQDSLK PVNI K----N --VE- --NQQLQNDRLFLYYIQNGKDMYTGETL --D- --INNLSDYDIDHI | 840 |
| WP_003065552 | 781 | QQRLKKLQNSLK PSYI E----DK--VE- --NSHLQNDQLFLYYIQNGKDMYTGDEL --D- --IDHLSDYDIDHI | 851 |
| WP_001040076 | 776 | RQRYKLLDDGVK NLAS NILKEYP -TD- --NQALQNERLFLYYLQNGRDMYTDDEL --D- --IDNLSQYDIDHI | 846 |
| WP_001040078 | 779 | RQRYKLLDDGVK NLAS NILKEYP -TD- --NQALQNERLFLYYLQNGRDMYTDDEL --D- --IDNLSQYDIDHI | 846 |
| WP_001040080 | 779 | RQRYKLLDDGVK NLAS NILKEYP -TD- --NQALQNERLFLYYLQNGRDMYTDDEL --D- --IDNLSQYDIDHI | 846 |
| WP_001040081 | 779 | RQRYKLLDDGVK NLAS NILKEYP -TD- --NQALQNERLFLYYLQNGRDMYTDDEL --D- --IDNLSQYDIDHI | 846 |
| WP_001040083 | 779 | RQRYKLLDDGVK NLAS NILKEYP -TD- --NQALQNERLFLYYLQNGRDMYTDDEL --D- --IDNLSQYDIDHI | 846 |
| WP_001040085 | 779 | RQRYKLLDDGVK NLAS NILKEYP -TD- --NQALQNERLFLYYLQNGRDMYTDDEL --D- --IDDLSQYDIDHI | 846 |
| WP_001040087 | 779 | RQRYKLLDDGVK NLAS NILKEYP -TD- --NQALQNERLFLYYLQNGRDMYTDDEL --D- --IDNLSQYDIDHI | 846 |
| WP_001040088 | 779 | RQRYKLLDDGVK NLAS NILKEYP -TD- --NQALQNERLFLYYLQNGRDMYTDDEL --D- --IDNLSQYDIDHI | 846 |
| WP_001040089 | 779 | RQRYKLLEDGVK NLAS DILKEYP -TD- --NQALQNERLFLYYLQNGRDMYTDDEL --D- --IDNLSQYDIDHI | 846 |
| WP_001040090 | 776 | RQRLTTLRESLA NLKS EKKPKYV- KDqveNHHLSDDRLFLYYLQNGRDMYTDDEL --D- --IDNLSQYDIDHI | 846 |
| WP_001040091 | 776 | RQRLTTLRESLA NLKS EKKPKYV- KDqveNHHLSDDRLFLYYLQNGRDMYTDDEL --D- --IDNLSQYDIDHI | 846 |
| WP_001040092 | 776 | RQRLTTLRESLA NLKS EKKPKYV- KDqveNHHLSDDRLFLYYLQNGRDMYTDDEL --D- --IDNLSQYDIDHI | 846 |
| WP_001040094 | 776 | RQRLTTLRESLA NLKS EKKPKYV- KDqveNHHLSDDRLFLYYLQNGRDMYTDDEL --D- --IDNLSQYDIDHI | 846 |
| WP_001040095 | 776 | RQRLTTLRESLA NLKS EKKPKYV- KDqveNHHLSDDRLFLYYLQNGRDMYTDDEL --D- --IDNLSQYDIDHI | 846 |
| WP_001040096 | 776 | RQRLTTLRESLA NLKS EKKPKYV- KDqveNHHLSDDRLFLYYLQNGRDMYTDDEL --D- --IDNLSQYDIDHI | 846 |
| WP_001040097 | 776 | RQRLTTLRESLA NLKS EKKPKYV- KDqveNHHLSDDRLFLYYLQNGRDMYTDDEL --D- --IDNLSQYDIDHI | 846 |
| WP_001040098 | 776 | RQRLTTLRESLA NLKS EKKPKYV- KDqveNHHLSDDRLFLYYLQNGRDMYTDDEL --D- --IDNLSQYDIDHI | 846 |
| WP_001040099 | 776 | RQRLTTLRESLA NLKS EKKPKYV- KDqveNHHLSDDRLFLYYLQNGRDMYTDDEL --D- --IDNLSQYDIDHI | 846 |
| WP_001040100 | 776 | RQRLTTLRESLA NLKS EKKPKYV- KDqveNHHLSDDRLFLYYLQNGRDMYTDDEL --D- --IDNLSQYDIDHI | 846 |

| ID | | Sequence | End |
|---|---|---|---|
| WP_001040104 | 779 | RQRYKLLDDGVK NLAS NILKEYP--TD---NQALQNERLFLYLYLQNGRDMYTGEAL--D--IDNLSQYDIDHI | 846 |
| WP_001040105 | 779 | RQRYKLLDDGVK NLAS NILKEYP--TD---NQALQNERLFLYLYLQNGRDMYTGEAL--D--IDNLSQYDIDHI | 846 |
| WP_001040106 | 779 | RQRYKLLEEGVK NLAS NILKEYP--TD---NQALQNERLFLYLYLQNGRDMYTGEAL--D--IDNLSQYDIDHI | 846 |
| WP_001040107 | 779 | RQRYKLLEEGVK NLAS NILKEYP--TD---NQALQNERLFLYLYLQNGRDMYTGEAL--D--IDNLSQYDIDHI | 846 |
| WP_001040108 | 779 | RQRYKLLEEGVK NLAS NILKEYP--TD---NQALQNERLFLYLYLQNGRDMYTGETL--D--IDNLSQYDIDHI | 846 |
| WP_001040109 | 779 | RQRYKLLEEGVK NLAS NILKEYP--TD---NQALQNERLFLYLYLQNGRDMYTGEAL--D--IDNLSQYDIDHI | 846 |
| WP_001040110 | 779 | RQRYKLLEDGVK NLAS DILKEYP--TD---NQALQNERLFLYLYLQNGRDMYTGEAL--D--IDNLSQYDIDHI | 846 |
| WP_015058523 | 776 | RQRLTTLRESLA NLKS EKKPKVV-KDqveNHHLSDDRLFLYLYLQNGRDMYTDDEL--D--IDNLSQYDIDLI | 846 |
| WP_017643650 | 779 | RQRYKLLDDGVK NLAS NILKEYP--TD---NQALQNERLFLYLYLQNGRDMYTGKAL--D--IDNLSQYDIDHI | 846 |
| WP_017647151 | 779 | RQRYKLLDDGVK NLAS NILKEYP--TD---NQALQNERLFLYLYLQNGRDMYTGEAL--D--IDNLSQYDIDHI | 846 |
| WP_017648376 | 779 | RQRYKLLDDGVK NLAS NILKEYP--TD---NQALQNERLFLYLYLQNGRDMYTGEAL--D--IDNLSQYDIDHI | 846 |
| WP_017649527 | 779 | RQRYKLLDDGVK NLAS NILKEYP--TD---NQALQNERLFLYLYLQNGRDMYTGEAL--D--IDNLSQYDIDHI | 846 |
| WP_017771611 | 779 | RQRYKLLDDGVK NLAS NILKEYP--TD---NQALQNERLFLYLYLQNGRDMYTGEAL--D--IDNLSQYDIDHI | 846 |
| WP_017771984 | 779 | RQRYKLLDDGVK NLAS NILKEYP--TD---NQALQNERLFLYLYLQNGRDMYTGEAL--D--IDNLSQYDIDHI | 846 |
| CFQ25032 | 779 | RQRYKLLDDGVK NLAS NILKEYP--TD---NQALQNERLFLYLYLQNGRDMYTGEAL--D--IDNLSQYDIDHI | 846 |
| CFV16040 | 779 | RQRYKLLEEGVK NLAS NILKEYP--TD---NQALQNERLFLYLYLQNGRDMYTGEAL--D--IDNLSQYDIDHI | 846 |
| KLJ37842 | 779 | RQRYKLLDDGVK NLAS NILKEYP--TD---NQALQNERLFLYLYLQNGRDMYTGEAL--D--IDNLSQYDIDHI | 846 |
| KLJ72361 | 793 | RQRYKLLDDGVK NLAS NILKEYP--TD---NQALQNERLFLYLYLQNGRDMYTGEAL--D--IDNLSQYDIDHI | 860 |
| KLL20707 | 779 | RQRYKLLDDGVK NLAS NILKEYP--TD---NQALQNERLFLYLYLQNGRDMYTGEAL--D--IDNLSQYDIDHI | 846 |
| KLL42645 | 779 | RQRLTTLRESLA NLKS EKKPKVV-KDqveNHHLSDDRLFLYLYLQNGRDMYTDDEL--D--IDNLSQYDIDHI | 846 |
| WP_047207273 | 776 | RQRYKLLDDGVK NLAS NILKEYP--TD---NQALQNERLFLYLYLQNGRDMYTGEAL--D--IDNLSQYDIDHI | 846 |
| WP_047209694 | 779 | RQRYKLLEEGVK NLAS NILKEYP--TD---NQALQNERLFLYLYLQNGRDMYTGEAL--D--IDNLSQYDIDHI | 846 |
| WP_050198062 | 779 | RQRYKLLDDGVK NLAS NILKEYP--TD---NQALQNERLFLYLYLQNGRDMYTGEAL--D--IDNLSQYDIDHI | 846 |
| WP_050201642 | 779 | RQRYKLLDDGVK NLAS NILKEYP--TD---NQALQNERLFLYLYLQNGRDMYTGEAL--D--IDNLSQYDIDHI | 846 |
| WP_050204027 | 779 | RQRYKLLEEGVK NLAS NILKEYP--TD---NQALQNERLFLYLYLQNGRDMYTGEAL--D--IDNLSQYDIDHI | 846 |
| WP_050881965 | 779 | RQRYKLLDDGVK NLAS NILKEYP--TD---NQALQNERLFLYLYLQNGRDMYTGEAL--D--IDSLSQYDIDHI | 846 |
| WP_050886065 | 779 | RQRYKLLEEGVK NLAS DILKEYP--TD---NQALQNERLFLYLYLQNGRDMYTGEAL--D--IDNLSQYDIDHI | 846 |
| AHN30376 | 779 | RQRYKLLDDGVK NLAS NILKEYP--TD---NQALQNERLFLYLYLQNGRDMYTGEAL--D--IDNLSQYDIDHI | 846 |
| EAO78426 | 779 | RQRYKLLDDGVR NLAS NILKEYP--TD---NQALQNERLFLYLYLQNGRDMYTGEKAL--D--IDNLSQYDIDHI | 846 |
| CCW42055 | 778 | QQRLKLLQDSLK PVNI K------N--VE---NQQLQNDQLFLYIYLQNGRDMYTGETL--D--IDNLSQYDIDHI | 840 |
| WP_003041502 | 779 | QQRLKLLQDSLK PVNI K------N--VE---NQQLQNDRLFLYIYLQNGRDMYTGETL--D--INNLSQYDIDHI | 841 |
| WP_037593752 | 779 | QQRLKLLQDSLK PVNI K------N--VE---NQQLQNDRLFLYIYLQNGRDMYTGETL--D--INNLSQYDIDHI | 841 |
| WP_049516684 | 779 | QQRLKLLQDSLK PVNI K------N--VE---NQQLQNDRLFLYIYLQNGRDMYTGETL--D--INNLSQYDIDHI | 840 |
| GAD46167 | 778 | RQRLKLLQDSLK PSYI E----DK--VE---NSHLQNDQLFLYIYLQNGRDMYTGDEL--D--IDHLSDYDIDHI | 849 |
| WP_018363470 | 779 | RERKKRIEEGIK ELES QILKENP--VE---NTQLQNEKLYLYLYLQNGRDMYTGDDL--D--INRLSDYDVDHI | 850 |
| WP_003043819 | 787 | QQRLKLLQDSLK PVNI K------N--VE---NQQLQNDRLFLYIYLQNGRDMYTGDEL--D--INRLSDYDIDHI | 840 |
| WP_006269658 | 778 | QQRLKLLQDSLT PVSI K------N--VE---NQQLQNDRLFLYIYLQNGRDMYTGDEL--D--IHHLSDYDIDHI | 840 |
| WP_048800889 | 777 | RERMKRIEEGIK ELGS QILKEHP--VE---NTQLQNEKLYLYLYLQNGRDMYTGDEL--D--INRLSDYDVDHI | 849 |
| WP_012767106 | 777 | RERMKRIEEGIK ELGS QILKEHP--VE---NTQLQNEKLYLYLYLQNGRDMYTGDEL--D--INRLSDYDVDHI | 840 |
| WP_014612333 | 777 | RERMKRIEEGIK ELGS QILKEHP--VE---NTQLQNEKLYLYLYLQNGRDMYTGDEL--D--INRLSDYDVDHI | 840 |
| WP_015017095 | 777 | RERMKRIEEGIK ELGS QILKEHP--VE---NTQLQNEKLYLYLYLQNGRDMYTGDEL--D--INRLSDYDVDHI | 840 |
| WP_015057649 | 777 | RERMKRIEEGIK ELGS QILKEHP--VE---NTQLQNEKLYLYLYLQNGRDMYTGDEL--D--IDYLSSYDIDHI | 840 |
| WP_048272215 | 777 | RQRMKLEETAK KLGS NILKEHP--VD---NSQLQNDKRYLYLYLQNGRDMYTGDDL--D--IDHLSDYDIDHI | 840 |
| WP_049519324 | 777 | RQRMKLEETAK KLGS NILKEHP--VD---NSQLQNDKRYLYLYLQNGRDMYTGDDL--D--IDHLSDYDIDHI | 840 |
| WP_012515931 | 778 | RQRMKLEETAK KLGS NILKEHP--VD---NSQLQNDKRYLYLYLQNGRDMYTGDDL--D--IDHLSDYDIDHI | 840 |
| WP_021320964 | 779 | RQRMKLEETAK KLGS NILKEHP--VD---NSQLQNDKRYLYLYLQNGRDMYTGDDL--D--IDYLSSYDIDHI | 840 |
| WP_037581760 | 778 | NQRLKRLQDSLK PSYV D----SK--VE---NSHLQNDQLFLYIYLQNGRDMYTGDDL--D--IDYLSSYDIDHI | 848 |
| WP_042324281 | 779 | QQRLKKLQSSLK PSYV D----DK--VE---NSHLQNDQLFLYIYLQNGRDMYTGDDL--D--IDHLSDYDIDHI | 849 |
| WP_009854540 | 779 | QQRLKKLQDSLK PSYI E----GK--VE---NNHLQDDRLFLYIYLQNGRDMYTGDEL--D--IDHLSDYDIDHI | 849 |
| WP_012962174 | 781 | NQRLKKLQNSLK PSYI E----DK--VE---NSHLQNDQLFLYIYLQNGRDMYTGDDL--D--IDYLSSYDIDHI | 851 |
| WP_039695303 | 778 | QQRLKKLQNSLK PSYV D----SK--VE---NSHLQNDQLFLYIYLQNGRDMYTGKEL--D--IDHLSDYDIDHI | 848 |
| WP_014334983 | 778 | NQRLRKLEEVHK NTGS KILKEYN--VS---NTQLQSDRLYLYLLLQDGKDMYTGKEL--D--YDNLSQYDIDHI | 841 |
| WP_003099269 | | | |

-continued

| | | | | | | |
|---|---|---|---|---|---|---|
| AHY15608 | 778 | RQRLRKLEEVHK | NTGS | KILKEYN | -VS- | -NTQLQSDRLYLYLLQDGKDMYTGKEL | -D- | -YDNLSQYDIDHI | 841 |
| AHY17476 | 778 | RQRLRKLEEVHK | NTGS | KILKEYN | -VS- | -NTQLQSDRLYLYLLQDGKDMYTGKEL | -D- | -YDNLSQYDIDHI | 841 |
| ESR09100 | | | | | | | | | |
| AGM98575 | 778 | RQRLRKLEEVHK | NTGS | KILKEYN | -VS- | -NTQLQSDRLYLYLLQDGKDMYTGKEL | -D- | -IDYLSQYDIDHI | 841 |
| ALF27331 | 778 | QQRLKGLTDSIK | EFGS | QILKEHP | -VE- | -NSQLQNDRLFLYLQNGRDMYTGEEL | -D- | -IDYLSQYDIDHI | 841 |
| WP_018372492 | 791 | AQRLKKIEDGIK | -LGS | DLLKQNP | -IQd | -NKDLQKEKLFLYMQNGIDLYTGQPLncD | | -PDSLAFIDVDHI | 857 |
| WP_045618028 | 777 | QQRYKRIEDALK | NLAH | NILKEHP | -TD- | -NIQLQNDRLFLYLQNGKDMYTGKSL | -D- | -INQLSSCDIDHI | 844 |
| WP_045635197 | 776 | QQRYKRIEDSLK | ILAS | NILKEHP | -TD- | -NNQLQNDRLFLYLYLQNGKDMYTGEAL | -D- | -INQLSSYDIDHI | 843 |
| WP_002263549 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002263887 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002264920 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002269043 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002269448 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002271977 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002272766 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002273241 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002275430 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002276448 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002277050 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002277364 | 779 | QQRYKRLKEAIK | DLNH | KILKEHP | -TD- | -NQALQNNRLFLYLYLQNGRDMYTGEEL | -D- | -INRLSDYDIDHV | 846 |
| WP_002279025 | 778 | QQRLKGLTDSIK | EFGS | QILKEHP | -VE- | -HSQLQNDRLFLYLYLQNGRDMYTGEEL | -D- | -IDYLSQYDIDHI | 841 |
| WP_002279859 | 778 | QQRLKGLTDSIK | EFGS | QILKEHP | -VE- | -NSQLQNDRLFLYLYLQNGRDMYTGESL | -D- | -IDYLSQYDIDHI | 841 |
| WP_002280230 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002281696 | 779 | QQRYKRLKEAIK | DLNH | KILKEHP | -TD- | -NQALQNNRLFLYLYLQNGRDMYTGEEL | -D- | -INRLSDYDIDHV | 846 |
| WP_002282247 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002282906 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002283846 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002872255 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002288990 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002289641 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002290427 | 778 | QQRLKGLTDSIK | EFGS | QILKEHP | -VK- | -HSQLQNDRLFLYLYLQNGRDMYTGEEL | -D- | -IDYLSQYDIDHI | 841 |
| WP_002295753 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002296423 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002304487 | 788 | QKRYKRLEEAIK | DLNH | KILKEHP | -TD- | -NQALQNDRLFLYLYLQNGRDMYTEDPL | -D- | -INRLSDYDIDHI | 855 |
| WP_002305844 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002307203 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_002310390 | 778 | QQRLKGLTDIK | EFGS | QILKEHP | -VE- | -NSQLQNDRLFLYLYLQNGRDMYTGEEL | -D- | -IDYLSQYDIDHI | 841 |
| WP_002352408 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_012997688 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_014677909 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_019312892 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_019313659 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_019314093 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_019315370 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_019803776 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_019805234 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_024783594 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_024784288 | 779 | QQRYKRLKEAIK | DLNH | KILKEHP | -TD- | -NQALQNNRLFLYLYLQNGRDMYTGEEL | -D- | -INRLSDYDIDHV | 846 |
| WP_024784666 | 778 | QQRLKGLTDSIK | EFGS | QILKEHP | -VE- | -HSQLQNDRLFLYLYLQNGRDMYTGEEL | -D- | -IDYLSQYDIDHI | 841 |
| WP_024784894 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_024786433 | 779 | QQRYKRLKEAIK | DLNH | KILKEHP | -TD- | -NQALQNNRLFLYLYLQNGRDMYTGESL | -D- | -INRLSDYDIDHV | 846 |
| WP_049473442 | 778 | QQRLKGLTDSIK | EFGS | QILKEHP | -VE- | -NSQLQNDRLFLYLYLQNGRDMYTGEEL | -D- | -IDYLSQYDIDHI | 841 |
| WP_049474547 | 778 | QQRLKGLTDSIK | EFGS | QILKEHP | -VE- | -NSQLQNDRLFLYLYLQNGRDMYTGEEL | -D- | -IDYLSQYDIDHI | 841 |

-continued

```
EMC03581         771 QQRLKGLTDSIK EFGS QILKEHP -VE- --HSQLQNDRLFLYYLQNGRDMYTGEEL --D- -IDYLSQYDIDHI 834
WP_000428612     779 QQRYKRIEDSLK ILAS KILKEHP -TD- --NIQLQNDRLFLYYLQNGRDMYTGKPL --D- -INQLSSYDIDHI 846
WP_000428613     777 QQRYKRIEDALK NLAS NILKEHP -TN- --NIQLQNDRLFLYYLQNGRDMYTGKPL --D- -INQLSSYDIDHI 844
WP_049523028     776 QQRLKTLSDAIS ELG- NILKEHP -TD- --NIQLQNDRLFLYYLQNGRDMYTGKPL --D- -INQLSSYDIDHI 839
WP_003107102     747 RERLRKLEEVHK NIGS KILKEHE -IS- --NAQLQSDRVYLYLLQDGKDMYTGKDL --D- -FDRLSQYDIDHI 810
WP_054279288     779 RERMKRVQEVLK KLGS QLLKEHP -VE- --NFQLQNERLYLYLYLQNGRDMYTGKDL --S- -ISNLSHYDIDHI 842
WP_049531101     777 QQRYKRIEDSLK NLAS NILKEHP -TD- --NIQLQNDRLFLYYLQNGRDMYTGNPL --D- -INHLSSYDIDHI 844
WP_049538452     777 QQRYKRIENSLK ILAS KILKEHP -TD- --NNQLQNDRLFLYYLQNGRDMYTGEAL --D- -INQLSSYDIDHI 844
WP_049549711     777 QQRYKRIEDSLK ILAS NILKEHP -TD- --NNQLQNDRLFLYYLYLLQDGKDMYTGQDL --D- -INNLSQYDIDHI 844
WP_007896501     781 RQRLKKIKEVHK KTGS RILEDNSerIT --NLTLQDNRLYLYLLQDGKDMYTGQDL --D- -INNLSQYDIDHI 846
EFR44625         733 RQRLKKIKEVHK KTGS RILEDNSerIT --NIQLQNDRLFLYYLQNGRDMYTGKPL --D- -INQLSSYDIDHI 798
WP_002897477     776 QQRYKRIEDALK NLAP NILKEHP -TD- --NIQLQNDRLFLYYLQNGRDMYTGKAI --D- -INQLSSYDIDHI 843
WP_002906454     777 QQRYKRIEDSLK ILAS KILKEHP -TD- --NIQLQNDRLFLYYLQNGRDMYTGEAL --D- -INQLSCDIDHI 844
WP_009729476     780 QQRLGSLTKAIQ DFGS DILKRYP -VE- --NNQLQNDQLYLYLYLQDGKDMYTGDTL --D- -IHNLSQYDIDHI 843
CQR24647         779 QQRYKRIEDSLK NLAS NILKEHP -TD- --NIQLQNDRLFLYYLQNGRDMYTGKDL --E- -INQLSNYDIDHI 846
WP_009754323     777 QQRYKRIEDALK NLAP TISKENP -TN- --NIQLQNDRLFLYYLQNGRDMYTGEAL --D- -IDQLSQYDIDHI 843
WP_044674937     776 QQRYKKIENAIK NLNS KILKEYP -TN- --NQALQNDRLFLYYLQNGRDMYTDEEL --D- -IDQLSQYDIDHI 843
WP_044676715     778 QQRYKKIENAIK NLNS KILKEYP -TN- --NQALQNDRLFLYYLQNGRDMYTDEEL --D- -IDQLSQYDIDHI 845
WP_044680361     778 QQRYKKIENAIK NLNS KILKEYP -TN- --NQALQNDRLFLYYLQNGRDMYTDEEL --D- -IDQLSQYDIDHI 845
WP_044681799     776 QQRYKKIENAIK NLNS NILKEYP -TN- --NQALQNDRLFLYYLQNGRDMYTGETL --D- -INNLSQYDIDHI 843
WP_049533112     778 QQRLKLLQDSLK PVNI K----- -N- -VE- --NQQLQNDRLFLYYIQNGKCMYSGEHL --D- -IERLDSYEVDHI 840
WP_029090905     753 TPRDKFIEKAYA ETDT EHLKELK- -Qr- --SKQLSSQRLFLYFIQNGKCMYSGKKL --D- -ISLDKYQIDHI 823
AI_T42264        778 ESKIKKLENVYK DEQT SVLEELKg FDn- TTKISDSLFLYFTQLGKCMYSGKKL --D- -IRLSDYDIDHI 849
WP_034440723     785 RERMKRIEEGIK ELGS QILKEHP -VE- --NTQLQNEKLYLYYLQNGRDMYVDQEL --D- -IGQLQTYDIDHI 848
AKQ21048         778 KARLKKIQEGLE NLDS HVEKQAL- -D- --EEMLKSPKYYLYCLQNGKDITGKDL --D- -INRLSKYDIDHI 841
WP_002636532     781 KERLEKLTEAIK EFDG --VKVKD -LK- --NENLRNDRLYLYLYLQNGKDMYVDQEL --D- -INRLSKYDIDHI 845
WP_002364836     740 IQRLKIVEKAMA EIGS NLLKEQP -TT- --NEQLRDTRLFLYYMQNGKDMYTGDEL --S- -LHRLSHYDIDHI 803
WP_016631044     525 KPRLKALEEALK SFDS PLLKEQP -VD- --NQALQKDRLYLYYLQNGRDMYTGEAL --D- -IDRLSEYDIDHI 588
EM575795         789 IQRLKIVEKAMA EIGS NLLKEQP -TT- --NEQLRDTRLFLYYMQNGKDMYTGDEL --S- -LHRLSHYDIDHI 852
WP_002373311     789 IQRLKIVEKAMA EIGS NLLKEQP -TT- --NEQLRDTRLFLYYMQNGKDMYTGDEL --S- -LHRLSHYDIDHI 852
WP_002378009     789 IQRLKIVEKAMA EIGS NLLKEQP -TT- --NEQLRDTRLFLYYMQNGKDMYTGDEL --S- -LHRLSHYDIDHI 852
WP_002407324     789 IQRLKIVEKAMA EIGS NLLKEQP -TT- --NEQLRDTRLFLYYMQNGKDMYTGDEL --S- -LHRLSHYDIDHI 852
WP_002413717     789 IQRLKIVEKAMA EIGS NLLKEQP -TT- --NEQLRDTRLFLYYMQNGKDMYTGDEL --S- -LHRLSHYDIDHI 852
WP_010775580     791 IQRLKIVEKAMA EIGS NLLKEQP -TT- --NEQLRDTRLFLYYMQNGKDMYTGDEL --S- -LHRLSHYDIDHI 854
WP_010818269     789 IQRLKIVEKAMA EIGS NLLKEQP -TT- --NEQLRDTRLFLYYMQNGKDMYTGDEL --S- -LHRLSHYDIDHI 852
WP_010824395     789 IQRLKIVEKAMA EIGS NLLKEQP -TT- --NEQLRDTRLFLYYMQNGKDMYTGDEL --S- -LHRLSHYDIDHI 852
WP_016622645     789 IQRLKIVEKAMA EIGS NLLKEQP -TT- --NEQLRDTRLFLYYMQNGKDMYTGDEL --S- -LHRLSHYDIDHI 852
WP_033624816     789 IQRLKIVEKAMA EIGS NLLKEQP -TT- --NEQLRDTRLFLYYMQNGKDMYTGDEL --S- -LHRLSHYDIDHI 852
WP_033625576     789 IQRLKIVEKAMA EIGS NLLKEQP -TT- --NEQLRDTRLFLYYMQNGKDMYTGDEL --S- -LHRLSHYDIDHI 852
WP_033789179     789 IQRLKIVEKAMA EIGS NLLKEQP -TT- --NEQLRDTRLFLYYMQNGKDMYTGDEL --S- -LHRLSHYDIDHI 852
WP_002310644     789 RPRLKALEEESLK DFGS QLLKEYP -TD- --NSSLQKDRLYLYLYLQNGRDMYTGAPL --D- -IHRLSDYDIDHI 852
WP_002312694     790 RPRLKALEEESLK DFGS QLLKEYP -TD- --NSSLQKDRLYLYLYLQNGRDMYTGAPL --D- -IHRLSDYDIDHI 853
WP_002314015     790 RPRLKALEEESLK DFGS QLLKEYP -TD- --NSSLQKDRLYLYLYLQNGRDMYTGAPL --D- -IHRLSDYDIDHI 853
WP_002320716     790 RPRLKALEEESLK DFGS QLLKEYP -TD- --NSSLQKDRLYLYLYLQNGRDMYTGAPL --D- -IHRLSDYDIDHI 853
WP_002330729     789 RPRLKALEEESLK DFGS QLLKEYP -TD- --NSSLQKDRLYLYLYLQNGRDMYTGAPL --D- -IHRLSDYDIDHI 852
WP_002335161     790 RPRLKALEEESLK DFGS QLLKEYP -TD- --NSSLQKDRLYLYLYLQNGRDMYTGAPL --D- -IHRLSDYDIDHI 853
WP_002345439     790 RPRLKALEEESLK DFGS QLLKEYP -TD- --NSSLQKDRLYLYLYLQNGRDMYTGAPL --D- -IHRLSDYDIDHI 853
WP_034867970     781 SPRLKALENGLK QIGS TLLKEQP -TD- --NKALQKERLYLYLYLQNGRDMYTGEPL --E- -IENLHQYEVDHI 844
WP_047937432     790 RPRLKALEEESLK DFGS QLLKEQP -TD- --NSSLQKDRLYLYLYLQNGRDMYTGAPL --D- -IHRLSDYDIDHI 853
WP_010720994     781 KPRLKALENGJK QIGS TLLKEQP -TD- --NKALQKERLYLYLYLQNGRDMYTGEPL --E- -IENLHQYEVDHI 844
WP_010737004     781 SPRLKALENGLK QIGS TLLKEQP -TD- --NKALQKERLYLYLYLQNGRDMYTGEPL --E- -IENLHQYEVDHI 844
```

```
-continued

WP_034700478  781  KPRLKALENGLK QIGS TLLKEQP--TD---NKALQKERLYLYLYLQNGRDMYTGEPL--E--IENLHQYEVDHI  844
WP_007209003  782  KPRLKGIENGLK EFSD SVLKGSS--ID---NKQLQNDRLYLYLYLQNGKDMYTGHEL--D--IDHLSTYDIDHI  845
WP_023519017  775  RPRLKALEEALK NIDS PLLKDYP--TD---NQALQKDRLYLYLYLQNGKDMYTGEPL--E--IHRLSEYDIDHI  838
WP_010770040  782  NPRMKALEEAMR NLRS NLLKEYP--TD---NQALQNDRLYLYLYLQNGKDMYTGLDL--S--LHNLSSYDIDHI  845
WP_048604708  779  RPRLKNLEKAID DLDS EILKKHP--VD---NKALQKDRLYLYLYLQNGKDMYTNEEL--D--IHKLSTYDIDHI  842
WP_010750235  784  RPRLKSLEEAIK NFDS QLLKEHP--VE---NQSLQNEKLYLYLYLQNGRDMYTGESL--D--IDRLSEYDIDHI  847
AII16583      817  RERMKRIEEGIK ELGS QILKEHP--VE---NTQLQNEKLYLYLYLQNGRDMVDQEL--D--INRLSDYDVDHI  880
WP_029073316  789  DSFVNQMLKLYK DFED EANKHLKg-EDa--KSKIRSERLKLYYTQMGKCMYTGKSL--D--IDRLDTYQVDHI  860
WP_031589969  789  DSFVNQMLKLYK DFED EANKHLKg-EDa--KSKIRSERLKLYYTQMGKCMYTGKSL--D--IDRLDTYQVDHI  860
KDA45870      772  EDRVQQIVKNLK ELPK ------P--S----NAELSDERKYLYCLQNGRDMYTGAPL--D--YDHLQFYDVDHI  833
AKP02966      789  KRQVEQVYQNIS EL-- EIRNELK---D1--sNSALSNTRLFLYFMQGGRDMYTGDSL--N--IDRLSTYDIDHI  856
WP_039099354  786  RLQSKLLNKANG -LVP EELKKHKn--TD---LSSERIMLYPLQNGKSLYSEESL--N--INKLSDYQVDHI  858
WP_010991369  781  RPRYKSLEKAIK EFGS QILKEHP--TD---NQELRNNRLYLYLYLQNGKDMYTGQDL--D--IHNLSNYDIDHI  844
WP_033838504  781  RPRYKSLEKAIK EFGS QILKEHP--TD---NQELRNNRLYLYLYLQNGKDMYTGQDL--D--IHNLSNYDIDHI  844
EHN60060      784  RPRYKSLEKAIK EFGS QILKEHP--VD---NQELRNNRLYLYLYLQNGKDMYTGQDL--D--IHNLSNYDIDHI  847
EFR89594      550  RPRYKSLEKAIK EFGS QILKEHP--TD---NQELRNNRLYLYLYLQNGKDMYTGQDL--D--IHNLSNYDIDHI  613
WP_038409211  781  KPRFISLEKAIK EFGS QILKEHP--TD---NQCLKNDRLYLYLYLQNGKDMYTGKEL--D--IHNLSNYDIDHI  844
EFR95520      400  KPRYKSLEKAIK EFGS QILKEHP--TD---NQELKNNRLYLYLYLQNGKDMYTGKEL--D--IHNLSNYDIDHI  463
WP_003723650  781  RPRYKSLEKAIK EFGS QILKEHP--TD---NQELKNNRLYLYLYLQNGKDMYTGQEL--D--IHNLSNYDIDHI  844
WP_003727705  781  KPRYKSLEKAIK DFGS QILKEHP--TD---NQELKNNRLYLYLYLQNGKDIYTGQEL--D--IHNLSNYDIDHI  844
WP_003730785  781  RPRYKSLEKAIK EFGS QILKEHP--TD---NQELKNNRLYLYLYLQNGKDMYTGQEL--D--IHNLSNYDIDHI  844
WP_003733029  781  RPRYKSLEKAIK EFGS QILKEHP--TD---NQELKNNRLYLYLYLQNGKDMYTGQEL--D--IHNLSNYDIDHI  844
WP_003739838  781  RPRYKSLEKAIK EFGS KILKEHP--TD---NQELKNNRLYLYLYLQNGKDMYTGQEL--D--IHNLSNYDIDHI  844
WP_014601172  781  RPRYKSLEKAIK EFGS QILKEHP--TD---NQELKNNRLYLYLYLQNGKDMYTGQEL--D--IHNLSNYDIDHI  844
WP_023548323  781  RPRYKSLEKAIK EFGS QILKEHP--TD---NQELKNNRLYLYLYLQNGKDMYTGQEL--D--IHNLSNYDIDHI  844
WP_031665337  781  KPRYKSLEKAIK EFGS QILKEHP--TD---NQELKNNRLYLYLYLQNGKDMYTGQEL--D--IHNLSNYDIDHI  844
WP_031669209  781  KPRYKSLEKAIK EFGS QILKEHP--TD---NQELKNNRLYLYLYLQNGKDMYTGQEL--D--IHNLSNYDIDHI  844
WP_033920898  781  KPRYKSLEKAIK EFGS QILKEHP--TD---NQELKNNRLYLYLYLQNGKDMYTGQEL--D--IHNLSNYDIDHI  844
AKI42028      784  KPRYKSLEKAIK EFGS QILKEHP--TD---NQELKNNRLYLYLYLQNGKDMYTGQEL--D--IHNLSNYDIDHI  847
AKI50529      784  KPRYKSLEKAIK EFGS QILKEHP--TD---NQELKNNRLYLYLYLQNGKDIYTGQEL--D--IHNLSNYDIDHI  847
EFR83390      229  KPRFTSLEKAIK ELGS QILKEHP--TD---NQGLKNDRLYLYLYLQNGKDIYTGQEL--D--IHNLSNYDIDHV  292
WP_046323366  781  RERMKRIEEGIK ELGS QILKEHP--VE---NTQLQNEKLYLYLYLQNGRDMVDQEL--D--IHNLSDYDVDHI  844
AKE81011      794  ESKIKKLENVYK DEQT SVLEELKg-FDn--TKKISSDSLFLYFTQLGKCMYSGKKL--D--IDSLDKYQIDHI  857
CUO82355      781  ESKIAKLQKIYE NLQT QVYESLKg-EDa--KKRMETDALYLYLYLQMGKSMYSGKPL--D--IDKLSTYQIDHI  853
WP_033162887  784  RERMKRIEEGIK ELGS QILKEHP--VE---NTQLQNEKLYLYLYLQNGRDMVDQEL--D--INRLSDYDVDHI  855
AGZ01981      811  RERMKRIEEGIK ELGS QILKEHP--VE---NTQLQNEKLYLYLYLQNGRDMVDQEL--D--INRLSDYDVDHI  874
AKA60242      778  RERMKRIEEGIK ELGS QILKEHP--VE---NTQLQNEKLYLYLYLQNGRDMVDQEL--D--INRLSDYDAI  841
AKS40380      782  RERMKRIEEGIK ELGS QILKEHP--VE---NTQLQNEKLYLYLYLQNGRDMVDQEL--D--INRLSDYDAI  845
4UN5_B        842  VPQSFLKDDSIDNKVLIRSDKNRG-KSDN--VP S---EEVVKKMKN-YWRQLLNAKLITQRKFDNLTKA--ERGGLSE  910

WP_039695303  852  IPQAFIKDDSIDNRVLISSAKNRG-KSDD--VP S---LDIVRARKA-EWVRLYKSGLISKRKEDNLTKA--ERGGLTE  920
WP_045635197  844  IPQAFIKDDSLDNRVLISSKDNRG-KSDN--VP S---IEVVQKRKA-FWQQLLDSKLISERKFNNLTKA--ERGGLDE  912
5AXW_A        562  IPRSVSFDNSFNNKVLVKQBEASK-KGNR--TP Fqy-LSSSDSKI--SYETFKKHILNLAKGKGRISKTK-KEYLLEE  632
WP_009880683  526  VPQSFLKDSIDNKVLIRSDKNRG-KSDN--VP S---EEVVKKMKN-YWKQLLNAKLITQRKFDNLTKA--ERGGLSE  594
WP_010922251  842  VPQSFLKDDSIDNKVLIRSDKNRG-KSDN--VP S---EEVVKKMKN-YWRQLLNAKLITQRKFDNLTKA--ERGGLSE  910
WP_011054416  842  VPQSFLKDDSIDNKVLIRSDKNRG-KSDN--VP S---EEVVKKMKN-YWRQLLNAKLITQRKFDNLTKA--ERGGLSE  910
WP_011284745  842  VPQSFLKDDSIDNKVLIRSDKNRG-KSNN--VP S---EEVVKKMKN-YWRQLLNAKLITQRKFDNLTKA--ERGGLSE  910
WP_011285506  842  VPQSFLKDDSIDNKVLIRSDKNRG-KSDN--VP S---EEVVKKMKN-YWRQLLNAKLITQRKFDNLTKA--ERGGLSE  910
WP_011527619  842  VPQSFLKDDSIDNKVLIRSDKNRG-KSDN--VP S---EEVVKKMKN-YWRQLLNAKLITQRKFDNLTKA--ERGGLSE  910
WP_012560673  842  VPQSFLKDDSIDNKVLIRSDKNRG-KSDN--VP S---EEVVKKMKN-YWRQLLNAKLITQRKFDNLTKA--ERGGLSE  910
WP_014407541  841  VPQSFLKDDSIDNKVLIRSDKNRG-KSDN--VP S---EEVVKKMKN-YWRQLLNAKLITQRKFDNLTKA--ERGGLSE  909
WP_020905136  842  VPQSFLKDDSIDNKVLIRSDKNRG-KSDN--VP S---EEVVKKMKN-YWRQLLNAKLITQRKFDNLTKA--ERGGLSE  910
```

-continued

| | | | |
|---|---|---|---|
| WP_023080005 | 841 | VPQSFLKDDSIDNKVLIRSDKNRG-KSDN--VP-S--EEVVKKMKN-YWRQLLNAKLITQRKFDNLTKA--ERGGLSE | 909 |
| WP_023610282 | 841 | VPQSFLKDDSIDNKVLIRSDKNRG-KSDN--VP-S--EEVVKKMKN-YWRQLLNAKLITQRKFDNLTKA--ERGGLSE | 909 |
| WP_030125963 | 842 | VPQSFIKDDSIDNKVLIRSDKNRG-KSDN--VP-S--EEVVKKMKN-YWRQLLNAKLITQRKFDNLTKA--ERGGLSE | 910 |
| WP_030126706 | 842 | VPQSFIKDDSIDNKVLIRSDKNRG-KSDN--VP-S--EEVVKKMKN-YWRQLLNAKLITQRKFDNLTKA--ERGGLSE | 910 |
| WP_031488318 | 842 | VPQSFIKDDSIDNKVLIRSDKNRG-KSDN--VP-S--EEVVKKMKN-YWRQLLNAKLITQRKFDNLTKA--ERGGLSE | 910 |
| WP_032460140 | 842 | VPQSFIKDDSIDNKVLIRSDKNRG-KSDN--VP-S--LEVVKKMKN-YWKQLLNAKLITQRKFDNLTKA--ERGGLSE | 910 |
| WP_032461047 | 842 | VPQSFIKDDSIDNKVLIRSDKNRG-KSDN--VP-S--LEVVKKMKN-YWKQLLNAKLITQRKFDNLTKA--ERGGLSE | 910 |
| WP_032462016 | 842 | VPQSFIKDDSIDNKVLIRSDKNRG-KSDN--VP-S--EEVVKKMKN-YWRQLLNAKLITQRKFDNLTKA--ERGGLSE | 910 |
| WP_032462936 | 842 | VPQSFLKDDSIDNKVLIRSDKNRG-KSDN--VP-S--EEVVKKMKN-YWRQLLNAKLITQRKFDNLTKA--ERGGLSE | 910 |
| WP_032464890 | 842 | VPQSFIKDDSIDNKVLIRSDKNRG-KSDN--VP-S--EEVVKKMKN-YWRQLLNAKLITQRKFDNLTKA--ERGGLSE | 910 |
| WP_033888930 | 667 | VPQSFIKDDSIDNKVLIRSDKNRG-KSDN--VP-S--EEVVKKMKN-YWRQLLNAKLITQRKFDNLTKA--ERGGLSE | 735 |
| WP_038431314 | 842 | VPQSFLKDDSIDNKVLIRSDKNRG-KSDN--VP-S--EEVVKKMKN-YWRQLLNAKLITQRKFDNLTKA--ERGGLSE | 910 |
| WP_038432938 | 841 | VPQSFIKDDSIDNKVLIRSDKNRG-KSDN--VP-S--EEVVKKMKN-YWRQLLNAKLITQRKFDNLTKA--ERGGLSE | 909 |
| WP_038434062 | 842 | VPQSFLKDDSIDNKVLIRSDKNRG-KSDN--VP-S--EEVVKKMKN-YWRQLLNAKLITQRKFDNLTKA--ERGGLSE | 910 |
| BAQ51233 | 753 | VPQSFLKDDSIDNKVLIRSDKNRG-KSDN--VP-S--EEVVKKMKN-YWRQLLNAKLITQRKFDNLTKA--ERGGLSE | 821 |
| KGE60162 | 17 | VPQSFLKDDSIDNKVLIRSDKNRG-KSDN--VP-S--EEVVKKMKN-YWRQLLNAKLITQRKFDNLTKA--ERGGLSE | 85 |
| KGE60856 | | | |
| WP_002989955 | 841 | VPQSFIKDDSIDNKVLIRSDKNRG-KSDN--VP-S--EEVVKKMKN-YWRQLLNAKLITQRKFDNLTKA--ERGGLSE | 909 |
| WP_003030002 | 841 | IPQSFIKDNSLDDNRVLIRSDKNRG-KSDN--VP-S--IEVVHEMKS-FWSKLLSVKLITQRKFDNLTKA--ERGGLTE | 909 |
| WP_003065552 | 852 | IPQAFIKDDSIDNRVLISSAKNRG-KSDD--VP-S--LDIVRARKA-EWVRLYKSGLISKRKEDNLTKA--ERGGLTE | 920 |
| WP_001040076 | 847 | IPQAFIKDDSIDNRVLVSSAKNRG-KSDD--VP-S--LEIVKDCKV-FWKKLLDAKLMSQRKYDNLTKA--ERGGLTS | 915 |
| WP_001040078 | 847 | IPQAFIKDDSIDNRVLVSSAKNRG-KSDD--VP-S--LEIVKDCKV-FWKKLLDAKLMSQRKYDNLTKA--ERGGLTS | 915 |
| WP_001040080 | 847 | IPQAFIKDDSIDNRVLVSSAKNRG-KSDD--VP-S--LEIVKDCKV-FWKKLLDAKLMSQRKYDNLTKA--ERGGLTS | 915 |
| WP_001040083 | 847 | IPQAFIKDDSIDNRVLVSSAKNRG-KSDD--VP-S--LEIVKDCKV-FWKKLLDAKLMSQRKYDNLTKA--ERGGLTS | 915 |
| WP_001040085 | 847 | IPQAFIKDDSIDNRVLVSSAKNRG-KSDD--VP-S--LEIVKDCKV-FWKKLLDAKLMSQRKYDNLTKA--ERGGLTS | 915 |
| WP_001040087 | 847 | IPQAFIKDDSIDNRVLVSSAKNRG-KSDD--VP-S--LEIVKDCKV-FWKKLLDAKLISQRKYDNLTKA--ERGGLTS | 915 |
| WP_001040088 | 847 | IPQAFIKDDSIDNRVLVSSAKNRG-KSDD--VP-S--IDIVKARKA-FWKKLLDAKLMSQRKYDNLTKA--ERGGLTS | 915 |
| WP_001040089 | 847 | IPQAFIKDDSIDNRVLVSSAKNRG-KSDD--VP-S--VEIVKDCKV-FWKKLLDAKLMSQRKYDNLTKA--ERGGLTP | 915 |
| WP_001040090 | 847 | VPQAFIKDDSIDNRVLVSSAKNRG-KSDD--VP-S--VEIVKDCKV-FWKKLLDAKLMSQRKYDNLTKA--ERGGLTS | 915 |
| WP_001040091 | 847 | IPQAFIKDDSIDNRVLVSSAKNRG-KSDD--VP-S--VEIVKDCKV-FWKKLLDAKLMSQRKYDNLTKA--ERGGLTS | 915 |
| WP_001040094 | 847 | IPQAFIKDDSIDNRVLVSSAKNRG-KSDD--VP-S--VEIVKDCKV-FWKKLLDAKLMSQRKYDNLTKA--ERGGLTS | 915 |
| WP_001040095 | 847 | VPQAFIKDDSIDNRVLVSSAKNRG-KSDD--VP-S--LEIVKDCKV-FWKKLLDAKLMSQRKYDNLTKA--ERGGLTS | 915 |
| WP_001040096 | 847 | IPQAFIKDDSIDNRVLVSSAKNRG-KSDD--VP-S--IDIVKARKA-FWKKLLDAKLMSQRKYDNLTKA--ERGGLTS | 915 |
| WP_001040097 | 847 | IPQAFIKDDSIDNRVLVSSAKNRG-KSDD--VP-S--IDIVKARKA-FWKKLLDAKLMSQRKYDNLTKA--ERGGLTS | 915 |
| WP_001040098 | 847 | IPQAFIKDDSIDNRVLVSSAKNRG-KSDD--VP-S--IDIVKARKA-FWKKLLDAKLMSQRKYDNLTKA--ERGGLTS | 915 |
| WP_001040099 | 847 | IPQAFIKDDSIDNRVLVSSAKNRG-KSDD--VP-S--IDIVKARKA-FWKKLLDAKLMSQRKYDNLTKA--ERGGLTS | 915 |
| WP_001040100 | 847 | IPQAFIKDDSIDNRVLVSSAKNRG-KSDD--VP-S--IDIVKARKA-FWKKLLDAKLMSQRKYDNLTKA--ERGGLTS | 915 |
| WP_001040104 | 847 | IPQAFIKDDSIDNRVLVSSAKNRG-KSDD--VP-S--LEIVKDCKV-FWKKLLDAKLMSQRKYDNLTKA--ERGGLTS | 915 |
| WP_001040105 | 847 | IPQAFIKDDSIDNRVLVSSAKNRG-KSDD--VP-S--IDIVKARKA-FWKKLLDAKLMSQRKYDNLTKA--ERGGLTS | 915 |
| WP_001040106 | 847 | IPQAFIKDDSIDNRVLVSSAKNRG-KSDD--VP-S--IDIVKARKA-FWKKLLDAKLMSQRKYDNLTKA--ERGGLTS | 915 |
| WP_001040107 | 847 | IPQAFIKDDSIDNRVLVSSAKNRG-KSDD--VP-S--IDIVKARKA-FWKKLLDAKLMSQRKYDNLTKA--ERGGLTS | 915 |
| WP_001040108 | 847 | IPQAFIKDDSIDNRVLVSSAKNRG-KSDD--VP-S--LEIVKDCKV-FWKKLLDAKLMSQRKYDNLTKA--ERGGLTS | 915 |
| WP_001040109 | 847 | IPQAFIKDDSIDNRVLVSSAKNRG-KSDD--VP-S--LEIVKDCKV-FWKKLLDAKLMSQRKYDNLTKA--ERGGLTS | 915 |
| WP_001040110 | 847 | IPQAFIKDDSIDNRVLVSSAKNRG-KSDD--VP-S--LEIVKDCKV-FWKKLLDAKLMSQRKYDNLTKA--ERGGLTS | 915 |
| WP_015058523 | 847 | VPQAFIKDDSIDNRVLVSSAKNRG-KSDD--VP-S--IDIVKARKA-FWKKLLDAKLISQRKYDNLTKA--ERGGLTP | 915 |
| WP_017643650 | 847 | IPQAFIKDDSIDNRVLVSSAKNRG-KSDD--VP-S--LEIVKDCKV-FWKKLLDAKLMSQRKYDNLTKA--ERGGLTS | 915 |
| WP_017647151 | 847 | VPQAFIKDDSIDNRVLVSSAKNRG-KSDD--VP-S--VEIVKDCKV-FWKKLLDAKLMSQRKYDNLTKA--ERGGLTS | 915 |
| WP_017649527 | 847 | IPQAFIKDDSIDNRVLVSSAKNRG-KSDD--VP-S--LEIVKDCKV-FWKKLLDAKLMSQRKYDNLTKA--ERGGLTS | 915 |
| WP_017771611 | 847 | VPQAFIKDDSIDNRVLVSSAKNRG-KSDD--VP-S--IDIVKARKA-FWKKLLDAKLMSQRKYDNLTKA--ERGGLTS | 915 |
| WP_017771984 | 847 | IPQAFIKDDSIDNRVLVSSAKNRG-KSDD--VP-S--LEIVKDCKV-FWKKLLDAKLMSQRKYDNLTKA--ERGGLTS | 915 |

-continued

| | | | |
|---|---|---|---|
| CFQ25032 | 847 | IPQAFIKDDSIDNRVLVSSAKNRG-KSDD--VP S--LEIVKDCKV-FWKKLLDAKLMSQRKYDNLTKA--ERGGLTS | 915 |
| CFV16040 | 847 | IPQAFIKDDSIDNRVLVSSAKNRG-KSDD--VP S--LEIVKDCKV-FWKKLLDAKLMSQRKYDNLTKA--ERGGLTS | 915 |
| KLJ37842 | 847 | IPQAFIKDDSIDNRVLVSSAKNRG-KSDD--VP S--LEIVKDCKV-FWKKLLDAKLMSQRKYDNLTKA--ERGGLTS | 915 |
| KLJ72361 | 847 | IPQAFIKDDSIDNRVLVSSAKNRG-KSDD--VP S--LEIVKDCKV-FWKKLLDAKLMSQRKYDNLTKA--ERGGLTS | 915 |
| KLL20707 | 861 | IPQAFIKDDSIDNRVLVSSAKNRG-KSDD--VP S--LEIVKDCKV-FWKKLLDAKLMSQRKYDNLTKA--ERGGLTS | 929 |
| KLL42645 | 847 | VPQAFIKDDSIDNRVLVSSAKNRG-KSDN--VP S--IDIVKARKA-FWKKLLDAKLMSQRKYDNLTKA--ERGGLTS | 915 |
| WP_047207273 | 847 | IPQAFIKDDSIDNRVLVSSAKNRG-KSDD--VP S--LEIVKDCKV-FWKKLLDAKLMSQRKYDNLTKA--ERGGLTS | 915 |
| WP_047209694 | 847 | IPQAFIKDDSIDNRVLVSSAKNRG-KSDD--VP S--VEIVKDCKV-FWKKLLDAKLMSQRKYDNLTKA--ERGGLTS | 915 |
| WP_050198062 | 847 | IPQAFIKDDSIDNRVLVSSAKNRG-KSDD--VP S--LEIVKDCKV-FWKKLLDAKLMSQRKYDNLTKA--ERGGLTS | 915 |
| WP_050201642 | 847 | IPQAFIKDDSIDNRVLVSSAKNRG-KSDD--VP S--LEIVKDCKV-FWKKLLDAKLMSQRKYDNLTKA--ERGGLTS | 915 |
| WP_050204027 | 847 | VPQAFIKDDSIDNRVLVSSAKNRG-KSDN--VP S--IDIVKARKA-FWKKLLDAKLMSQRKYDNLTKA--ERGGLTS | 915 |
| WP_050881965 | 847 | IPQAFIKDDSIDNRVLVSSAKNRG-KSDD--VP S--LEIVKDCKV-FWKKLLDAKLMSQRKYDNLTKA--ERGGLTS | 915 |
| WP_050886065 | 847 | IPQAFIKDDSIDNRVLVSSAKNRG-KSDD--VP S--LEIVKDCKV-FWKKLLDAKLMSQRKYDNLTKA--ERGGLTS | 915 |
| AHN30376 | 847 | VPQAFIKDDSIDNRVLVSSAKNRG-KSDD--VP S--IDIVKARKA-FWKKLLDAKLISQRKYDNLTKA--ERGGLTP | 915 |
| EAO78426 | 847 | IPQAFIKDDSIDNRVLVSSAKNRG-KSDD--VP S--LEIVKDCKV-FWKKLLDAKLMSQRKYDNLTKA--ERGGLTS | 915 |
| CCW42055 | 847 | IPQAFIKDDSIDNRVLVSSAKNRG-KSDD--VP S--LEIVKDCKV-FWKKLLDAKLMSQRKYDNLTKA--ERGGLTS | 915 |
| WP_003041502 | 841 | IPQAYIKDDSFDNRVLTSSSENRG-KSDN--VP S--IEVVCARKA-DWMRLRKAGLISQRKEDNLTKA--ERGGLTE | 909 |
| WP_037593752 | 842 | IPQAFIKDNSLDNRVLTRSDKNRG-KSDD--VP S--IEVVHEMKS-FWSKLLSVKLITQRKEDNLTKA--ERGGLTE | 910 |
| WP_049516684 | 842 | IPQAFIKDNSLDNRVLTRSDKNRG-KSDD--VP S--IEVVHEMKS-FWSKLLSVKLITQRKEDNLTKA--ERGGLTE | 910 |
| GAD46167 | 841 | IPQAFIKDNSLDNRVLTRSDKNRG-KSDD--VP S--IEVVHEMKS-FWSKLLSVKLITQRKEDNLTKA--ERGGLTE | 909 |
| WP_018363470 | 850 | IPQAFIKDDSIDNRVLTSSAKNRG-KSDD--VP S--LGIVRARKA-EWVRLYKSGLISKRKEDNLTKA--ERGGLTE | 918 |
| WP_003043819 | 851 | VPQSFIKDDSIDNKVLTRSVENRG-KSDN--VP S--EEVVKKMKN-YWRQLLNAKLITQRKEDNLTKA--ERGGLSE | 919 |
| WP_006269658 | 841 | IPQAFIKDNSLDNRVLTRSDKNRG-KSDD--VP S--IEVVHEMKS-FWSKLLSVKLITQRKEDNLTKA--ERGGLTE | 909 |
| WP_048800889 | 841 | IPQAFIKDDSIDNRVLTSSAKNRG-KSDN--VP N--LEVVCDRKA-DWIRLREAGLISQRKEDNLTKA--ERGGLTE | 909 |
| WP_012767106 | 841 | VPQSFIKDDSIDNKILTRSDKNRG-KSDN--VP S--EEVVKKMKN-YWRQLLNAKLITQRKEDNLTKA--ERGGLSE | 909 |
| WP_014612333 | 841 | VPQSFIKDDSIDNKVLTRSDKNRG-KSDN--VP S--EEVVKKMKN-YWRQLLNAKLITQRKEDNLTKA--ERGGLSE | 909 |
| WP_015017095 | 841 | VPQSFIKDDSIDNKVLTRSDKNRG-KSDD--VP S--EEVVKKMKN-YWRQLLNAKLITQRKEDNLTKA--ERGGLSE | 909 |
| WP_015057649 | 841 | VPQSFIKDDSIDNKVLTRSDKNRG-KSDN--VP S--EEVVKKMKN-YWRQLLNAKLITQRKEDNLTKA--ERGGLSE | 909 |
| WP_048327215 | 841 | VPQSFIKDDSIDNKVLTRSDKNRG-KSDD--VP S--EEVVKKMKN-YWRQLLNAKLITQRKEDNLTKA--ERGGLSE | 909 |
| WP_049519324 | 841 | VPQSFIKDDSIDNKVLTRSDKNRG-KSDN--VP S--EEVVKKMKN-YWRQLLNAKLITQRKEDNLTKA--ERGGLSE | 909 |
| WP_012515931 | 841 | IPQSFIKNNSIDNKVLTSQGANRG-KLDN--VP S--EAIVRKMKG-YWQSLLRAGAISKQKEDNLTKA--ERGGLIQ | 909 |
| WP_021320964 | 841 | IPQSFIKNNSIDNKVLTSQGANRG-KLDN--VP S--EAIVRKMKG-YWQSLLRAGAISKQKEDNLTKA--ERGGLIQ | 909 |
| WP_037581760 | 841 | IPQSFIKNNSIDNKVLTSQGANRG-KLDN--VP S--EAIVRKMKG-YWQSLLRAGAISKQKEDNLTKA--ERGGLIQ | 909 |
| WP_004232481 | 849 | IPQAFIKDNSIDNRVLTSSAKNRG-KSDD--VP S--IEIVRNRKS-YWYKLYKSGLISKRKEDNLTKA--ERGGLTE | 917 |
| WP_009854540 | 850 | IPQAFIKDDSIDNRVLTSSAKNRG-KSDD--VP S--LDIVRARKA-EWVRLYKSGLISKRKEDNLTKA--ERGGLTE | 918 |
| WP_012962174 | 850 | IPQAFIKDDSIDNRVLTSSAKNRG-KSDD--VP S--LDIVHDRKA-DWIRLYKSGLISKRKEDNLTKA--ERGGLTE | 918 |
| WP_039695303 | 852 | IPQAFIKDDSIDNRVLTSSAKNRG-KSDD--VP S--LDIVRARKA-EWVRLYKSGLISKRKEDNLTKA--ERGGLTE | 920 |
| WP_014334983 | 849 | IPQAFIKDNSIDNKVLTSSAKNRG-KSDD--VP S--IEIVRNRRS-YWYKLYKSGLISKRKEDNLTKA--ERGGLTE | 917 |
| WP_003099269 | 842 | IPQSFIKDNSIDNIVLITQASNRG-KSDN--VP N--IETVNKMKS-FWYKQLKSGAISQRKFDHLTKA--ERGALSD | 910 |
| AHY15608 | 842 | IPQSFIKDNSIDNIVLITQASNRG-KSDN--VP N--IETVNKMKS-FWYKQLKSGAISQRKFDHLTKA--ERGALSD | 910 |
| AHY17476 | 842 | IPQSFIKDNSIDNIVLITQASNRG-KSDN--VP N--IETVNKMKS-FWYKQLKSGAISQRKFDHLTKA--ERGALSD | 910 |
| ESR09100 | | -------------------------------- ------------------------------------------- | |
| AGM98575 | 842 | IPQSFIKDNSIDNIVLITQASNRG-KSDN--VP N--IETVNKMKS-FWYKQLKSGAISQRKFDHLTKA--ERGALSD | 910 |
| ALF27331 | 842 | IPQAFIKDNSIDNRVLTSSKENRG-KSDD--VP S--KDVVRKMKS-YWSKLLSAKLITQRKEDNLTKA--ERGGLTD | 910 |
| WP_018372492 | 858 | VPRSYIKNDSFDNKVLITSKGNRK-KLDD--VP A--KEVVEKMEN-TWRRLHAAGLISDIKLSYLMKGe-----LTE | 923 |
| WP_045618028 | 845 | IPQAFIKDDSLDNRVLTSSKDNRG-KSDN--VP S--LEIVQKRKA-FWQQLLDSKLISERKENNLTKA--ERGGLDE | 913 |
| WP_045635197 | 844 | IPQAFIKDDSLDNRVLTSSKDNRG-KSDN--VP S--IEVVQKRKA-FWQQLLDSKLISERKENNLTKA--ERGGLDE | 912 |
| WP_002263549 | 842 | IPQAFIKDNSIDNRVLTSSKENRG-KSDD--VP S--KDVVRKMKS-YWSKLLSAKLITQRKEDNLTKA--ERGGLTD | 910 |
| WP_002263887 | 842 | IPQAFIKDNSIDNRVLTSSKENRG-KSDD--VP S--KDVVRKMKS-YWSKLLSAKLITQRKEDNLTKA--ERGGLTD | 910 |
| WP_002264920 | 842 | IPQAFIKDNSIDNRVLTSSKENRG-KSDD--VP S--KDVVRKMKS-YWSKLLSAKLITQRKEDNLTKG--ERGGLTD | 910 |
| WP_002269043 | 842 | IPQAFIKDNSIDNRVLTSSKENRG-KSDD--VP S--KDVVRKMKS-YWSKLLSAKLITQRKEDNLTKA--ERGGLTD | 910 |
| WP_002269448 | 842 | IPQAFIKDNSIDNRVLTSSKENRG-KSDD--VP S--EDVVRKMKS-YWSKLLSAKLITQRKEDNLTKA--ERGGLTD | 910 |
| WP_002271977 | 842 | IPQAFIKDNSIDNRVLTSSKENRG-KSDD--VP S--KDVVRKMKS-YWSKLLSAKLITQRKEDNLTKA--ERGGLTD | 910 |

-continued

| | | | |
|---|---|---|---|
| WP_002272766 | 842 | IPQAFIKDNSIDNRVLTSSKENRG-KSDD--VP S--KDVVRKMKP-YWSKLLSAKLITQRKEDNLTKA--ERGGLTD | 910 |
| WP_002273241 | 842 | IPQAFIKDNSIDNRVLTSSKENRG-KSDD--VP S--KDVVRKMKS-YWSKLLSAKLITQRKEDNLTKA--ERGGLTD | 910 |
| WP_002275430 | 842 | IPQAFIKDNSIDNRVLTSSKENRG-KSDD--VP S--KDVVRKMKP-YWSKLLSAKLITQRKEDNLTKA--ERGGLTD | 910 |
| WP_002276448 | 842 | IPQAFIKDNSIDNRVLTSSKENRG-KSDD--VP S--KDVVRKMKS-YWSKLLSAKLITQRKEDNLTKA--ERGGLTD | 910 |
| WP_002277050 | 847 | IPQAFIKDNSIDNRVLTSSKANRG-KSDD--VP S--EDVVNRMRP-FWNKLLSSGLISQRKYNNLTKK--E---LTP | 912 |
| WP_002277364 | 842 | IPQAFIKDNSIDNRVLTSSKENRG-KSDD--VP S--KNVVRKMKS-YWSKLLSAKLITQRKEDNLTKA--ERGGLTD | 910 |
| WP_002279025 | 842 | IPQAFIKDNSIDNRVLTSSKENRG-KSDD--VP S--KDVVRKMKP-YWSKLLSAKLITQRKEDNLTKA--ERGGLTD | 910 |
| WP_002279859 | 842 | IPQAFIKDNSIDNRVLTSSKENRG-KSDD--VP S--KDVVRKMKS-YWSKLLSAKLITQRKEDNLTKG--ERGGLTD | 910 |
| WP_002280230 | 842 | IPQAFIKDNSIDNRVLTSSKENRG-KSDD--VP S--KDVVRKMKS-YWSKLLSAKLITQRKEDNLTKA--ERGGLTD | 910 |
| WP_002281696 | 842 | IPQAFIKDNSIDNRVLTSSKENRG-KSDD--VP S--KNVVRKMKS-YWSKLLSAKLITQRKEDNLTKA--ERGGLTD | 910 |
| WP_002282247 | 847 | IPQAFIKDNSIDNRVLTSSKANRG-KSDD--VP S--EDVVNRMRP-FWNKLLSSGLISQRKYNNLTKK--E---LTL | 912 |
| WP_002282906 | 842 | IPQAFIKDNSIDNRVLTSSKENRG-KSDD--VP S--KDVVRKMKS-YWSKLLSAKLITQRKEDNLTKA--ERGGLTD | 910 |
| WP_002283846 | 842 | IPQAFIKDNSIDNRVLTSSKENRG-KSDD--VP S--KNVVRKMKS-YWSKLLSAKLITQRKEDNLTKA--ERGGLTD | 910 |
| WP_002287255 | 842 | IPQAFIKDNSIDNRVLTSSKENRG-KSDD--VP S--KNVVRKMKS-YWSKLLSAKLITQRKEDNLTKA--ERGGLTD | 910 |
| WP_002288990 | 842 | IPQAFIKDNSIDNRVLTSSKENRG-KSDD--VP S--KDVVRKMKS-YWSKLLSAKLITQRKEDNLTKA--ERGGLTD | 910 |
| WP_002289641 | 842 | IPQAFIKDNSIDNRVLTSSKENRG-KSDD--VP S--KDVVRKMKS-YWSKLLSAKLITQRKEDNLTKA--ERGGLTD | 910 |
| WP_002290427 | 842 | IPQAFIKDNSIDNRVLTSSKENRG-KSDD--VP S--KDVVRKMKS-YWSKLLSAKLITQRKEDNLTKG--ERGGLTD | 910 |
| WP_002295753 | 842 | IPQAFIKDNSIDNRVLTSSKENRG-KSDD--VP S--KDVVRKMKS-YWSKLLSAKLITQRKEDNLTKA--ERGGLTD | 910 |
| WP_002296423 | 842 | IPQAFIKDNSIDNRVLTSSKENRG-KSDD--VP S--KNVVRKMKS-YWSKLLSAKLITQRKEDNLTKA--ERGGLTD | 910 |
| WP_002304487 | 856 | IPQAFIKDNSIDNRVLTRSDKNRG-KSDD--VP S--EEVVHKMKP-FWSKLLSAKLITQRKEDNLTKA--ERGGLTD | 924 |
| WP_002305844 | 842 | IPQAFIKDNSIDNRVLTSSKENRG-KSDD--VP S--KDVVRKMKS-YWSKLLSAKLITQRKEDNLTKA--ERGGLTD | 910 |
| WP_002307203 | 842 | IPQAFIKDNSIDNRVLTSSKENRG-KSDD--VP S--KDVVRKMKS-YWSKLLSAKLITQRKEDNLTKA--ERGGLTD | 910 |
| WP_002310390 | 842 | IPQAFIKDNSIDNRVLTSSKENRG-KSDD--VP S--KDVVRKMKS-YWSKLLSAKLITQRKEDNLTKG--ERGGLTD | 910 |
| WP_002352408 | 842 | IPQAFIKDNSIDNRVLTSSKENRG-KSDD--VP S--KDVVRKMKS-YWSKLLSAKLITQRKEDNLTKA--ERGGLTD | 910 |
| WP_012997688 | 842 | IPQAFIKDNSIDNRVLTSSKENRG-KSDD--VP S--KNVVRKMKS-YWSKLLSAKLITQRKEDNLTKA--ERGGLTD | 910 |
| WP_014677909 | 842 | IPQAFIKDNSIDNRVLTSSKENRG-KSDD--VP S--KDVVRKMKS-YWSKLLSAKLITQRKEDNLTKA--ERGGLTD | 910 |
| WP_019312892 | 842 | IPQAFIKDNSIDNRVLTSSKENRG-KSDD--VP S--KNVVRKMKS-YWSKLLSAKLITQRKEDNLTKA--ERGGLTD | 910 |
| WP_019313659 | 842 | IPQAFIKDNSIDNRVLTSSKENRG-KSDD--VP S--KDVVRKMKS-YWSKLLSAKLITQRKEDNLTKA--ERGGLTD | 910 |
| WP_019314093 | 842 | IPQAFIKDNSIDNRVLTSSKENRG-KSDD--VP S--KDVVRKMKS-YWSKLLSAKLITQRKEDNLTKA--ERGGLTD | 910 |
| WP_019315370 | 842 | IPQAFIKDNSIDNRVLTSSKENRG-KSDD--VP S--KDVVRKMKP-YWSKLLSAKLITQRKEDNLTKA--ERGGLTD | 910 |
| WP_019803776 | 842 | IPQAFIKDNSIDNRVLTSSKENRG-KSDD--VP S--KDVVRKMKS-YWSKLLSAKLITQRKEDNLTKA--ERGGLTD | 910 |
| WP_019805234 | 842 | IPQAFIKDNSIDNRVLTSSKENRG-KSDD--VP S--KDVVRKMKS-YWSKLLSAKLITQRKEDNLTKG--ERGGLTD | 910 |
| WP_024783594 | 842 | IPQAFIKDNSIDNRVLTSSKENRG-KSDD--VP S--KDVVRKMKS-YWSKLLSAKLITQRKEDNLTKA--ERGGLTD | 910 |
| WP_024784288 | 847 | IPQAFIKDNSIDNRVLTSSKANRG-KSDD--VP S--EDVVNRMRP-FWNKLLSSGLISQRKYNNLTKK--E---LTL | 912 |
| WP_024784666 | 842 | IPQAFIKDNSIDNRVLTSSKENRG-KSDD--VP S--KNVVRKMKS-YWSKLLSAKLITQRKEDNLTKA--ERGGLTD | 910 |
| WP_024784894 | 842 | IPQAFIKDNSIDNRVLTSSKENRG-KSDD--VP S--KDVVRKMKS-YWSKLLSAKLITQRKEDNLTKA--ERGGLTD | 910 |
| WP_024786433 | 847 | IPQAFIKDNSIDNRVLTSSKANRG-KSDD--VP S--EDVVNRMRP-FWNKLLSSGLISQRKYNNLTKK--E---LTL | 912 |
| WP_049473442 | 842 | IPQAFIKDNSIDNRVLISSKENRG-KSDD--VP S--KDVVRKMKP-YWSKLLSAKLITQRKFDNLTKA--ERGGLTD | 910 |
| WP_049474547 | 842 | IPQAFIKDNSIDNRVLISSKENRG-KSDD--VP S--KDVVRKMKS-YWSKLLSAKLITQRKFDNLTKA--ERGGLTD | 910 |
| EMC03581 | 835 | IPQAFIKDNSIDNRVLISSKENRG-KSDD--VP S--KNVVRKMKS-YWSKLLSAKLITQRKFDNLTKA--ERGGLTD | 903 |
| WP_000428612 | 847 | VPQAFIKDDSLDNRVLISLKDNRG-KSDN--VP S--LEVVEKMKT-FWQQLLDSKLISYRKFNNLTKA--ERGGLDE | 915 |
| WP_000428613 | 845 | VPQAFIKDDSLDNRVLISLKDNRG-KSDN--VP S--IEVVQKRKA-FWQQLLDSKLISERKFNNLTKA--ERGGLDE | 913 |
| WP_049523028 | 840 | IPQAFIKDDSLDNRVLISSKDNRG-KSDN--VP S--LEIVEKMKG-FWQQLLDSKLISERKFNNLTKA--ERGGLDE | 908 |
| WP_003107102 | 811 | IPQSFIKDNSIDNIVLISQESNRG-KSDN--VP Y--IAIVNKMKS-YWQHQLKSGAISQRKFDNLTKA--ERGGLSE | 879 |
| WP_054279288 | 843 | IPRSFIKDDSIDNKVLIRSEHNRG-KIDN--VP S--IEVVKRMKP-YWQKLLDTKVISQRKEDNLTKA--ERGGLQE | 911 |
| WP_049531101 | 845 | IPQAFIKDDSLDNRVLISSKDNRG-KSDN--VP S--LEVVQKRKA-FWQQLLESKLISERKFNNLTKA--ERGGLNE | 913 |
| WP_049538452 | 845 | IPQAFIKDDSLDNRVLISSKENRG-KSDN--VP C--LEVVDKMKV-FWQQLLDFKLISYRKFNNLTKA--ERGGLDE | 913 |
| WP_049549711 | 845 | IPQAFIKDDSLDNRVLISSKDNRG-KSDN--VP S--LEVVQKRKA-FWQQLLDSKLISERKFNNLTKAerERDGLNE | 915 |
| WP_007896501 | 847 | IPQSFIKDNSIDNLVLITQKANRG-KSDN--VP S--IEVVRDMKDrVWRRQLANGAISRQKFDHLTKA--ERGGLAD | 916 |
| EFR44625 | 799 | IPQSFIKDNSIDNLVLITQKANRG-KSDN--VP S--IEVVRDMKDrVWRRQLANGAISRQKFDHLTKA--ERGGLAD | 868 |
| WP_002897477 | 844 | IPQAFIKDDSIDNRVLISSKDNRG-KSDN--VP S--LEVVQKRKA-FWQQLLDSKLISERKFNNLTKA--ERGGLDE | 912 |
| WP_002906454 | 844 | IPQAFIKDDSLDNRVLISSKDNRG-KSDN--VP S--IEVVQKRKA-FWQQLLDSKLISERKFNNLTKA--KRGGLDE | 912 |
| WP_009729476 | 845 | IPQAFIKDDSLDNRVLISSKDNRG-KSDN--VP S--LEVVDKMKV-FWQQLLDSKLISYRKFNNLTKA--ERGGLNE | 913 |

```
-continued

CQR24647            844  IPQSFIKDNSLDNRVLINSKSNRG-KSDN--VP  S---NEVVKRMKG-FWLKQLDAKLISQRKEDNLTKA--FWLKQLDAKLISQRKEDNLTKA--ERGGLSA         912
WP_000066813        847  IPQAFIKDDSLDNRVLIISSKDNRG-KSDN--VP  S---LEVVEKMKA-FWQQLLDSKLISERKFNNLTKAerERGGLNE                                   917
WP_009754323        845  IPQAFIKDDSLDNRVLIISSKDNRG-KSDN--VP  S---LEVVKKRKA-FWQQLLDSKLISERKFNNLTKA--ERGGLDE                                   913
WP_044674937        844  IPQAFIKDDSLDNKVLIKSAKNRG-KSDD--VP  S---LEIVHKKKN-FWKQLLDSQLISQRKFDNLTKA--ERGGLTN                                   912
WP_044676715        846  IPQAFIKDDSLDNKVLIKSAKNRG-KSDD--VP  S---LEIVHKKKN-FWKQLLDSQLISQRKFDNLTKA--ERGGLTN                                   914
WP_044680361        846  IPQAFIKDDSLDNKVLIKSAKNRG-KSDD--VP  S---LEIVHKKKN-FWKQLLDSQLISQRKFDNLTKA--ERGGLTN                                   914
WP_044681799        844  IPQAFIKDDSLDNKVLIKSAKNRG-KSDD--VP  S---LEIVHKKKN-FWKQLLDSQLISQRKFDNLTKA--ERGGLTN                                   912
WP_049533112        841  IPQAFIKDDSFDNRVLISSSENRG-KSDN--VP  S---IEVVRARKA-DWMRLRKAGLISQRKEDNLTKA--ERGGLTE                                   909
WP_029090905        824  LPQSYIKDNSIENLALVKKVENQR-KLDD1VVP  S---SIINQNYS-RWEQLKNAGLIGEKKFRNLTRTK----ITD                                     890
WP_006506696        850  VPQSLVKDDSEDNRVLVVPSENQR-KLDD1VVP  ---FDIRDKMYR-FWKLLFDHELISPKKFYSLTKTe---YTE                                      916
AIT42264            842  VPQSFLKDDSLDNRVLIRSDKNRG-KSDN--VP  S---KEVVKKMKN-YWRQLLNAKLITQRKFDNLTKA--ERGGLSE                                   910
WP_034440723        849  IPRSFITDNSFDNLVLISSIVNRG-KLDN--VP  Sp--DIVRQQKG-FWKQLLRAGLMSQRKENNLTKGr---LTD                                      914
AKQ21048            842  VPQSFLKDDSIDNKVLIRSDKNRG-KSDN--VP  S---EEVVKKMKN-YWRQLLNAKLITQRKFDNLTKA--ERGGLSE                                   910
WP_004636532        846  IPQSFTIDNSIDNKVLVSRTKNOgnKSDD--VP  S---INIVHKMKP-FWRQLHKAGLISDRKFKNLTKA--EHGGLTE                                   915
WP_002364836        853  IPQSFMKDDSLDNILVLVGSTENRG-KSDD--VP  S---KEVVKDMKA-YWEKLYAAGLISQRKFQRLTKG--EQGGLTL                                  921
WP_016631044        804  IPQSFMKDDSLDNILVLVGSTENRG-KSDD--VP  S---KEVVKDMKA-YWEKLYAAGLISQRKFQRLTKG--EQGGLTL                                  872
EMS75795            589  IPRSFIVDNSIDNKVLVSSKENRL-KMDD--VP  D---QKVVIRMRR-YWEKLLRANLISERKFAYLTKAg--LTP                                      654
WP_002373311        853  IPQSFMKDDSLDNILVLVGSTENRG-KSDD--VP  S---KEVVKKMKA-YWEKLYAAGLISQRKFQRLTKG--EQGGLTL                                  921
WP_002378009        853  IPQSFMKDDSLDNILVLVGSTENRG-KSDD--VP  S---KEVVKDMKA-YWEKLYAAGLISQRKFQRLTKG--EQGGLTL                                  921
WP_002407324        853  IPQSFMKDDSLDNILVLVGSTENRG-KSDD--VP  S---KEVVKDMKA-YWEKLYAAGLISQRKFQRLTKG--EQGGLTL                                  921
WP_002413717        855  IPQSFMKDDSLDNILVLVGSTENRG-KSDD--VP  S---KEVVKDMKA-YWEKLYAAGLISQRKFQRLTKG--EQGGLTL                                  923
WP_010775580        853  IPQSFMKDDSLDNILVLVGSTENRG-KSDD--VP  S---KEVVKDMKA-YWEKLYAAGLISQRKFQRLTKG--EQGGLTL                                  921
WP_010818269        853  IPQSFMKDDSLDNILVLVGSTENRG-KSDD--VP  S---KEVVKDMKA-YWEKLYAAGLISQRKFQRLTKG--EQGGLTL                                  921
WP_016622645        853  IPQSFMKDDSLDNILVLVGSTENRG-KSDD--VP  S---KEVVKDMKA-YWEKLYAAGLISQRKFQRLTKG--EQGGLTL                                  921
WP_033624816        853  IPQSFMKDDSLDNILVLVGSTENRG-KSDD--VP  S---KEVVKKMKA-YWEKLYAAGLISQRKFQRLTKG--EQGGLTL                                  921
WP_002625576        853  IPQSFMKDDSLDNILVLVGSTENRG-KSDD--VP  S---KEVVKDMKA-YWEKLYAAGLISQRKFQRLTKG--EQGGLTL                                  921
WP_033789179        853  IPQSFMKDDSLDNILVLVGSTENRG-KSDD--VP  S---KEVVKDMKA-YWEKLYAAGLISQRKFQRLTKG--EQGGLTL                                  921
WP_002310644        854  IPRSFITDNSIDNKVLVSSKENRL-KKDD--VP  S---EKVVKKMRS-FWYDLYSSKLISKRKLDNLTKIk------LTE                                  918
WP_002312694        854  IPRSFITDNSIDNKVLVSSKENRL-KKDD--VP  S---EKVVKKMRS-FWYDLYSSKLISKRKLDNLTKIk------LTE                                  919
WP_002314015        854  IPRSFITDNSIDNKVLVSSKENRL-KKDD--VP  S---EKVVKKMRS-FWYDLYSSKLISKRKLDNLTKIk------LTE                                  919
WP_002320716        853  IPRSFITDNSIDNKVLVSSKENRL-KKDD--VP  S---EKVVKKMRS-FWYDLYSSKLISKRKLDNLTKIk------LTE                                  919
WP_047937432        854  IPRSFITDNSIDNKVLVSSKENRL-KKDD--VP  S---EKVVKKMRS-FWYDLYSSKLISKRKLDNLTKIk------LTE                                  919
WP_002330729        853  IPRSFTIDNSIDNKVLVSSKENRL-KKDD--VP  S---EKVVKKMRS-FWYDLYSSKLISKRKLDNLTKIk------LTE                                  918
WP_002335161        854  IPRSFTIDNSIDNKVLVSSKENRL-KKDD--VP  S---EKVVKKMRS-FWYDLYSSKLISKRKLDNLTKIk------LTE                                  919
WP_002345439        854  IPRSFTIDNSIDDKVLVASKQNQK-KRDD--VP  K---KQIVNEQRI-FWNQLKEAKLISTKKYAYLTKIe------LTP                                  919
WP_034867970        854  IPRSFTIDNSIDDKVLVASKQNQK-KRDD--VP  K---KQIVNEQRI-FWNQLKEAKLISPKKYAYLTKIe------LTP                                  919
WP_010720994        845  IPRSFTIDNSIDNKVLVASKQNQK-KRDD--VP  K---KQIVNEQRI-FWNQLKEAKLISPKKYAYLTKIe------LTP                                  910
WP_010737004        845  IPRSFIVDNSIDNKVLVASKQNQK-KRDD--VP  K---KQIVNEQRI-FWNQLKEAKLISPKKYAYLTKIe------LTP                                  910
WP_034700478        845  IPRSFIVDNSIDNKVLVASKQNQK-KRDD--VP  N---KQIVNEQRI-FWNQLKEAKLISPKKYAYLTKIe------LTP                                  910
WP_072090903        846  IPQSFLIDNSIDNKVLITSKSNRG-KSDN--VP  S---EEVVKRKMDR-FWRKLLNAKLISERKYTNLTKKe------LTE                                 911
WP_023519017        839  IPRSFIVDNSLDNKVLITSKSNRG-KLDN--AP  D---PLVVKRMRS-HWEKLHQAKLISDKKLANLITKQn-----LTE                                  904
WP_010770040        846  VPQSFTIDNSILDDKVLVLSENKQR-KKDD--VP  S---KEVVQKNIT-LWETLKNSNLISQKKYDNLTKG---LRGGLTE                                  914
WP_048604708        843  VPQSLLKDDSIDNKVLVLSSENQR-KLDD--VP  ---SSIRNKMYG-FWEKLENNKIISPKKFYSLIKTe----ESGGLSE                                  911
KDA45870            848  IPQSFLKDDSIENKVLTIKKENVR-KTNG--LP  ---EAVIQKMGS-FWKKLLDAGAMTNKKYDNLRRN1--HGGLNE                                    913
WP_010750235        881  VPQSFITDDHSLDNKVLVSSKENRL-KKDD--VP  D---SKVVKRMKA-YWEKLLRANLISERKESYLIKLe-----LTD                                  949
AII16583            861  LPRTYIPDDSLENKALVLAKENQR-KADDILLN  S---NVIDKNLE-RWTYMLNNNMGLKKEKNLTRRv-----ITD                                     927
WP_029073316        861  LPRTYIPDDSLENKALVLAKENQR-KADDILLN  S---NVIDKNLE-RWTYMLNNNMGLKKEKNLTRRv-----ITD                                     927
WP_031589969        834  IPQSFLKDDSLDNKVLVLSSENQR-KLDD1VIP  ---SSIRNKMYG-FWEKLENNKIISPKKFYSLIKTe----FNE                                     902
WP_039099354        857  IPQSFITDNSIDNLVLISSAGNRE-KGDD--VP  S---VELGQKMQI-QWEQMLRAGLITKKKYDNLTLNp-------                                     923
AKP02966            859  IPRTYIPDDSLENKALVLAKENQR-KADDILLN  S---NVIDKNLE-RWTYMLNNNMGLKKEKNLTRRv-----ITD                                     925
WP_010991369        845  VPQSFITDNSIDNLVLISSAGNRE-KGDD--VP  P---LEIVRKKV-FWEKLYQGNLMSKRKFDYLTKA--ERGGLTE                                   913
WP_033838504        845  VPQSFITDNSIDNLVLISSAGNRE-KGDD--VP  P---LEIVRRKV-FWEKLYQGNLMSKRKFDYLTKA--ERGGLTE                                   913
```

| | | | |
|---|---|---|---|
| EHN60060 | 848 | VPQSFITDNSIDNLVLISSAGNRE-KGDD--VP P--LEIVRKRKV-FWEKLYQGNLMSKRKFDYLTKA--ERGGLTE | 916 |
| EFR89594 | 614 | VPQSFITDNSIDNLVLISSAGNRE-KGND--VP P--LEIVQKRRV-FWEKLYQGNLMSKRKFDYLTKA--ERGGLTE | 682 |
| WP_038409211 | 845 | IPQSFITDNSIDNRVLVSSTANRE-KGDN--VP L--LEVVRKRKA-FWEKLYQAKLMSKRKFDYLTKA--ERGGLTE | 913 |
| EFR95520 | 464 | IPQSFITDNSIDNRVLVSSTANRE-KGDN--VP L--LEVVRKRKA-FWEKLYQAKLMSKRKFDYLTKA--ERGGLTE | 532 |
| WP_003723650 | 845 | VPQSFITDNSIDNLVLISSAGNRE-KGGD--VP P--LEIVRKRKV-FWEKLYQGNLMSKRKFDYLTKA--ERGGLTE | 913 |
| WP_003727705 | 845 | VPQSFITDNSIDNLVLISSAGNRE-KGGD--VP P--LEIVRKRKV-FWEKLYQGNLMSKRKFDYLTKA--ERGGLTE | 913 |
| WP_003730785 | 845 | VPQSFITDNSIDNLVLISSAGNRE-KGGD--VP P--LEIVRKRKV-FWEKLYQGNLMSKRKFDYLTKA--ERGGLTE | 913 |
| WP_003733029 | 845 | VPQSFITDNSVDNLVLISSAGNRE-KGDN--VP P--LEIVQKRKI-FWEKLYQGNLMSKRKFDYLTKA--ERGGLTE | 913 |
| WP_003739838 | 845 | VPQSFITDNSIDNLVLISSAGNRE-KGDD--VP P--LEIVRKRKV-FWEKLYQGNLMSKRKFDYLTKA--ERGGLTE | 913 |
| WP_014601172 | 845 | VPQSFITDNSIDNLVLTSSAGNRE-KGGD--VP P--LEIVQKRRI-FWEKLYQGNLMSKRKFDYLTKA--ERGGLTD | 913 |
| WP_023548323 | 845 | VPQSFITDNSIDNLVLTSSAGNRE-KGDN--VP P--LEIVQKRKI-FWEKLYQGNLMSKRKFDYLTKA--ERGGLTE | 913 |
| WP_031665337 | 845 | VPQSFITDNSIDNLVLTSSAGNRE-KGGD--VP P--LEIVRKRKV-FWEKLYQGNLMSKRKFDYLTKA--ERGGLTE | 913 |
| WP_031669209 | 845 | VPQSFITDNSVDNLVLTSSAGNRE-KGDN--VP P--LEIVQKRKI-FWEKLYQGNLMSKRKFDYLTKA--ERGGLTE | 913 |
| WP_033920898 | 845 | VPQSFITDNSIDNLVLTSSAGNRE-KGGD--VP P--LEIVQKRKI-FWEKLYQGNLMSKRKFDYLTKA--ERGGLTE | 913 |
| AKI42028 | 848 | VPQSFITDNSIDNLVLTSSAGNRE-KGDD--VP P--LEIVRKRKV-FWEKLYQGNLMSKRKFDYLTKA--ERGGLTD | 916 |
| AKI50529 | 848 | VPQSFITDNSIDNLVLTSSAGNRE-KGDN--VP P--LEIVQKRKI-FWEKLYQGNLMSKRKFDYLTKA--ERGGLTE | 916 |
| EFR83390 | 293 | VPQSFITDNSIDNRVLASSAANRE-KGDN--VP S--LEVVRKRKV-YWEKLYQAKLMSKRKFDYLTKA--ERGGLTE | 361 |
| WP_046323366 | 845 | VPQSFLKDDSIDNKVLTRSDKNRG-KSDN--VP S--EEVVKKMKN-YWRQLLNAKLITQRKFDNLTKA--ERGGLSE | 913 |
| AKE81011 | 858 | VPQSFLKDDSIDNKVLTRSDKNRG-KSDN--VP S--EEVVKKMKN-YWRQLLNAKLITQRKFDNLTKA--ERGGLSE | 926 |
| CUO82355 | 854 | VPQSLVKDDSEDNRVLVLPSENQR-KLDDlvVP --FDIRDKMYR-FWKLLFDHELISPKKFYSLIKTe----YTE | 920 |
| WP_033162887 | 856 | LPQSLIKDDSFDNRVLVLPEENQW-KLDSetVP --FEIRNKMIG-FWQMLHENGLMSNKKFSLIRTd-----FSD | 922 |
| AGZ01981 | 875 | VPQSFLKDDSIDNKVLTRSDKNRG-KSDN--VP S--EEVVKKMKN-YWRQLLNAKLITQRKFDNLTKA--ERGGLSE | 943 |
| AKA60242 | 842 | VPQSFLKDDSIDNKVLTRSDKNRG-KSDN--VP S--EEVVKKMKN-YWRQLLNAKLITQRKFDNLTKA--ERGGLSE | 910 |
| AKS40380 | 842 | VPQSFLKDDSIDNKVLTRSDKNRG-KSDN--VP S--EEVVKKMKN-YWRQLLNAKLITQRKFDNLTKA--ERGGLSE | 910 |
| 4UN5_B | 846 | VPQSFLKDDSIDNKVLTRSDKNRG-KSDN--VP S--EEVVKKMKN-YWRQLLNAKLITQRKFDNLTKA--ERGGLSE | 914 |
| WP_010922251 | 911 | LD KAGFIKRQLVETRQITKHVAQILDSRMNTKYDENDKLIR--EVKVITLKSKLVSDFRKDF QFYKVREINNY | 981 |
| WP_039695303 | 921 | AD KAGFIKRQLVETRQITKHVAQILDARPNTEHDENDKVIR--DVKVITLKSNLVSQFRKDF EFYKVREINDY | 991 |
| WP_045635197 | 913 | RD KVGFIKRQLVETRQITKHVAQILDARYNTEVNEKDKKQNR--TVKIITLKSKLVSNFRKEF RLYKVREINDY | 983 |
| 5AXW_A | 633 | RD QKDFINRNLVDTRYATRGLMNLLRSYFR--------VNnlDVKVKSINGGFTSFLRRKW KFKKERNKGYK | 702 |
| WP_009880683 | 595 | LD KAGFIKRQLVETRQITKHVAQILDSRMNIKYDENDKLIR--EVRVITLKSKLVSDFRKDF QFYKVREINNY | 665 |
| WP_010922251 | 911 | LD KAGFIKRQLVETRQITKHVAQILDSRMNIKYDENDKLIR--EVRVITLKSKLVSDFRKDF QFYKVREINNY | 981 |
| WP_011054416 | 911 | LD KVGFIKRQLVETRQITKHVAQILDSRMNIKYDENDKLIR--EVRVITLKSKLVSDFRKDF QFYKVREINNY | 981 |
| WP_011284745 | 911 | LD KAGFIKRQLVETRQITKHVAQILDSRMNIKYDENDKLIR--EVRVITLKSKLVSDFRKDF QFYKVREINNY | 981 |
| WP_011285506 | 911 | LD KAGFIKRQLVETRQITKHVAQILDSRMNIKYDENDKLIR--EVRVITLKSKLVSDFRKDF QFYKVREINNY | 981 |
| WP_011527619 | 911 | LD KAGFIKRQLVETRQITKHVAQILDSRMNIKYDENDKLIR--EVRVITLKSKLVSDFRKDF QFYKVREINNY | 981 |
| WP_012560673 | 911 | LD KAGFIKRQLVETRQITKHVAQILDSRMNIKYDENDKLIR--EVRVITLKSKLVSDFRKDF QFYKVREINNY | 981 |
| WP_014407541 | 910 | LD KAGFIKRQLVETRQITKHVAQILDSRMNIKYDENDKLIR--EVRVITLKSKLVSDFRKDF QFYKVREINNY | 980 |
| WP_020905136 | 911 | LD KAGFIKRQLVETRQITKHVAQILDSRMNIKYDENDKLIR--EVRVITLKSKLVSDFRKDF QFYKVREINNY | 981 |
| WP_023080005 | 910 | LD KAGFIKRQLVETRQITKHVAQILDSRMNIKYDENDKLIR--EVRVITLKSKLVSDFRKDF QFYKVREINNY | 980 |
| WP_023610282 | 910 | LD KAGFIKRQLVETRQITKHVAQILDSRMNIKYDENDKLIR--EVRVITLKSKLVSDFRKDF QFYKVREINNY | 980 |
| WP_030125963 | 911 | LD KAGFIKRQLVETRQITKHVAQILDSRMNIKYDENDKLIR--EVRVITLKSKLVSDFRKDF QFYKVREINNY | 981 |
| WP_030126706 | 911 | LD KAGFIKRQLVETRQITKHVAQILDSRMNIKYDENDKLIR--EVRVITLKSKLVSDFRKDF QFYKVREINNY | 981 |
| WP_031488318 | 911 | LD KAGFIKRQLVETRQITKHVAQILDSRMNIKYDENDKLIR--EVRVITLKSKLVSDFRKDF QFYKVREINNY | 981 |
| WP_032460140 | 911 | LD KAGFIKRQLVETRQITKHVAQILDSRMNIKYDENDKLIR--EVRVITLKSKLVSDFRKDF QFYKVREINNY | 981 |
| WP_032461047 | 911 | LD KAGFIKRQLVETRQITKHVAQILDSRMNIKYDENDKLIR--EVRVITLKSKLVSDFRKDF QFYKVREINNY | 981 |
| WP_032462016 | 911 | LD KAGFIKRQLVETRQITKHVAQILDSRMNIKYDENDKLIR--EVRVITLKSKLVSDFRKDF QFYKVREINNY | 981 |
| WP_032462936 | 911 | LD KAGFIKRQLVETRQITKHVAQILDSRMNIKYDENDKLIR--EVRVITLKSKLVSDFRKDF QFYKVREINNY | 981 |
| WP_032464890 | 911 | LD KAGFIKRQLVETRQITKHVAQILDSRMNIKYDENDKLIR--EVRVITLKSKLVSDFRKDF QFYKVREINNY | 981 |
| WP_033888930 | 736 | LD KAGFIKRQLVETRQITKHVAQILDSRMNIKYDENDKLIR--EVRVITLKSKLVSDFRKDF QFYKVREINNY | 806 |
| WP_038431314 | 911 | LD KAGFIKRQLVETRQITKHVAQILDSRMNIKYDENDKLIR--EVRVITLKSKLVSDFRKDF QFYKVREINNY | 981 |
| WP_038432938 | 910 | LD KAGFIKRQLVETRQITKHVAQILDSRMNIKYDENDKLIR--EVRVITLKSKLVSDFRKDF QFYKVREINNY | 980 |
| WP_038434062 | 911 | LD KAGFIKRQLVETRQITKHVAQILDSRMNIKYDENDKLIR--EVRVITLKSKLVSDFRKDF QFYKVREINNY | 981 |

```
BAQ51233        822 LD KAGFIKRQLVETRQITKHVAQILDSRMNIKYDENDKLIR--EVKVITLKSKLVSDFRKDF QFYKVREINNY 892
KGE60162         86 LD KVGFIKRQLVETRQITKHVAQILDSRMNIKYDENDKLIR--EVRVITLKSKLVSDFRKDF QFYKVREINNY 156
KGE60856            -- ------------------------------------------------------------ ----------- 
WP_002989955    911 LD KAGFIKRQLVETRQITKHVAQILDERFNIEFPDGNKRRIR--EVKVITLKSNLVSNFPRKEF ELYKIREINDY 981
WP_003030002    910 ED KAGFIKRQLVETRQITKHVAQILDERFNIEFPDGNKRRIR--NVKIITLKSNLVSNFPRKEF ELYKIREINDY 980
WP_003065552    921 AD KAGFIQRQLVETRQITKHVARILDARPNTESDENDKVIR--DVKVITLKSNLVSQPRKDF EFYKVREINDY 991
WP_001040076    916 DD KARFIQRQLVETRQITKHVARILDERFNNELDSKGRRIR--KVKIVTLKSNLVSNFPRKEF VFYKIREVNNY 986
WP_001040078    916 DD KARFIQRQLVETRQITKHVARILDERFNNELDSKGRRIR--KVKIVTLKSNLVSNFPRKEF GFYKIREVNNY 986
WP_001040080    916 DD KARFIQRQLVETRQITKHVARILDERFNNELDSKGRRIR--KVKIVTLKSNLVSNFPRKEF GFYKIREVNNY 986
WP_001040081    916 DD KARFIQRQLVETRQITKHVARILDERFNNELDSKGRRIR--KVKIVTLKSNLVSNFPRKEF GFYKIREVNNY 986
WP_001040083    916 DD KARFIQRQLVETRQITKHVARILDERFNNELDSKGRRIR--KVKIVTLKSNLVSNFPRKEF GFYKIREVNNY 986
WP_001040085    916 DD KARFIQRQLVETRQITKHVARILDERFNNELDSKGRRIR--KVKIVTLKSNLVSNFPRKEF GFYKIREVNNY 986
WP_001040087    916 DD KARFIQRQLVETRQITKHVARILDERFNNELDSKGRRIR--KVKIVTLKSNLVSNFPRKEF GFYKIREVNNY 986
WP_001040088    916 DD KARFIQRQLVETRQITKHVARILDERFNNELDSKGRRIR--KVKIVTLKSNLVSNFPRKEF GFYKIREVNNY 986
WP_001040089    916 DD KARFIQRQLVETRQITKHVARILDERFNNELDSKGRRIR--KVKIVTLKSNLVSNFPRKEF GFYKIREVNNY 986
WP_001040090    916 DD KARFIQRQLVETRQITKHVARILDERFNNELDSKGRRIR--KVKIVTLKSNLVSNFPRKEF GFYKIREVNNY 986
WP_001040091    916 DD KARFIQRQLVETRQITKHVARILDERFNNELDSKGRRIR--KVKIVTLKSNLVSNFPRKEF GFYKIREVNNY 986
WP_001040092    916 DD KAGFIQRQLVETRQITKHVARILDERFNNELDSKGRRIR--KVKIVTLKSNLVSNFPRKEF GFYKIREVNNY 986
WP_001040094    916 DD KARFIQRQLVETRQITKHVARILDERFNNELDSKGRRIR--KVKIVTLKSNLVSNFPRKEF GFYKIREVNNY 986
WP_001040095    916 DD KARFIQRQLVETRQITKHVARILDERFNNELDSKGRRIR--KVKIVTLKSNLVSNFPRKEF GFYKIREVNNY 986
WP_001040096    916 DD KARFIQRQLVETRQITKHVARILDERFNNELDSKGRRIR--KVKIVTLKSNLVSNFPRKEF GFYKIREVNNY 986
WP_001040097    916 DD KARFIQRQLVETRQITKHVARILDERFNNELDSKGRRIR--KVKIVTLKSNLVSNFPRKEF GFYKIREVNNY 986
WP_001040098    916 DD KARFIQRQLVETRQITKHVARILDERFNNELDSKGRRIR--KVKIVTLKSNLVSNFPRKEF GFYKIREVNNY 986
WP_001040099    916 DD KARFIQRQLVETRQITKHVARILDERFNNELDSKGRRIR--KVKIVTLKSNLVSNFPRKEF GFYKIREVNNY 986
WP_001040100    916 DD KARFIQRQLVETRQITKHVARILDERFNNELDSKGRRIR--KVKIVTLKSNLVSNFPRKEF GFYKIREVNNY 986
WP_001040104    916 DD KARFIQRQLVETRQITKHVARILDERFNNELDSKGRRIR--KVKIVTLKSNLVSNFPRKEF GFYKIREVNDY 986
WP_001040105    916 DD KARFIQRQLVETRQITKHVARILDERFNNELDSKGRRIR--KVKIVTLKSNLVSNFPRKEF GFYKIREVNNY 986
WP_001040106    916 DD KARFIQRQLVETRQITKHVARILDERFNNELDSKGRRIR--KVKIVTLKSNLVSNFPRKEF GFYKIREVNNY 986
WP_001040107    916 DD KARFIQRQLVETRQITKHVARILDERFNNELDSKGRRIR--KVKIVTLKSNLVSNFPRKEF GFYKIREVNNY 986
WP_001040108    916 DD KARFIQRQLVETRQITKHVARILDERFNNELDSKGRRIR--KVKIVTLKSNLVSNFPRKEF GFYKIREVNNY 986
WP_001040109    916 DD KARFIQRQLVETRQITKHVARILDERFNNELDSKGRRIR--KVKIVTLKSNLVSNFPRKEF GFYKIREVNDY 986
WP_001040110    916 DD KARFIQRQLVETRQITKHVARILDERFNNELDSKGRRIR--KVKIVTLKSNLVSNFPRKEF GFYKIREVNNY 986
WP_015058523    916 DD KARFIQRQLVETRQITKHVARILDERFNNKVDDNNKPIR--KVKIVTLKSNLVSNFPRKEF GFYKIREVNNY 986
WP_017643650    916 DD KARFIQRQLVETRQITKHVARILDERFNNELDSKGRRIR--KVKIVTLKSNLVSNFPRKEF GFYKIREVNNY 986
WP_017647151    916 DD KARFIQRQLVETRQITKHVARILDERFNNELDSKGRRIR--KVKIVTLKSNLVSNFPRKEF GFYKIREVNNY 986
WP_017648376    916 DD KARFIQRQLVETRQITKHVARILDERFNNELDSKGRRIR--KVKIVTLKSNLVSNFPRKEF GFYKIREVNNY 986
WP_017649527    916 DD KARFIQRQLVETRQITKHVARILDERFNNELDSKGRRIR--KVKIVTLKSNLVSNFPRKEF GFYKIREVNNY 986
WP_017771611    916 DD KARFIQRQLVETRQITKHVARILDERFNNELDSKGRRIR--KVKIVTLKSNLVSNFPRKEF GFYKIREVNNY 986
WP_017771984    916 DD KARFIQRQLVETRQITKHVARILDERFNNELDSKGRRIR--KVKIVTLKSNLVSNFPRKEF GFYKIREVNNY 986
CFQ25032        916 DD KARFIQRQLVETRQITKHVARILDERFNNELDSKGRRIR--KVKIVTLKSNLVSNFPRKEF GFYKIREVNNY 986
CFV16040        916 DD KARFIQRQLVEIRQITKHVARILDERFNNELDSKGRRIR--KVKIVTLKSNLVSNFPRKEF GFYKIREVNNY 986
KLJ37842        916 DD KARFIQRQLVETRQITKHVARILDELFNNELDSKGRRIR--KVKIVTVLKSNLVSNFPRKEF GFYKIREVNNY 986
KLJ72361        916 DD KARFIQRQLVETRQITKHVARILDERFNNELDSKGRRIR--KVKIVTLKSNLVSNFPRKEF GFYKIREVNNY 986
KLL20707        930 DD KARFIQRQLVETRQITKHVARILDERFNNELDSKGRRIR--KVKIVTLKSNLVSNFPRKEF GFYKIREVNNY 1000
KLL42645        916 DD KARFIQRQLVETRQITKHVARILDERFNNELDSKGRRIR--KVKIVTLKSNLVSNFPRKEF GFYKIREVNNY 986
WP_047207273    916 DD KARFIQRQLVETRQITKHVARILDERFNNELDSKGRRIR--KVKIVTLKSNLVSNFPRKEF GFYKIREVNNY 986
WP_047209694    916 DD KARFIQRQLVETRQITKHVARILDERFNNELDSKGRRIR--KVKIVTLKSNLVSNFPRKEF GFYKIREVNNY 986
WP_050198062    916 DD KARFIQRQLVETRQITKHVARILDERFNNELDSKGRRIR--KVKIVTLKSNLVSNFPRKEF GFYKIREVNNY 986
WP_050201642    916 DD KARFIQRQLVETRQITKHVASILDERFNNELDSKGRRIR--KVKIVTLKSNLVSNFPRKEF GFYKIREVNNY 986
WP_050204027    916 DD KARFIQRQLVETRQITKHVARILDERENNELDSKGRRIR--KVKIVTLKSNLVSNFPRKEF GFYKIREVNNY 986
WP_050881965    916 DD KARFIQRQLVETRQITKHVARILDERFNNELDSKGRRIR--KVKIVTLKSNLVSNFPRKEF GFYKIREVNNY 986
WP_050886065    916 DD KARFIQRQLVETRQITKHVARILDERFNNELDSKGRRIR--KVKIVTLKSNLVSNFPRKEF GFYKIREVNNY 986
AHN30376        916 DD KAGFIQRQLVETRQITKHVARILDERFNNKVDDNNKPIR--KVKIVILKSNLVSNERKPIR GFYKIREVNNY 986
```

| | | | | |
|---|---|---|---|---|
| EAO78426 | 916 | DD KARFIQRQLVETRQIIKHVARILDERENNELDSKGRRIR--KVKIVTLKSNLVSNFRKEF GFYKLREVNNY | 986 |
| CCW42055 | 916 | DD KARFIQRQLVETRQIIKHVARILDERENNELDSKGRRIR--KVKIVTLKSNLVSNFRKEF GFYKLREVNDY | 986 |
| WP_003041502 | 910 | ND KAGFIKRQLVETRQITKHVAQVLDARPNAKHDENKKVIR--DVKIITLKSNLVSQPRKDF KFYKVREINDY | 980 |
| WP_037593752 | 911 | ED KAGFIKRQLVETRQITKHVAQILDERENTEEDGAQRRIR--NVKIITLKSNLVSNERKEF ELYKVREINDY | 981 |
| WP_049516684 | 910 | ED KAGFIKRQLVETRQIIKHVAQILDERENTEEDGAQRRIR--NVKIITLKSNLVSNERKEF ELYKVREINDY | 980 |
| GAD46167 | 919 | LD KAGFIKRQLVETRQIIKHVAQILDERENTERDENDKKVIR--DVKVITLKSNLVSNERKEF KFYKVREINDY | 989 |
| WP_018363470 | 920 | AD KAGFIKRQLVETRQIIKHVAQILDARENTERDENDKKVIR--DVKVITLKSNLVSQFRKEF KFYKVREINDY | 989 |
| WP_003043819 | 920 | AD KAGFIKRQLVETRQITKHVARILDSRMNTKRDNDKPIR--EVKVITLKSKLVSDFRKDF QLYKVRDINNY | 990 |
| WP_006269658 | 910 | ED KAGFIKRQLVETRQIIKHVAQILDERENTEEDGNKPRIR--NVKIITLKSNLVSNERKEF ELYKVREINDY | 980 |
| WP_048800889 | 910 | ND KAGFIKRQLVETRQIIKHVAQILDDARFNPKRDDNKKVIR--DVKVTLKSNLVSQPRRDF KLYKVREINDY | 980 |
| WP_012767106 | 910 | LD KAGFIKRQLVETRQIIKHVAQILDSRMNIKYDENDKLIR--DVKIITLKSNLVSQPRKDF FQYKVREINNY | 980 |
| WP_014612333 | 910 | LD KAGFIKRQLVETRQIIKHVAQILDSRMNIKYDENDKLIR--EVKVITLKSNLVSDFRKDF QFYKVREINDY | 980 |
| WP_015017095 | 910 | LD KAGFIKRQLVETRQIIKHVAQILDSRMNIKYDENDKLIR--EVKVTLKSKLVSDFRKDF QFYKVREINDY | 980 |
| WP_015057649 | 910 | LD KAGFIKRQLVETRQIIKHVAQILDSRMNIKYDENDKLIR--EVKVTLKSKLVSDFRKDF QFYKVREINDY | 980 |
| WP_048327215 | 910 | LD KAGFIKRQLVETRQIIKHVAQILDSRMNIKYDENDKLIR--EVKVITLKSKLVSQFRKDF QFYKVREINDY | 980 |
| WP_049519324 | 910 | LD KAGFIKRQLVETRQIIKHVAQILDSRMNIKYDENDKLIR--EVKVITLKSKLVSDFRKDF QFYKVREINDY | 980 |
| WP_012515931 | 910 | VD KAGFIQRQLVETRQIIKHVAQILDSRENTEFDDHNKKIR--KVHIITLKSKLVSDERKEF GLYKVREINDY | 980 |
| WP_021320964 | 910 | VD KAGFIQRQLVETRQIIKHVAQILDSRENTEFDDHNKKIR--KVHIITLKSKLVSDERKEF GLYKLRDINHY | 980 |
| WP_037581760 | 910 | VD KAGFIQLQLVETRQIIKHVAQILDSRENTEFDDHNKKIR--KVHIITLKSKLVSDERKEF GLYKLRDINHY | 980 |
| WP_004324481 | 918 | TD KAGFIKRQLVETRQIIKHVAQILDARENTKCDENDKVIR--DVKVITLKSSLVSQPRKEF KFYKVREINDY | 988 |
| WP_009854540 | 919 | AD KAGFIKRQLVETRQIIKHVAQILDSRENTEHDENDKVIR--DVKVITLKSNLVSQPRKDF EFYKVREINDY | 989 |
| WP_012962174 | 919 | ND KAGFIKRQLVETRQIIKHVAQILDSRENTERDENDKVIR--NVKVITLKSNLVSQPRKDF KFYKVREINDY | 989 |
| WP_039695303 | 921 | AD KAGFIKRQLVETRQIIKHVAQILDSRENTKRDENDKVIR--DVKVITLKSNLVSNERKEF KFYKVREINDY | 991 |
| WP_034434983 | 918 | AD KAGFIKRQLVETRQIIKHVAQILDSRENSNLTEDSKSNR--NVKIITLKSKMVSDERKDF GFYKLREVNDY | 988 |
| WP_003099269 | 911 | FD KAGFIKRQLVETRQIIKHVAQILDSRENSNLTEDSKSNR--NVKIITLKSKMVSDERKDF GFYKLREVNDY | 981 |
| AHY15608 | 911 | FD KAGFIKRQLVETRQIIKHVAQILDSRENSNLTEDSKSNR--NVKIITLKSKMVSDERKDF GFYKLREVNDY | 981 |
| AHY17476 | 911 | FD KAGFIKRQLVETRQIIKHVARILDDSRENSNLTEDSKSNR--NVKIITLKSKMVSDERKDF GFYKVREVNDY | 981 |
| ESR09100 | | -- ---------------------------------------------------------- ----------- | |
| AGM98575 | 911 | FD KAGFIKRQLVETRQIIKHVARILDERENTEDSKSNR--QVKIVTLKSNLVSNERKEF ELYKVREVNDY | 981 |
| ALF27331 | 911 | DD KAGFIKRQLVETRQIIKHVARILDERENTETDENNKKIR--QVKIVTLKSNLVSNERKEF ELYKVREINDY | 981 |
| WP_018372492 | 924 | ED KAGFIKRQLVETRQITKHVARILDDEKLNRKKNENGEKLR--TTKIITLKSVFASRPFANF DLYKLRELNHY | 994 |
| WP_045618028 | 914 | RD KVGFIKRQLVETRQIIKHVAQILDDARYNTEVNEKDKKNR--SVKIITLKSNLVSNERKEF ELYKVREINDY | 984 |
| WP_045635197 | 913 | RD KVGFIKRQLVETRQIIKHVAQILDDARYNTEVNEKDKKNR--TVKIITLKSNLVSNERKEF RLYKVREINDY | 983 |
| WP_002263549 | 911 | DD KAGFIKRQLVETRQIIKHVARILDERENTETDENNKKIR--QVKIVTLKSNLVSNERKEF ELYKVREINDY | 981 |
| WP_002263887 | 911 | DD KAGFIKRQLVETRQIIKHVARILDERFYTETDENNKKIR--QVKIVTLKSNLVSNERKEF ELYKVREINDY | 981 |
| WP_002264920 | 911 | DD KAGFIKRQLVETRQIIKHVARILDERFYTETDENNKKIR--QVKIVTLKSNLVSNERKEF ELYKVREINDY | 981 |
| WP_002269043 | 911 | DD KAGFIKRQLVETRQIIKHVARILDERFYTETDENNKKIR--QVKIVTLKSNLVSNERKEF ELYKVREINDY | 981 |
| WP_002269448 | 911 | DD KAGFIKRQLVETRQIIKHVARILDERPHTETDENNKKIR--QVKIVTLKSNLVSNERKEF ELYKVREINDY | 981 |
| WP_002271977 | 911 | DD KAGFIKRQLVETRQIIKHVARILDERFYTETDENNKKIR--QVKIVTLKSNLVSNERKEF ELYKVREINDY | 981 |
| WP_002272766 | 911 | DD KAGFIKRQLVETRQIIKHVARILDERPHTETDENNKKIR--QVKIVTLKSNLVSNERKEF ELYKVREINDY | 981 |
| WP_002273241 | 914 | DD KAGFIKRQLVETRQIIKHVARMLDERPNKEFDDNNKIR--QVKIVTLKSVSFRKEF ELYKVREINDY | 984 |
| WP_002275430 | 911 | DD KAGFIKRQLVETRQIIKHVARILDERPHTETDENNKKIR--RVKIVTLKSNLVSSFRKEF ELYKVREINDY | 981 |
| WP_002276448 | 911 | DD KAGFIKRQLVETRQIIKHVARILDERFYTETDENNKKIR--QVKIVTLKSNLVSNERKEF ELYKVREINDY | 981 |
| WP_002277050 | 911 | DD KAGFIKRQLVETRQIIKHVARILDERPHTETDENNKKIR--QVKIVTLKSNLVSNERKEF ELYKVREINDY | 981 |
| WP_002277364 | 913 | DD KAGFIKRQLVETRQIIKHVARILDERPHTETDENNKKIR--QVKIVTLKSNLVSNFRKEF ELYKVREINDY | 983 |
| WP_002279025 | 911 | DD KAGFIKRQLVETRQIIKHVARILDERPHTETDENNKKIR--QVKIVTLKSNLVSNERKEF ELYKVREINDY | 981 |
| WP_002279859 | 911 | DD KAGFIKRQLVETRQIIKHVARILDERPHTETDENNKKIR--QVKIVTLKSNLVSNERKEF ELYKVREINDY | 981 |
| WP_002280230 | 911 | DD KAGFIKRQLVETRQIIKHVARILDERPHTETDENNKKIR--QVKIVTLKSNLVSNFRKEF ELYKVREINDY | 981 |
| WP_002281696 | 911 | DD KAGFIKRQLVETRQIIKHVARILDERPHTETDENNKKIR--QVKIVTLKSNLVSNFRKEF ELYKVREINDY | 981 |
| WP_002282247 | 913 | DD KAGFIKRQLVETRQIIKHVARMLDERPNKEFDDNNKIR--QVKIVTLKSVSSFRKEF ELYKVREINDY | 983 |
| WP_002282906 | 911 | DD KAGFIKRQLVETRQIIKHVARILDERFYTETDENNKKIR--QVKIVTLKSNLVSNERKEF ELYKVREINDY | 981 |
| WP_002283846 | 911 | DD KAGFIKRQLVETRQIIKHVARILDERPHTETDENNKKIR--QVKIVTLKSNLVSNFRKEF ELYKVREINDY | 981 |
| WP_002287255 | 911 | DD KAGFIKRQLVETRQIIKHVARILDERPHTETDENNKKIR--QVKIVTLKSNLVSNFRKEF ELYKVREINDY | 981 |

| | | | | |
|---|---|---|---|---|
| WP_002288990 | 911 | DD KAGFIKRQLVETRQITKHVARILDERENTETDENNKKIR--QVKIVTLKSNLVSNERKEF ELYKVREINDY | 981 |
| WP_002289641 | 911 | DD KAGFIKRQLVETRQITKHVARILDERENTETDENNKKIR--QVKIVTLKSNLVSNERKEF ELYKVREINDY | 981 |
| WP_002290427 | 911 | DD KAGFIKRQLVETRQITKHVARILDERENTETDENNKKIR--QVKIVTLKSNLVSNERKEF ELYKVREINDY | 981 |
| WP_002295753 | 911 | DD KAGFIKRQLVETRQITKHVARILDERENTETDENNKKIR--QVKIVTLKSNLVSNERKEF ELYKVREINDY | 981 |
| WP_002296423 | 925 | DD KAGFIKRQLVETRQITKHVARILDERPYTETDENNKKIR--QVKIVTLKSNLVSNERKEF ELYKVREINDY | 995 |
| WP_002304487 | 911 | DD KAGFIKRQLVETRQITKHVARILDERPHTETDENNKKIR--QVKIVTLKSNLVSNERKEF ELYKVREINDY | 981 |
| WP_002305844 | 911 | DD KAGFIKRQLVETRQITKHVARILDERPYTETDENNKKIR--QVKIVTLKSNLVSNERKEF ELYKVREINDY | 981 |
| WP_002307203 | 911 | DD KAGFIKRQLVETRQITKHVARILDERENTETDENNKKIR--QVKIVTLKSNLVSNERKEF ELYKVREINDY | 981 |
| WP_002310390 | 911 | DD KAGFIKRQLVETRQITKHVARILDERENTETDENNKKIR--QVKIVTLKSNLVSNERKEF ELYKVREINDY | 981 |
| WP_002352408 | 911 | DD KAGFIKRQLVETRQITKHVARILDERENTETDENNKKIR--QVKIVTLKSNLVSNERKEF ELYKVREINDY | 981 |
| WP_012997688 | 911 | DD KAGFIKRQLVETRQITKHVARILDERPHTETDENNKKIR--QVKIVTLKSNLVSNERKEF ELYKVREINDY | 981 |
| WP_014677909 | 911 | DD KAGFIKRQLVETRQITKHVARILDERPYTETDENNKKIR--QVKIVTLKSNLVSNERKEF ELYKVREINDY | 981 |
| WP_019312892 | 911 | DD KAGFIKRQLVETRQITKHVARILDERPHTETDENNKKIR--QVKIVTLKSNLVSNERKEF ELYKVREINDY | 981 |
| WP_019313659 | 911 | DD KAGFIKRQLVETRQITKHVARILDERENTETDENNKKIR--QVKIVTLKSNLVSNERKEF ELYKVREINDY | 981 |
| WP_019314093 | 911 | DD KAGFIKRQLVETRQITKHVARILDERPYTETDENNKKIR--QVKIVTLKSNLVSNERKEF ELYKVREINDY | 981 |
| WP_019315370 | 911 | DD KAGFIKRQLVETRQITKHVARILDERENTETDENNKKIR--QVKIVTLKSNLVSNERKEF ELYKVREINDY | 981 |
| WP_019803776 | 911 | DD KAGFIKRQLVETRQITKHVARILDERENTETDENNKKIR--QVKIVTLKSNLVSNERKEF ELYKVREINDY | 981 |
| WP_019805234 | 911 | DD KAGFIKRQLVETRQITKHVARILDERENTETDENNKKIR--QVKIVTLKSNLVSNERKEF ELYKVREINDY | 981 |
| WP_024783594 | 911 | DD KAGFIKRQLVETRQITKHVARILDERENTETDENNKKIR--RVKIVTLKSNLVSSFRKEF ELYKVREINDY | 981 |
| WP_024784288 | 913 | DD KAGFIKRQLVETRQITKHVARMLDERPNKEFPDDNNKRIR--RVKIVTLKSNLVSSFRKEF ELYKVREINDY | 983 |
| WP_024784666 | 911 | DD KAGFIKRQLVETRQITKHVARILDERPHTETDENNKKIR--QVKIVTLKSNLVSNERKEF ELYKVREINDY | 981 |
| WP_024784894 | 911 | DD KAGFIKRQLVETRQITKHVARMLDERPNKEFDDNNKRIR--RVKIVTLKSNLVSSFRKEF ELYKVREINDY | 981 |
| WP_024786433 | 913 | DD KAGFIKRQLVETRQITKHVARILDERPHTETDENNKKIR--RVKIVTLKSNLVSNERKEF ELYKVREINDY | 983 |
| WP_049523028 | 911 | DD KAGFIKRQLVETRQITKHVARILDERENTETDENNKKIR--SVKIVTLKSNLVSNPRKEF ELYKVREINDY | 981 |
| WP_049473442 | 911 | DD KAGFIKRQLVETRQITKHVARILDERENTETDENNKKIR--QVKIVILKSNLVSNERKEF ELYKVREINDY | 981 |
| WP_049474547 | 904 | DD KAGFIKRQLVETRQITKHVARILDERENTETDENNKKIR--QVKIVTLKSNLVSNERKEF ELYKVREINDY | 974 |
| EMC03581 | 916 | RD KVGFIKRQLVETRQITKHVAQILDARYNTEVNEKDKKNR--TVKIITLKSNLVSNPRKEF RLYKIREINDY | 986 |
| WP_000428612 | 914 | RD KVGFIKRQLVETRQITKHVAQILDARPNKEVNEKDKKNR--TVKIITLKSNLVSNFRKEF RLYKVREINDY | 984 |
| WP_000428613 | 909 | RD KVGFIKRQLVETRQITKHVAQILDARPNKEVNEKDKKNR--TVKIITLKSNLVSNFRKEF RLYKVREINDY | 979 |
| WP_003107102 | 880 | YD KAGFIKRQLVETQQITNVAQILDDRPNAEVNEKNQKIR--SVKIITLKSNLVSNPRKEF GLYKVREINDY | 950 |
| WP_054279288 | 912 | SD KANFIQRQLVETRQITKHVAQILDSRENTERDEKDRPIR--RVKVITLKSKEVSDFRQDF GFYKLREINDY | 982 |
| WP_049531101 | 914 | RD KVGFIRRQLVETRQITKHVAQILDSRPNIKVNEKNQKIR--TVKIITLKSNLVSNFRKEF RLYKVREINDY | 984 |
| WP_049538452 | 916 | LD KVGFIKRQLVETRQITKHVAQILDSRPNIEVTEKDKKNR--NVKIITLKSNLVSNFRKEF GLYKVREINDY | 986 |
| WP_049549711 | 917 | LD KVGFIKRQLVETRQITKHVAQILDDARPNKEVTEKDKKNR--NVKIITLKSKIVSDERKDF GLYKLREVNNY | 987 |
| WP_007896501 | 869 | SD KARLRRQLVETRQITKHVAQLLDSRENSKSNQNKKLAR--NVKIITLKSKIVSDERKDF GLYKLREVNNY | 939 |
| EFR44625 | 913 | SD KARLRRQLVETRQITKHVAQLLDSRENSKSNQNKKLAR--NVKIITLKSKIVSDERKDF GLYKLREVNNY | 983 |
| WP_002897477 | 914 | RD KVGFIKRQLVETQQITNVAQILDSRPNIEVKEKNQKIR--TVKIITLKSNLVSNFRKEF GLYKVREINNY | 984 |
| WP_002906454 | 913 | LD KVGFIKRQLVETRQITKHVAQILDDTRPNIEVNEENQKIR--TVKIITLKSNLVSNFRKEF GLYKVREINNY | 983 |
| WP_009729476 | 915 | LD KVGFIKRQLVETRQITKHVAQILDTRPNKEVTEKDKKNR--TVKIVTLKSNLVSNERKEF GLYKVREINNY | 985 |
| CQR24647 | 918 | ED KVGFIKRQLVETRQITKHVAQILDARPNKEVTEKDKKNR--NVKIVILKSNLVSNERKEF GFYKVREINNF | 988 |
| WP_000066813 | 914 | LD KVGFIKRQLVETRQITKHVAQILDARPNKEVTEKDKKNR--NVKIITLKSNLVSNFRKEF GLYKVREINDY | 984 |
| WP_009754323 | 913 | ED KARFIQRQLVETRQITKHVARILDTRENTKLDEAGNRIRdpKVNIITLKSNLVSQFRKDY QLYKVREINDY | 985 |
| WP_044674937 | 915 | ED KARFIQRQLVETRQITKHVARILDTRENTKLDEAGNRIRdpKVNIITLKSNLVSQFRKDY QLYKVREINNY | 987 |
| WP_044676715 | 915 | ED KARFIQRQLVETRQITKHVARILDTRENTKLDEAGNRIRdpKVNIITLKSNLVSQFRKDY QLYKVREINDY | 987 |
| WP_044680361 | 913 | ED KARFIQRQLVETRQITKHVARILDTRENTKLDEAGNRIRdpKVNIITLKSNLVSQFRKDY QLYKVREINNY | 985 |
| WP_044681799 | 910 | ED KARFIQRQLVETRQITKHVARILDTRENTKLDEAGNRIRdpKVNIITLKSNLVSQFRKDY QLYKVREINDY | 980 |
| WP_049533112 | 891 | ND KEGFIARQLVETRQITKHVAQLDARPNKNAKHDENKKVIR--DVKIITLKSNLVSQPFRKDF KFYKVREINNF | 951 |
| WP_029090905 | 917 | RD KVGFIKRQLVETRQITKHVTQLLQQEY--------K-dTTKVFAIKATIVSGLRRKF EFIKNRNVNDY | 987 |
| WP_006506696 | 976 | EERFINRQLVETRQITKNVIQIIEDHYST------TKVAAIRANLSHEFRVKN HIYKNRDINDY | 976 |
| AIT42264 | 911 | LD KAGFIKRQLVETRQITKHVAQILDSRMNIKYDENDKLIR--EVKIVLLKSALTSQFRKDF QFYKVREINNY | 981 |
| WP_034440723 | 915 | RD RQQFINRQLVETRQITKHVANLLSHHLNEK----KEVG-EINIVLLKSALTSQFRKDF DFYKVREVNDY | 985 |
| AKQ21048 | 911 | LD KAGFIKRQLVETRQITKHVAQILDSRMNIKYDENDKLIR--EVKVITLKSKIVSDERKDF QFYKVREINNY | 981 |
| WP_004636532 | 916 | AD RAHFLNRQLVETRQITKHVANLLDSQYNTAEEQ-----R--INIVLLKSSMTSRFRKEF KLYKVREINDY | 980 |

| | | | | |
|---|---|---|---|---|
| WP_002364836 | 922 | ED KAHFIQRQLVETRQITKNVAGILDQRYNANSKE-----K--KVQIITLKASLTSQFRSIF GLYKVREVNDY | 987 |
| WP_016631044 | 873 | ED KAHFIQRQLVETRQITKNVAGILDQRYNAKSKE-----K--KVQIITLKASLTSQFRSIF GLYKVREVNDY | 938 |
| EMS75795 | 655 | ED KAHFIQRQLVETRQITKHVAAILDQYFN-QPEE-SK-NK-GIRIITLKSSLVSQFRKTF GINKVREINNH | 722 |
| WP_002373311 | 922 | ED KAHFIQRQLVETRQITKNVAGILDQRYNAKSKE-----K--KVQIITLKASLTSQFRSIF GLYKVREINNH | 987 |
| WP_002378009 | 922 | ED KAHFIQRQLVETRQITKNVAGILDQRYNAKSKE-----K--KVQIITLKASLTSQFRSIF GLYKVREVNDY | 987 |
| WP_002407324 | 922 | ED KAHFIQRQLVETRQITKNVAGILDQRYNAKSKE-----K--KVQIITLKASLTSQFRSIF GLYKVREVNDY | 987 |
| WP_002413717 | 922 | ED KAHFIQRQLVETRQITKNVAGILNQRYNANSKE-----K--KVQIITLKASLTSQFRSIF GLYKVREVNDY | 987 |
| WP_010775580 | 924 | ED KAHFIQRQLVETRQITKNVAGILDQRYNANSKE-----K--KVQIITLKASLTSQFRSIF GLYKVREVNDY | 989 |
| WP_010818269 | 922 | ED KAHFIQRQLVETRQITKNVAGILDQRYNAKSKE-----K--KVQIITLKASLTSQFRSIF GLYKVREVNDY | 987 |
| WP_010824395 | 922 | ED KAHFIQRQLVETRQITKNVAGILDQLYNAKSKE-----K--KVQIITLKASLTSQFRSIF GLYKVREVNDY | 987 |
| WP_016622645 | 922 | ED KAHFIQRQLVETRQITKNVAGILDQRYNAKSKE-----K--KVQIITLKASLTSQFRSIF GLYKVREVNDY | 987 |
| WP_033624816 | 922 | ED KAHFIQRQLVETRQITKNVAGILDQRYNAKSKE-----K--KVQIITLKASLTSQFRSIF GLYKVREVNDY | 987 |
| WP_033625576 | 922 | ED KAHFIQRQLVETRQITKNVAGILDQRYNAKSKE-----K--KVQIITLKASLTSQFRSIF GLYKVREVNDY | 987 |
| WP_033789179 | 922 | ED KAGFIKRQLVETRQITKHVAGILHHRFN-KAEDTNEPIR-KVRIITLKSALVSQFRNRF GIYKVREINEY | 988 |
| WP_002310644 | 919 | ED KAGFIKRQLVETRQITKHVAGILHHRFN-KAEDTNDPIR-KVRIITLKSALVSQFRNRF GIYKVREINEY | 989 |
| WP_002112694 | 920 | ED KAGFIKRQLVETRQITKHVAGILHHRFN-KAEDTNEPIR-KVRIITLKSALVSQFRNRF GIYKVREINEY | 989 |
| WP_002114015 | 920 | ED KAGFIKRQLVETRQITKHVAGILHHRFN-KAEDTNEPIR-KVRIITLKSALVSQFRNRF GIYKVREINEY | 989 |
| WP_002220716 | 919 | ED KAGFIKRQLVETRQITKHVAGILHHRFN-KAEDTNEPIR-KVRIITLKSALVSQFRNRF GIYKVREINEY | 988 |
| WP_002330729 | 920 | ED KAGFIKRQLVETRQITKHVAGILHHRFN-KAEDTNEPIR-KVRIITLKSALVSQFRNRF GIYKVREINEY | 989 |
| WP_002335161 | 920 | ED KAGFIKRQLVETRQITKHVAGILHHRFN-KAEDTNEPIR-KVRIITLKSALVSQFRNRF GIYKVREINEY | 989 |
| WP_002345439 | 911 | ED KARFIQRQLVETRQITKHVANILHQSFN-QBEEGTD-CD-GVQIITLKATLISQFRQTF GLYKVREINPH | 979 |
| WP_034867970 | 920 | ED KARFIKRQLVETRQITKHVANILHQSFN-KAEDINEPIR-KVRIITLKSALVSQFRNRF GIYKVREINEY | 989 |
| WP_047937432 | 911 | ED KARFIKRQLVETRQITKHVANILHQSFN-QBEEGTD-CD-GVQIITLKATLISQFRQTF GIYKVREINEY | 979 |
| WP_010720994 | 911 | ED KARFIQRQLVETRQITKHVANILHQSFN-QBEEGTD-CD-GVQIITLKATLISQFRQTF GLYKVREINPH | 979 |
| WP_010733704 | 911 | ED KARFIQRQLVETRQITKHVANILHQSFN-QBEEGTD-CD-GVQIITLKATLISQFRQTF GLYKVREINPH | 979 |
| WP_034700478 | 912 | SD KAGELKRQLVETRQITKHVATILDSKFNE-DSNNRDVQ-----IITLKSALVSEFRKTF NLYKVREINDL | 977 |
| WP_007029003 | 905 | AD KARFIKRQLVETRQITKNVANILHQHEN-LPEEVSA-TE-KTSIITLKSTLTSQFRQMF DIYKVREINHH | 973 |
| WP_023519017 | 915 | DD RAHFIKRQLVETRQITKHVAR ILDQRFNSQKDEEGKTIR-AVRVVTLKSSLTSQFRKQF AIHKVREINDY | 985 |
| WP_010770040 | 912 | DD KAGFIHRQLVETRQITKHVANVAR ILHQRFNSEKDEEGNLIR-KVRIITLKSALVSQFRKNY GIYKIREINDY | 982 |
| WP_048604708 | 915 | DD KARFIQRQLVETRQITKHVAAILHQYFN-QTQELEK-EK-DIRIITLKSSLVSQFRQVF GIHKVREINHH | 982 |
| WP_010750235 | 950 | LD KAGFIKRQLVETRQITKHVAQILDSRMNIKYDENDKLIR-EVKVITLKSTVRADLSHAFRERY HIYKNRDINDF | 1020 |
| AII16583 | 928 | KD KERFINRQIVETRQITKHVAQIISNHYET----------TKVVTVRADLSHQFRERY HIYKNRDINDF | 987 |
| WP_029073316 | 928 | KD QERFINRQIVETRQITKHVAQIIDNHYEN----------TKVVTVRADLSHQFRERY HIYKNRDINDF | 987 |
| WP_031589969 | 903 | KL KERFIERQLVETRQITKYVAQILDQRLN--YDGNGVELD-eKIAIVTLKAQLASQFMRSEF KLRKVRALNNL | 972 |
| KDA45870 | 924 | -D MKGFINRQLVETRQITKQVIKLATNLLMEQYGED-------NIELITVKSGLTHQMRTEF DFPKNRNLNNH | 990 |
| AKP02966 | 926 | KD KLGFINRQLVQTSQMVKGVANILNSMYK---NQGTTCIQ-----ARANLSTAFRKAL ELVKNRNINDF | 999 |
| WP_010991369 | 914 | AD KARFIHRQLVETRQITKNVANILHQRFNYEKDDHGNTMK--QVRIVTLKSALVSQFRKQF QLYKVRDVNDY | 984 |
| WP_033838504 | 914 | AD KARFIHRQLVETRQITKNVANILHQRFNYEKDDHGNTMK--QVRIVTLKSALVSQFRKQF QLYKVRDVNDY | 984 |
| EHN60060 | 917 | AD KARFIHRQLVETRQITKNVANILHQRFNYEKDDHGNTMK--QVRIVTLKSALVSQFRKQF QLYKVRDVNDY | 987 |
| EFR89594 | 683 | AD KARFIHRQLVETRQITKNVANILHQRFNYGKDDHGNTMK--QVRIVTLKSALVSQFRKQF QLYKVRGVNDY | 753 |
| WP_038409211 | 914 | AD KANFIQRQLVETRQITKNVANILYQRFNCKQDENGNEVE--QVRIVTLKSTLVSQFRKQF QLYKVREVNDY | 984 |
| EFR95520 | 533 | AD KANFINRQLVETRQITKNVANILYQRPNCKQDENGNEVE--QVRIVTLKSTLVSQFRKQF QLYKVREVNDY | 603 |
| WP_003723650 | 914 | AD KARFIHRQLVETRQITKNVANILHQRPNKEIDNHGNIME--QVRIVTLKSALVSQFRKQF QLYKVREVNGY | 984 |
| WP_003727705 | 914 | AD KARFIHRQLVETRQITKNVANILHQRPNKEIDNHGNTME--QVRIVTLKSALVSQFRKQF QLYKVREVNDY | 984 |
| WP_003730785 | 914 | AD KARFIHRQLVETRQITKNVANILHQRPNKEIDNHGNTME--QVRIVTLKSALVSQFRKQF QLYKVREVNDY | 984 |
| WP_003733029 | 914 | AD KATFIHRQLVETRQITKNVANILHQRPNYKIDGNKDTME--TVRIVMLKSALVSQFRKQF QFYKVREVNDY | 984 |
| WP_003739838 | 914 | AD KARFIHRQLVETRQITKNVANILHQRPNNETDNHGNNME--QVRIVTLKSALVSQFRKQF QLYKVREVNDY | 984 |
| WP_014601172 | 914 | AD KARFIHRQLVETRQITKNVANILHQRPNNETDNHGNTME--QVRIVTLKSALVSQFRKQF QLYKVRGVNDY | 984 |
| WP_023548323 | 914 | AD KARFIHRQLVETRQITKNVANILHQRPNKETDNHGNNME--QVRIVTLKSALVSQFRKQF QLYKVREVNDY | 984 |
| WP_031665337 | 914 | AD KARFIHRQLVETRQITKNVANILHQRPNYKTDGNKDTME--PVRIVTLKSALVSQFRKQF QFYKVREVNDY | 984 |
| WP_031669209 | 914 | AD KARFIHRQLVETRQITKNVANILHQRPNYKTDGNKDTME--TVRIVTLKSALVSQFRKQF QLYKVREVNDY | 984 |
| WP_033920898 | 914 | AD KARFIHRQLVETRQITKNVANILHQRPNYKTDDNEDTME--PVRIVTLKSALVSQFRKQF QLYKVREVNDY | 984 |

```
                                                           -continued

AKI42028     917  AD KARFIHRQLVETRQITKNVANILHQRPNNETDNHGNTME--QVRIVTLKSALVSQPRKQF QLYKVREVNDY  987
AKI50529     917  AD KARFIHRQLVETRQITKNVANILHQRPNNETDNHGNTME--PVRIVTLKSALVSQPRKQF QLYKVREVNDY  987
EFR83390     362  AD KARFIHRQLVETRQITKNVANILHQRPNNETDNHGNTME--QVRIVTLKSALVSQPRKQF QLYKVREVNDY  432
WP_046323366 914  LD KAGFIKRQLVETRQITKHVAQILDSRMNIKYDENDKLIR--EVKVITLKSKLVSDFRKDF QFYKVREINNY  984
AKE81011     927  RD EERFINRQLVETRQITKNVTQIIEDHYST----------TKVAAIRANLSHEPRVKN HIYKNRDINDY  997
CUO82355     921  KD KERFINRQLVETRQIIKNVAVIINDHYTN----------TNIVTVRAELSHQPRERY KIYKNRDINDF  980
WP_033162887 923  LD KAGFIKRQLVETRQIIKHVAQILDSRMNIKYDENDKLIR--EVKVITLKSKLVSDFRKDF QFYKVREINNY  982
AGZ01981     944  LD KAGFIKRQLVETRQIIKHVAQILDSRMNIKYDENDKLIR--EVKVITLKSKLVSDFRKDF QFYKVREINNY 1014
AKA60242     911  LD KAGFIKRQLVETRQIIKHVAQILDSRMNIKYDENDKLIR--EVKVITLKSKLVSDFRKDF QFYKVREINNY  981
AKS40380     911  LD KAGFIKRQLVETRQIIKHVAQILDSRMNIKYDENDKLIR--EVKVITLKSKLVSDFRKDF QFYKVREINNY  981
4UN5_B       915  LD KAGFIKRQLVETRQIIKHVAQILDSRMNIKYDENDKLIR--EVKVITLKSKLVSDFRKDF QFYKVREINNY  985
WP_010922251 982  HHAHDAYLNAVVGTALIKKYPKL-ESEFVYGDYKVYDV S---EQEI---GK ATAKY--F-FYSNIM-NFFKTEIT 1051

WP_039695303 992  HHAHDAYLNAVVGTALLKKYPKL-ASEFVVGEYKKDI S---SD------ KATAK- YfFYSNLM-NFFKTKVK 1058
WP_045635197 984  HHAHDAYLNAVVGTAKAILKKYPKL-EPEFVYGEYQKDL SkdpKEV-- EK ATEKY--F-FYSNLL-NFFKEEVH 1055
5AXW_A       703  HHAEDALI--------------IaNADFIPKEWKKLDK Nq-mFE--- EK ETBQEyKEiFITPHQiKHIKDFKD  771
WP_009880683 666  HHAHDAYLNAVVGTALIKKYPKL-ESEFVVGDYKVYDI S---EQEi--- GK ATAKY--F-FYSNIM-NFFKTEIT  735
WP_010922251 982  HHAHDAYLNAVVGTALIKKYPKL-ESEFVVGDYKVYDV S---EQEi--- GK ATAKY--F-FYSNIM-NFFKTEIT 1051
WP_011054416 982  HHAHDAYLNAVVGTALIKKYPKL-ESEFVVGDYKVYDV S---EQEi--- GK ATAKY--F-FYSNIM-NFFKTEIT 1051
WP_011284745 982  HHAHDAYLNAVVGTALIKKYPKL-ESEFVVGDYKVYDV S---EQEi--- GK ATAKY--F-FYSNIM-NFFKTEIT 1051
WP_011285506 982  HHAHDAYLNAVVGTALIKKYPKL-ESEFVVGDYKVYDV S---EQEi--- GK ATAKY--F-FYSNIM-NFFKTEIT 1051
WP_011527619 982  HHAHDAYLNAVVGTALIKKYPKL-ESEFVVGDYKVYDV S---EQEi--- GK ATAKY--F-FYSNIM-NFFKTEIT 1051
WP_012560673 982  HHAHDAYLNAVVGTALIKKYPKL-ESEFVVGDYKVYDI S---EQEi--- GK ATAKY--F-FYSNIM-NFFKTEIT 1051
WP_014407541 981  HHAHDAYLNAVVGTALIKKYPKL-ESEFVVGDYKVYDV S---EQEi--- GK ATAKY--F-FYSNIM-NFFKTEIT 1050
WP_020905136 982  HHAHDAYLNAVVGTALIKKYPKL-ESEFVVGDYKVYDV S---EQEi--- GK ATAKY--F-FYSNIM-NFFKTEIT 1051
WP_023080005 981  HHAHDAYLNAVVGTALIKKYPKL-ESEFVVGDYKVYDV S---EQEi--- GK ATAKY--F-FYSNIM-NFFKTEIT 1050
WP_023610282 981  HHAHDAYLNAVVGTALIKKYPKL-ESEFVVGDYKVYDV S---EQEi--- GK ATAKY--F-FYSNIM-NFFKTEIT 1050
WP_030125963 982  HHAHDAYLNAVVGTALIKKYPKL-ESEFVVGDYKVYDV S---EQEi--- GK ATAKY--F-FYSNIM-NFFKTEIT 1051
WP_030126706 982  HHAHDAYLNAVVGTALIKKYPKL-ESEFVVGDYKVYDV S---EQEi--- GK ATAKY--F-FYSNIM-NFFKTEIT 1051
WP_031148318 982  HHAHDAYLNAVVGTALIKKYPKL-ESEFVVGDYKVYDV S---EQEi--- GK ATAKY--F-FYSNIM-NFFKTEIT 1051
WP_032460140 982  HHAHDAYLNAVVGTALIKKYPKL-ESEFVVGDYKVYDV S---EQEi--- GK ATAKY--F-FYSNIM-NFFKTEIT 1051
WP_032461047 982  HHAHDAYLNAVVGTALIKKYPKL-ESEFVVGDYKVYDV S---EQEi--- GK ATAKY--F-FYSNIM-NFFKTEIT 1051
WP_032462016 982  HHAHDAYLNAVVGTALIKKYPKL-ESEFVVGDYKVYDV S---EQEi--- GK ATAKY--F-FYSNIM-NFFKTEIT 1051
WP_032462936 982  HHAHDAYLNAVVGTALIKKYPKL-ESEFVVGDYKVYDV S---EQEi--- GK ATAKY--F-FYSNIM-NFFKTEIT 1051
WP_032464890 982  HHAHDAYLNAVVGTALIKKYPKL-ESEFVVGDYKVYDV S---VR--sRK SATEK- FLFYSNIL-RFFKKE--  1051
WP_033888930 807  HHAHDAYLNAVVGTALIKKYPKL-ESEFVVGDYKVYDV S---SD------ KATAK- YfFYSNLM-NFFKRVIR  876
WP_038431314 981  HHAHDAYLNAVVGTALIKKYPKL-ESEFVVGDYKVYDV S---YKT--- RK ATEKL--F-FYSNLM-NFFKTKVT 1050
WP_038432938 981  HHAHDAYLNAVAKAILTKYPQL-EPEFVVGDYPKAN- S---SKI--- VR ATRKM--F-FYSNLM-NMFKRVVR 1050
WP_038434062 893  HHAHDAYLNAVVAKAILTKYPQL-EPEFVVGDYPKAN- S---YKT--- RK ATEKL--F-FYSNIM-NFFKTKVT  962
BAQ51233     157  HHAHDAYLNAVVAKAILTKYPQL-EPEFVVGDYPKAN- S---YKT--- RK ATEKL--F-FYSNIM-NFFKTKVT  226

KGE60162     982  HHAHDAYLNAVVGNALLLKYPQL-EPEFVVGDYPKAN- S---EQEi--- GK ATAKY--F-FYSNIM-NFFKTEIT 1051
KGE60856     981  HHAHDAYLNAVVGNALLLKYPQL-EPEFVVGDYPKAN- S---VR---sRK SATEK- FLFYSNIL-RFFKKE--  1041
WP_002989955 992  HHAHDAYLNAVVGTALLKKYPKL-ASEFVVGEYKKDI S---SD------ KATAK- YfFYSNLM-NFFKRVIR  1058
WP_003030002 987  HHAHDAYLNAVVAKAILTKYPQL-EPEFVVGDYPKAN- L---SKI--- VR ATRKM--F-FYSNLM-NMFKRVVR 1057
WP_003065552 987  HHAHDAYLNAVVAKAILTKYPQL-EPEFVVGDYPKRKK S---YKT--- RK ATEKL--F-FYSNLM-NFFKTKVT 1049
WP_001040076 987  HHAHDAYLNAVVAKAILTKYPQL-EPEFVVGDYPKAN- S---YKT--- RK ATEKL--F-FYSNIM-NFFKTKVT 1049
WP_001040078 987  HHAHDAYLNAVVAKAILTKYPQL-EPEFVVGDYPKAN- S---YKT--- RK ATEKL--F-FYSNIM-NFFKTKVT 1049
WP_001040080 987  HHAHDAYLNAVVAKAILTKYPQL-EPEFVVGDYPKAN- S---YKT--- RK ATEKL--F-FYSNIM-NFFKTKVT 1049
WP_001040081 987  HHAHDAYLNAVVAKAILTKYPQL-EPEFVVGDYPKAN- S---YKT--- RK ATEKL--F-FYSNIM-NFFKTKVT 1049
WP_001040083 987  HHAHDAYLNAVVAKAILTKYPQL-EPEFVVGDYPKAN- S---YKT--- RK ATEKL--F-FYSNIM-NFFKTKVT 1049
WP_001040085 987  HHAHDAYLNAVVAKAILTKYPQL-EPEFVVGDYPKAN- S---YKT--- RK ATEKL--F-FYSNIM-NFFKTKVT 1049
WP_001040087 987  HHAHDAYLNAVVAKAILTKYPQL-EPEFVVGDYPKAN- S---YKT--- RK ATEKL--F-FYSNIM-NFFKTKVT 1049
WP_001040088 987  HHAHDAYLNAVVAKAILTKYPQL-EPEFVVGDYPKAN- S---YKT--- RK ATEKL--F-FYSNIM-NFFKTKVT 1049
```

| | | | |
|---|---|---|---|
| WP_001040089 | 987 | HHAHDAYLNAVVAKAILTKYPQL-EPEFVVGDYPKYN-S---YKT---RK ATEKL-F-FYSNIM-NFFKTKVT | 1049 |
| WP_001040090 | 987 | HHAHDAYLNAVVAKAILTKYPQL-EPEFVVGDYPKYN-S---YKT---RK ATEKL-F-FYSNIM-NFFKTKVT | 1049 |
| WP_001040091 | 987 | HHAHDAYLNAVVAKAILTKYPQL-EPEFVVGDYPKYN-S---YKT---RK ATEKL-F-FYSNIM-NFFKTKVT | 1049 |
| WP_001040092 | 987 | HHAHDAYLNAVVAKAILTKYPQL-EPEFVVGDYPKYN-S---YKT---RK ATEKL-F-FYSNIM-NFFKTKVT | 1049 |
| WP_001040094 | 987 | HHAHDAYLNAVVAKAILTKYPQL-EPEFVVGDYPKYN-S---YKT---RK ATEKL-F-FYSNIM-NFFKTKVT | 1049 |
| WP_001040095 | 987 | HHAHDAYLNAVVAKAILTKYPQL-EPEFVVGDYPKYN-S---YKT---RK ATEKL-F-FYSNIM-NFFKTKVT | 1049 |
| WP_001040096 | 987 | HHAHDAYLNAVVAKAILTKYPQL-EPEFVVGDYPKYN-S---YKT---RK ATEKL-F-FYSNIM-NFFKTKVT | 1049 |
| WP_001040097 | 987 | HHAHDAYLNAVVAKAILTKYPQL-EPEFVVGDYPKYN-S---YKT---sRK ATEKL-F-FYSNIM-NFFKTKVT | 1049 |
| WP_001040098 | 987 | HHAHDAYLNAVVAKAILTKYPQL-EPEFVVGDYPKYN-S---YKT---RK ATEKL-F-FYSNIM-NFFKTKVT | 1049 |
| WP_001040099 | 987 | HHAHDAYLNAVVAKAILTKYPQL-EPEFVVGDYPKYN-S---YKT---RK ATEKL-F-FYSNIM-NFFKTKVT | 1049 |
| WP_001040100 | 987 | HHAHDAYLNAVVAKAILTKYPQL-EPEFVVGDYPKYN-S---YKT---RK ATEKL-F-FYSNIM-NFFKTKVT | 1049 |
| WP_001040104 | 987 | HHAHDAYLNAVVAKAILTKYPQL-EPEFVVGDYPKYN-S---YKT---RK ATEKL-F-FYSNIM-NFFKTKVT | 1049 |
| WP_001040105 | 987 | HHAHDAYLNAVVAKAILTKYPQL-EPEFVVGDYPKYN-S---YKT---RK ATEKL-F-FYSNIM-NFFKTKVT | 1049 |
| WP_001040106 | 987 | HHAHDAYLNAVVAKAILTKYPQL-EPEFVVGDYPKYN-S---YKT---RK ATEKL-F-FYSNIM-NFFKTKVT | 1049 |
| WP_001040107 | 987 | HHAHDAYLNAVVAKAILTKYPQL-EPEFVVGDYPKYN-S---YKT---RK ATEKL-F-FYSNIM-NFFKTKVT | 1049 |
| WP_001040108 | 987 | HHAHDAYLNAVVAKAILTKYPQL-EREFVVGDYPKYN-S---YKT---RK ATEKL-F-FYSNIM-NFFKTKVT | 1049 |
| WP_001040109 | 987 | HHAHDAYLNAVVAKAILTKYPQL-EPEFVVGDYPKYN-S---YKT---RK ATEKL-F-FYSNIM-NFFKTKVT | 1049 |
| WP_001040110 | 987 | HHAHDAYLNAVVAKAILTKYPQL-EPEFVVGDYPKYN-S---YKT---RK ATEKL-F-FYSNIM-NFFKTKVT | 1049 |
| WP_015058523 | 987 | HHAHDAYLNAVVAKAILTKYPQL-EPEFVVGDYPKYN-S---YKT---RK ATEKL-F-FYSNIM-NFFKTKVT | 1049 |
| WP_017643650 | 987 | HHAHDAYLNAVVAKAILTKYPQL-EPEFVVGDYPKYN-S---YKT---RK ATEKL-F-FYSNIM-NFFKTKVT | 1049 |
| WP_017647151 | 987 | HHAHDAYLNAVVAKAILTKYPQL-EPEFVVGDYPKYN-S---YKT---RK ATEKL-F-FYSNIM-NFFKTKVT | 1049 |
| WP_017648376 | 987 | HHAHDAYLNAVVAKAILTKYPQL-EPEFVVGDYPKYN-S---YKT---RK ATEKL-F-FYSNIM-NFFKTKVT | 1049 |
| WP_017649527 | 987 | HHAHDAYLNAVVAKAILTKYPQL-EPEFVVGDYPKYN-S---YKT---RK ATEKL-F-FYSNIM-NFFKTKVT | 1049 |
| WP_017771611 | 987 | HHAHDAYLNAVVAKAILTKYPQL-EPEFVVGDYPKYN-S---YKT---RK ATEKL-F-FYSNIM-NFFKTKVT | 1049 |
| WP_017771984 | 987 | HHAHDAYLNAVVAKAILTKYPQL-EPEFVVGDYPKYN-S---YKT---RK ATEKL-F-FYSNIM-NFFKTKVT | 1049 |
| CFQ25032 | 1001 | HHAHDAYLNAVVAKAILTKYPQL-EPEFVVGDYPKYN-S---YKT---RK ATEKL-F-FYSNIM-NFFKTKVT | 1063 |
| CFV16040 | 987 | HHAHDAYLNAVVAKAILTKYPQL-EPEFVVGDYPKYN-S---YKT---RK ATEKL-F-FYSNIM-NFFKTKVT | 1049 |
| KLJ37842 | 987 | HHAHDAYLNAVVAKAILTKYPQL-EPEFVVGDYPKYN-S---YKT---RK ATEKL-F-FYSNIM-NFFKTKVT | 1049 |
| KLJ72361 | 987 | HHAHDAYLNAVVAKAILTKYPQL-EPEFVVGDYPKYN-S---YKT---RK ATEKL-F-FYSNIM-NFFKTKVT | 1049 |
| KLL20707 | 987 | HHAHDAYLNAVVAKAILTKYPQL-EPEFVVGDYPKYN-S---YKT---RK ATEKL-F-FYSNIM-NFFKTKVT | 1049 |
| KLL42645 | 987 | HHAHDAYLNAVVAKAILTKYPQL-EPEFVVGDYPKYN-S---YKT---RK ATEKL-F-FYSNIM-NFFKTKVT | 1049 |
| WP_047207273 | 987 | HHAHDAYLNAVVAKAILTKYPQL-EPEFVVGDYPKYN-S---YKT---RK ATEKL-F-FYSNIM-NFFKTKVT | 1049 |
| WP_047209694 | 987 | HHAHDAYLNAVVAKAILTKYPQL-EPEFVVGDYPKYN-S---YKT---RK ATEKL-F-FYSNIM-NFFKTKVT | 1049 |
| WP_050198062 | 987 | HHAHDAYLNAVVAKAILTKYPQL-EPEFVVGDYPKYN-S---YKT---RK ATEKL-F-FYSNIM-NFFKTKVT | 1049 |
| WP_050201642 | 987 | HHAHDAYLNAVVAKAILTKYPQL-EPEFVVGDYPKYN-S---YKT---RK ATEKL-F-FYSNIM-NFFKTKVT | 1049 |
| WP_050204027 | 987 | HHAHDAYLNAVVAKAILTKYPQL-EPEFVVGDYPKYN-S---YKT---RK ATEKL-F-FYSNIM-NFFKTKVT | 1049 |
| WP_050881965 | 987 | HHAHDAYLNAVVAKAILTKYPQL-EPEFVVGDYPKYN-S---YKT---RK ATEKL-F-FYSNIM-NFFKTKVT | 1049 |
| WP_050886065 | 987 | HHAHDAYLNAVVAKAILTKYPQL-EPEFVVGDYPKYN-S---YKT---RK ATEKL-F-FYSNIM-NFFKTKVT | 1049 |
| AHN30376 | 987 | HHAHDAYLNAVVAKAILTKYPQL-EPEFVVGDYPKYN-S---YKT---RK ATEKL-F-FYSNIM-NFFKTKVT | 1049 |
| EAO78426 | 987 | HHAHDAYLNAVVAKAILTKYPQL-EPEFVVGDYPKYN-S---YKT---RK ATEKL-F-FYSNIM-NFFKTKVT | 1049 |
| CCW42055 | 987 | HHAHDAYLNAVVAKAILTKYPQL-EPEFVVGDYPKYN-S---YKT---RK ATEKL-F-FYSNIM-NFFKTKVT | 1049 |
| WP_003041502 | 981 | HHAHDAYLNAVIGTALLKKYPKL-ASEFVVGEFKKDV-S---DK---eIG KATAK-YfFYSNLM-NFFKKEVK | 1050 |
| WP_037593752 | 982 | HHAHDAYLNAVVGNALLLKYPQL-EPEFVVGEYPKYN-S---YR---sRK SATEK-F1FYSNIL-RFFKKE-- | 1042 |
| WP_049516684 | 982 | HHAHDAYLNAVVGNALLLKYPQL-EPEFVVGEYPKYN-S---YR---sRK SATEK-F1FYSNIL-RFFKKE-- | 1042 |
| GAD46167 | 981 | HHAHDAYLNAVVGNALLLKYPQL-EPEFVVGEYPKYN-S---YR---sRK SATEK-F1FYSNIL-RFFKKE-- | 1041 |
| WP_018363470 | 990 | HHAHDAYLNAVGTALLKKYPKL-APEFVVGEYKKDV-S---SDDhseMG KATAK-YfFYSNLM-NFFKRVIR | 1062 |
| WP_003043819 | 991 | HHAHDAYLNAVVGTALIKKYPKL-ESEFVVGDYKVYDV-S---EQEi---GK ATAKR-F-FYSNLM-NFFKTEVK | 1060 |
| WP_066269658 | 981 | HHAHDAYLNAVVGNALLLKYPQL-EPEFVVGEYPKYN-S---YR---sRK SATEK-F1FYSNIL-RFFKKE-- | 1041 |
| WP_048800889 | 981 | HHAHDAYLNAVVGTALIKKYPKL-TSEFVVGEYKKDV-S---DND---eIG KATAK-YfFYSNLM-NFFKTEVK | 1051 |
| WP_012767106 | 981 | HHAHDAYLNAVVGTALIKKYPKL-ESEFVVGDYKVYDV-S---EQEi---GK ATAKR-F-FYSNIM-NFFKTEIT | 1050 |
| WP_014612333 | 981 | HHAHDAYLNAVVGTALIKKYTKL-ESEFVVGDYKVYDV-S---EQEi---GK ATAKR-F-FYSNIM-NFFKTEIT | 1050 |
| WP_015017095 | 981 | HHAHDAYLNAVVGTALIKKYPKL-ESEFVVGDYKVYDV-S---EQEi---GK ATAKR-F-FYSNIM-NFFKTEIT | 1050 |
| WP_015057649 | 981 | HHAHDAYLNAVVGTALIKKYPKL-ESEFVVGDYKVYDV-S---EQEi---GK ATAKR-F-FYSNIM-NFFKTEIT | 1050 |

```
-continued

WP_048327215   981  HHAHDAYLNAVVGTALIKYPKL-ESEFVYGDYKVYDV S---EQEi--GK ATAKR--F-FYSNIM-NFFKTEIT  1050
WP_049519324   981  HHAHDAYLNAVVGTALIKYPKL-ESEFVYGDYKVYDV S---EQEi--GK ATAKR--F-FYSNIM-NFFKTEIT  1050
WP_012515931   981  HHAHDAYLNAVVAKAILGKYPQL-APEFVYGDYPKYN- S---FKEr--QK ATQKM--L-FYSNIL-KFFKDQES  1043
WP_021320964   981  HHAHDAYLNAVVAKAILGKYPQL-APEFVYGDYPKYN- S---FKEr--QK ATQKT--L-FYSNIL-KFFKDQES  1043
WP_037581760   981  HHAHDAYLNAVVGTALLKYPKL-APEFVYGDYPKYN- S---FKEr--QK ATQKT--L-FYSNIL-KFFKDQES  1061
WP_044232481   989  HHAHDAYLNAVVGTALLKYPKL-APEFVYGEYKKYDV S---SDNhsLG  KATAK--YfFYSNLM-NFFKTEVK  1056
WP_009854540   990  HHAHDAYLNAVVGTALLKYPKL-ASEFVYGEYKKYDI S---SD----- KATAK--YfFYSNLM-NFFKTKVK  1058
WP_012962174   992  HHAHDAYLNAVVGTALLKYPKL-APEFVYGEYKKYDI S---GD----- KATAK--YfFYSNLM-NFFKRVIR  1061
WP_039695303   989  HHAHDAYLNAVVGTALLKYPKL-TPEFVYGEYKKYDV S---SDDyseMG KATAK--YfFYSNLM-NFFKTKVK  1051
WP_014334983   982  HHAHDAYLNAVVGTALLKYPKL-EAEFVYGDYKHYDL P---DSS1--GK ATTRM--F-FYSNIM-NFFKKEIK  1051
WP_003099269   982  HHAQDAYLNAVVGTALLKYPKL-EAEFVYGDYKHYDL P---DSS1--GK ATTRM--F-FYSNIM-NFFKKEIK  1051
AHY15608       982  HHAQDAYLNAVVGTALLKYPKL-EABFVYGDYKHYDL P---DSS1--GK ATTRM--F-FYSNIM-NFFKKEIK  1051
AHY17476       982  HHAHDAYLNAVVGTALLKYPKL-EABFVYGDYKHYDL P---DSS1--GK ATTRM--F-FYSNIM-NFFKKEIK  1051
AGM98575       982  HHAQDAYLNAVVGTALLKYPKL-EAEFVYGDYKHYDL P---DSS1--GK ATTRM--F-FYSNIM-NFFKKEIK  1051
ALF27331       982  HHAHDAYLNAVIGKALLGVYPQL-EPEFVYGDYPHFH G----HK---GK ATAKK--F-FYSNIM-NFFKKD--  1041
WP_018372492   995  HHAHDAYLNAVVAQALLKVYPKF-ERELVYGSYVKESI ----FS----RK ATERM--rMYNNIL-KFISKD--  1055
WP_045618028   985  HHAHDPYLNAVVAKAILKKYPKL-EPEFVYGDYQKYDL Tkdp KEV----EK ATEKY--F-FYSNLL-NFFKEEVH 1056
WP_045635197   984  HHAHDPYLNAVVAKAILKKYPKL-EPEFVYGEYQKYDL Skdp KEV----EK ATEKY--F-FYSNLL-NFFKEEVH 1055
WP_002263549   982  HHAHDAYLNAVIGKALLGVYPQL-EPEFVYGDYPHFH G----HK---EK ATAKK--F-FYSNIM-NFFKKD-- 1041
WP_002263887   982  HHAHDAYLNAVIGKALLGVYPQL-EAEFVYGDYKHYDL P---DSS1--GK ATTRM--F-FYSNLM-NFFKKEIK 1051
WP_002264920   982  HHAHDAYLNAVIGKALLGVYPQL-EPEFVYGDYPHFH G----HK---eNK ATAKK--F-FYSNIM-NFFKKD-- 1041
WP_002269043   982  HHAHDAYLNAVIGKALLGVYPQL-EPEFVYGDYPHFH G----HK---eNK ATAKK--F-FYSNIM-NFFKKD-- 1041
WP_002269448   982  HHAHDAYLNAVIGKALLGVYPQL-EPEFVYGDYPHFH G----HE---eNK ATAKK--F-FYSNIM-NFFKKD-- 1041
WP_002271977   982  HHAHDAYLNAVIGKALLGVYPQL-EPEFVYGDYPHFH G----HK---eNK ATAKK--F-FYSNIM-NFFKKD-- 1041
WP_002272766   982  HHAHDAYLNAVIGKALLGVYPQL-EPEFVYGDYPHFH G----HE---eNK ATAKK--F-FYSNIM-NFFKKD-- 1041
WP_002273241   982  HHAHDAYLNAVIGKALLGVYPQL-EPEFVYGDYPHFH G----HK---eNK ATAKK--F-FYSNIM-NFFKKD-- 1041
WP_002275430   982  HHAHDAYLNAVIGKALLGVYPQL-EPEFVYGDYPHFH G----HK---eNK ATAKK--F-FYSNIM-NFFKKD-- 1041
WP_002276448   982  HHAHDAYLNAVIGKALLGVYPQL-EPEFVYGDYPHFH G----HK---eNK ATAKK--F-FYSNIM-NFFKKD-- 1041
WP_002277050   984  HHAHDAYLNAVVKALLVKYPKL-EPEFVYGEYPKYN- S---YR----eRK ATQKM--F-FYSNIM-NMFKSKVK 1046
WP_002277364   982  HHAHDAYLNAVIGKALLGVYPQL-EPEFVYGDYPHFH G----HK---eNK ATAKK--F-FYSNIM-NFFKKD-- 1041
WP_002279025   982  HHAHDAYLNAVIGKALLGVYPQL-EPEFVYGDYPHFH G----YR---eRK ATQKM--F-FYSNIM-NMFKSKVK 1046
WP_002279859   982  HHAHDAYLNAVIGKALLGVYPQL-EPEFVYGDYPHFH G----HK---eNK ATAKK--F-FYSNIM-NFFKKD-- 1041
WP_002280230   982  HHAHDAYLNAVIGKALLGVYPQL-EPEFVYGDYPHFH G----HK---eNK ATAKK--F-FYSNIM-NFFKKD-- 1041
WP_002281696   982  HHAHDAYLNAVIGKALLGVYPQL-EPEFVYGDYPHFH G----HK---eNK ATAKK--F-FYSNIM-NFFKKD-- 1041
WP_002282247   984  HHAHDAYLNAVIGKALLGVYPQL-EPEFVYGDYPHFH G----HK---eNK ATAKK--F-FYSNIM-NFFKKD-- 1041
WP_002282906   982  HHAHDAYLNAVIGKALLGVYPQL-EPEFVYGDYPHFH G----HK---eNK ATAKK--F-FYSNIM-NFFKKD-- 1041
WP_002283846   982  HHAHDAYLNAVIGKALLGVYPQL-EPEFVYGDYPHFH G----HK---eNK ATAKK--F-FYSNIM-NFFKKD-- 1041
WP_002287255   982  HHAHDAYLNAVIGKALLGVYPQL-EPEFVYGDYPHFH G----HK---eNK ATAKK--F-FYSNIM-NFFKKD-- 1041
WP_002288990   982  HHAHDAYLNAVIGKALLGVYPQL-EPEFVYGDYPHFH G----HK---eNK ATAKK--F-FYSNIM-NFFKKD-- 1041
WP_002289641   982  HHAHDAYLNAVIGKALLGVYPQL-EPEFVYGDYPHFH G----HK---eNK ATAKK--F-FYSNIM-NFFKKD-- 1041
WP_002290427   982  HHAHDAYLNAVIGKALLGVYPQL-EPEFVYGDYPHFH G----HK---eNK ATAKK--F-FYSNIM-NFFKKD-- 1041
WP_002295753   982  HHAHDAYLNAVIGKALLGVYPQL-EPEFVYGDYPHFH G----HK---eNK ATAKK--F-FYSNIM-NFFKKD-- 1041
WP_002296423   996  HHAHDAYLNAVIGKALLGVYPQL-EPEFVYGDYPHFH G----HK---eNK ATAKK--F-FYSNIM-NFFKKD-- 1055
WP_003044487   982  HHAHDAYLNAVIGKALLGVYPQL-EPEFVYGDYPHFH G----HK---eNK ATAKK--F-FYSNIM-NFFKKG-- 1041
WP_003044487   982  HHAHDAYLNAVIGKALLGVYPQL-EPEFVYGDYPHFH G----HK---eNK ATAKK--F-FYSNIM-NFFKKD-- 1041
WP_003307203   982  HHAHDAYLNAVIGKALLGVYPQL-EPEFVYGDYPHFH G----HK---eNK ATAKK--F-FYSNIM-NFFKKD-- 1041
WP_003310390   982  HHAHDAYLNAVIGKALLGVYPQL-EPEFVYGDYPHFH G----HK---eNK ATAKK--F-FYSNIM-NFFKKD-- 1041
WP_002352408   982  HHAHDAYLNAVIGKALLGVYPQL-EPEFVYGDYPHFH G----HK---eNK ATAKK--F-FYSNIM-NFFKKD-- 1041
WP_012997688   982  HHAHDAYLNAVIGKALLGVYPQL-EPEFVYGDYPHFH G----HK---eNK ATAKK--F-FYSNIM-NFFKKD-- 1041
WP_014677909   982  HHAHDAYLNAVIGKALLGVYPQL-EPEFVYGDYPHFH G----HK---eNK ATAKK--F-FYSNIM-NFFKKD-- 1041
WP_019312892   982  HHAHDAYLNAVIGKALLGVYPQL-EPEFVYGDYPHFH G----HK---eNK ATAKK--F-FYSNIM-NFFKKD-- 1041
WP_019313659   982  HHAHDAYLNAVIGKALLGVYPQL-EPEFVYGDYPHFH G----HK---eNK ATAKK--F-FYSNIM-NFFKKD-- 1041
```

| | | | |
|---|---|---|---|
| WP_019314093 | 982 | HHAHDAYLNAVIGKALLGVYPQL-EPEFVVGDYPHFH-G----HK----eNK ATAKK--F-FYSNIM-NFFKKD-- | 1041 |
| WP_019315370 | 982 | HHAHDAYLNAVIGKALLGVYPQL-EPEFVVGDYPHFH-G----HE----eNK ATAKK--F-FYSNIM-NFFKKD-- | 1041 |
| WP_019803776 | 982 | HHAHDAYLNAVIGKALLGVYPQL-EPEFVVGDYPHFH-G----HK----eNK ATAKK--F-FYSNIM-NFFKKD-- | 1041 |
| WP_019805234 | 982 | HHAHDAYLNAVIGKALLGVYPQL-EPEFVVGDYPHFH-G----HK----eNK ATAKK--F-FYSNIM-NFFKKD-- | 1041 |
| WP_024783594 | 982 | HHAHDAYLNAVVKALLVKYPKL-EPEFVVGDYPHFH-S----YR----eRK ATQKM--F-FYSNIM-NMFKSKVK | 1046 |
| WP_024784288 | 982 | HHAHDAYLNAVIGKALLGVYPQL-EPEFVVGDYPHFH-G----HK----eNK ATAKK--F-FYSNIM-NFFKKD-- | 1041 |
| WP_024784666 | 982 | HHAHDAYLNAVIGKALLGVYPQL-EPEFVVGDYPHFH-G----HK----eNK ATAKK--F-FYSNIM-NFFKKD-- | 1041 |
| WP_024784894 | 984 | HHAHDAYLNAVVKALLVKYPKL-EPEFVVGDYPHFH-S----YR----eRK ATQKM--F-FYSNIM-NMFKSKVK | 1046 |
| WP_024786433 | 982 | HHAHDAYLNAVIGKALLGVYPQL-EPEFVVGDYPHFH-G----HK----eNK ATAKK--F-FYSNIM-NFFKKD-- | 1041 |
| WP_049473442 | 984 | HHAHDAYLNAVIGKALLGVYPQL-EPEFVVGDYPHFH-G----HE----eNK ATAKK--F-FYSNIM-NFFKKD-- | 1041 |
| WP_049474547 | 982 | HHAHDAYLNAVIGKALLGVYPQL-EPEFVVGDYPHFH-G----HK----eNK ATAKK--F-FYSNIM-NFFKKD-- | 1041 |
| EMC03581 | 975 | HHAHDAYLNAVIGKALLGVYPQL-EPEFVVGDYPHFH-G----HK----eNK ATAKK--F-FYSNIM-NFFKKD-- | 1034 |
| WP_000428612 | 987 | HHAHDAYLNAVVAKAILKKYPKL-EPEFVVGDYQKYDL-SkdpKEI---EK ATAKY--F-FYSNLL-NFFKEEVH | 1058 |
| WP_000428613 | 985 | HHAHDAYLNAVVAKAILKKYPKL-EPEFVVGDYQKYDL-SrmpKEV---EK ATEKY--F-FYSNLL-NFFKEEVH | 1056 |
| WP_049523028 | 980 | HHAHDAYLNAVVGTALLKKYPDL-EAEFVVGDYKHYDL-TkdpKEI---EK ATEKY--F-FYSNLL-NFFKDKVY | 1051 |
| WP_003107102 | 951 | HHAHDAYLNAVVGTALLKKYPDL-EAEFVVGDYKHYDL-S----DTS1-GK ATAKM--F-FYSNIM-NFFKEEVH | 1020 |
| WP_054279288 | 983 | HHAHDAYLNAVVAKAILKKYPDL-ASEFVVGDYQKYDL-S----GKAs-GH ATAKY--F-FYSNIM-NFFKSEVK | 1052 |
| WP_049531101 | 985 | HHAHDAYLNAVVAKAILKKYPKL-EPEFVVGDYQKYDL-SrdpKEI---EK ATEKY--F-FYSNLL-NFFKEEVH | 1056 |
| WP_049538452 | 985 | HHAHDAYLNAVVAKAILKKYPKL-EPEFVVGDYQKYDL-S----HK----EK ATEKY--F-FYSNIM-NFFKEEVH | 1056 |
| WP_049549711 | 987 | HHAHDAYLNAVVAKAILKKYPKL-EPEFVVGDYQKNDL-SkdpKDI---EK ATEKY--F-FYSNLL-NFFKEEVH | 1058 |
| WP_007896501 | 988 | HHAHDAYLNAVVGTALLKKYPDL-EAEFVVGDYKHFDL-S----DPSl-GK ATAKV--F-FYSNLL-NFFKEELS | 1057 |
| EFR44625 | 940 | HHAHDAYLNAVVGTALLKKYPDL-EAEFVVGDYKHFDL-S----DPSl-GK ATAKV--F-FYSNLL-NFFKEELS | 1009 |
| WP_002897477 | 984 | HHAHDAYLNAVVAKAILKKYPKL-EPEFVVGDYQKYDL-FkpsKEI---DK ATEKY--F-FYSNLL-NFFKEEVL | 1055 |
| WP_002906454 | 985 | HHAHDAYLNAVVAKAILKKYPKL-EPEFVVGDYQKYDL-SkasNTI---DK ATEKY--F-FYSNLL-NFFKEKVR | 1056 |
| WP_009729476 | 984 | HHAHDAYLNAVVAKAILKKYPKL-EPEFVVGDYQKYDL-SkdpKEI---EK ATEKY--F-FYSNIM-NMFKTTIK | 1055 |
| CQR24647 | 985 | HHAHDAYLNAVLAKAILRYPKL-EPEFVVGDYQKYDL-S----YRE---RK ATEKM--F-FYSNLL-NFFKEEVH | 1046 |
| WP_000066813 | 989 | HHAHDAYLNAVVAKAILKKYPKL-EPEFVVGDYQKYDL-SrepKEV---EK ATQKY--F-FYSNLL-NFFKEEVH | 1060 |
| WP_009754323 | 985 | HHAHDAYLNAVVAKAILKKYPKL-EPEFVVGDYQKYDL-SkdpKEV---EK ATEKY--F-FYSNLL-NFFKEEVH | 1056 |
| WP_044674937 | 986 | HHAHDAYLNAVVATALLKKYPQL-APEFVVGDYPKYN-S----YKS---RK ATEKV--L-FYSNIM-NFFRRVLV | 1048 |
| WP_044676715 | 988 | HHAHDAYLNAVVATALLKKYPQL-APEFVVGDYPKYN-S----YKS---RK ATEKV--L-FYSNIM-NFFRRVLV | 1050 |
| WP_044680361 | 988 | HHAHDAYLNAVVATALLKKYPQL-APEFVVGDYPKYN-S----YKS---RK ATEKV--L-FYSNIM-NFFRRVLV | 1050 |
| WP_044681799 | 986 | HHAHDAYLNAVVATALLKKYPQL-APEFVVGDYPKYN-S----YKS---RK ATEKV--L-FYSNIM-NFFRRVLV | 1048 |
| WP_049533112 | 981 | HHAHDAYLNAVIGTALLKKYPDL-ASEFVVGEFKKDV-S----DK----eIG KATAK--YfFYSNLM-NFFRKKVK | 1050 |
| WP_029090905 | 952 | HHAQDAFLVAFLGTNITSNYPKI-EMEYLFKGIYQHYLN------Ev-GK AAKPKItF-IVENLS------- | 1007 |
| WP_006506696 | 977 | HHAHDAYIVALIGGFMRDRYPNMdSKAVYSEYMKMFR------g----QK----g---FVINSM-NYPY-EV- | 1038 |
| AIT42264 | 981 | HHAHDAYLNAVTALIKKYPKL-ESEFVVGDYKVYDV-S----EQEi--DK ATAKY--Y-FYSNIM-NFFKTEIT | 1051 |
| WP_034440723 | 982 | HHAHDAYLNGVIALKLLELYPYM-AKDLIYGKYSTHRK-G------NK---DK ATQAK--Y-KMSNI-ERFSQDL- | 1041 |
| AKQ21048 | 981 | HHAHDAYLNAVVGTALIKKYPKL-ESEFVVGDYKVYDV-S----EQEi--GK ATAKY--F-FYSNIM-NFFKTEIT | 1051 |
| WP_004636532 | 988 | HHGQDAYLNAVATTIMKYPNL-KPQFVVGQYKKTSM----FKE---EK ATARK--H-FYSNIT-KFFKKEKV | 1042 |
| WP_002364836 | 939 | HHGQDAYLNCVVATTLLKYPNL-APEFVVGEYPKFQT----FKE---NK ATAKA--I-IYTNLL-RFFTED-- | 1047 |
| WP_016631044 | 723 | HHGQDAYLNCVVATTLLKYPNL-APEFVVGEYPKFQT----FKE---NK ATAKA--I-IYTNLL-RFFTED-- | 998 |
| EMS75795 | 988 | HHAHDAYLNCVVATTLLKYPNL-APEFVVGEYPKFNL----AT----eNK ATAKA--E-FYSNIL-RFFEKE-- | 782 |
| WP_002373311 | 988 | HHGQDAYLNCVVATTLLKYPNL-APEFVVGEYPKFQA----FKE---NK ATAKT--I-IYTNLM-RFFTED-- | 1047 |
| WP_002378009 | 988 | HHGQDAYLNCVVATTLLKYPNL-APEFVVGEYPKFQT----FKE---NK ATAKA--I-IYTNLL-RFFTED-- | 1047 |
| WP_002407324 | 988 | HHGQDAYLNCVVATTLLKYPNL-APEFVVGEYPKFQT----FKE---NK ATAKA--I-IYTNLL-RFFTED-- | 1047 |
| WP_002413717 | 990 | HHGQDAYLNCVVATTLLKYPNL-APEFVVGEYPKFQT----FKE---NK ATAKT--I-IYTNLL-RFFTED-- | 1049 |
| WP_010775580 | 988 | HHGQDAYLNCVVATTLLKYPNL-APEFVVGEYPKFQT----FKE---NK ATAKA--I-IYTNLL-RFFTED-- | 1047 |
| WP_010818269 | 988 | HHGQDAYLNCVVATTLLKYPNL-APEFVVGEYPKFQT----FKE---NK ATAKA--I-IYTNLL-RFFTED-- | 1047 |
| WP_010824395 | 988 | HHGQDAYLNCVVATTLLKYPNL-APEFVVGEYPKFQT----FKE---NK ATAKT--I-IYTNLL-RFFTED-- | 1047 |
| WP_016622645 | 988 | HHGQDAYLNCVVATTLLKYPNL-APEFVVGEYPKFQT----FKE---NK AMAKA--I-IYTNLL-RFFTED-- | 1047 |
| WP_033624816 | 988 | HHGQDAYLNCVVATTLLKYPNL-APEFVVGEYPKFQA----FKE---NK ATAKA--I-IYTNLL-RFFTED-- | 1047 |
| WP_033625576 | 988 | HHGQDAYLNCVVATTLLKYPNL-APEFVVGEYPKFQA----FKE---NK ATAKA--I-IYTNLM-RFFTEV-- | 1047 |
| WP_033789179 | 988 | HHGQDAYLNCVVATTLLKYPNL-APEFVVGEYPKFQA----FKE---NK ATAKA--I-IYTNLL-RFFTED-- | 1047 |

-continued

| ID | Start | Sequence | End |
|---|---|---|---|
| WP_002310644 | 989 | HHAHDAYLNGVVALALLKKYPQL-APEFVVGEYLKFNA-----HK---aNK ATVKK--E-FYSNIM-KFFESD-- | 1048 |
| WP_002312694 | 990 | HHAHDAYLNGVVALALLKKYPQL-APEFVVGEYLKFNA-----HK---aNK ATVKK--E-FYSNIM-KFFESD-- | 1049 |
| WP_002314015 | 990 | HHAHDAYLNGVVALALLKKYPQL-APEFVVGEYLKFNA-----HK---aNK ATVKK--E-FYSNIM-KFFESD-- | 1049 |
| WP_002320716 | 990 | HHAHDAYLNGVVALALLKKYPQL-APEFVVGEYLKFNA-----HK---aNK ATVKK--E-FYSNIM-KFFESD-- | 1049 |
| WP_002330729 | 989 | HHAHDAYLNGVVALALLKKYPQL-APEFVVGEYLKFNA-----HK---aNK ATVKK--E-FYSNIM-KFFESD-- | 1048 |
| WP_002335161 | 990 | HHAHDAYLNGVVALALLKKYPQL-APEFVVGEYLKFNA-----HK---aNK ATVKK--E-FYSNIM-KFFESD-- | 1049 |
| WP_002345439 | 990 | HHAHDAYLNGVVALALLKKYPQL-APEFVVGEYLKFNA-----HK---aNK ATVKK--E-FYSNIM-KFFESD-- | 1049 |
| WP_034867970 | 980 | HHAHDAYLNGFIANVLLKRYPKL-APEFVVGKVVKYSL-----AR---aNK ATAKK--E-FYSNIL-KFLESD-- | 1039 |
| WP_047937432 | 990 | HHAHDAYLNGVIALALLKKYPKL-APEFVVGEYLKFNA-----HK---aNK ATAKK--E-FYSNIM-KFFESD-- | 1049 |
| WP_010720994 | 980 | HHAHDAYLNGFIANVLLKRYPKL-APEFVVGKVVKYSL-----AR---eNK ATAKK--E-FYSNIL-KFLESD-- | 1039 |
| WP_010737004 | 980 | HHAHDAYLNGFIANVLLKRYPKL-APEFVVGKVVKYSL-----AR---eNK ATAKK--E-FYSNIL-KFLESD-- | 1039 |
| WP_034700478 | 980 | HHAHDAYLNGFIANVLLKRYPKL-APEFVVGKVVKYSL-----AR---eNK ATAKK--E-FYSNIL-KFLESD-- | 1039 |
| WP_007209003 | 978 | HHAHDAYLNAVVALSLLRVYPQL-KPEFVVGEYGKNS------IHDg-NK ATIKK--E-qFYSNIT-RYFASK-- | 1037 |
| WP_023519017 | 974 | HHGHDAYLNGVVAMTLLKKYPKL-APEFVVGSYIKGDI-----NQ---iNK ATAKK--E-FYSNIM-KFFESE-- | 1033 |
| WP_010770040 | 986 | HHGHDAYLNGVVANSLLRVYPQL-QPEFVVGDYPKFNA-----YKA--NK ATAKK--Q-LYTNIM-KFFAED-- | 1045 |
| WP_048604708 | 983 | HHGHDAYLNGVVATALLKIYPQL-APEFVVGEFHRFNA-----FKE--NK ATAKK--E-FYSNLM-EFSKSD-- | 1042 |
| WP_010750235 | 983 | HHAHDAYLNAVVALALLKKYPRL-APEFVVGSFAKFHL-----VK---eNK ATAKK--E-FYSNIL-KFFEKE-- | 1042 |
| AII16583 | 1021 | HHAHDAYLNAVVGTALIKKYPKL-ESEFVVGDYKVYDV s---EQEi-GK ATAKY--F-FYSNIM-NFFKTEIT | 1090 |
| WP_029073316 | 988 | HHAHDAYIATILGTYIGHRPESL-DAKYIYGEYQKIFR-----NKNk-DK ---KDg--FILNSM-RNLYADK- | 1052 |
| WP_031589969 | 988 | HHAHDAYIATILGTYIGHRPESL-DAKYIYGEYKRIFR-----QKNk-GK ---NDg--FILNSM-RNIYADK- | 1052 |
| KDA45870 | 973 | HHAHDAYLNAVVANLIMAKYPEL-EPEFVVGKYRKTK------FKG1-GK ATAKN--tLYANVL-YFLKENEV | 1034 |
| WP_039099354 | 991 | HHAFDAYLTAFVGLYLLKRYPKL-KPYFVVGEYOKAS------QQ---DK ---RN---F---NFL-NGLKKD-- | 1043 |
| AKP02966 | 1000 | HHAQDAYLASFLGTYRLRRFPTD-EMLLMNGEYNKFYG-----KElysKK -SRKN-gF-IISPLV------- | 1062 |
| WP_010991369 | 985 | HHAHDAYLNGVVANTLLKYPQL-EPEFVVGDYHQFDW-----FKA--NK ATAKK--Q-FYTNIM-LFFAQK-- | 1044 |
| WP_033838504 | 985 | HHAHDAYLNGVVANTLLKYPQL-EPEFVVGDYHQFDW-----FKA--NK ATAKK--Q-FYTNIM-LFFAQK-- | 1044 |
| EHN60060 | 988 | HHAHDAYLNGVVANTLLKYPQL-EPEFVVGDYHQFDW-----FKA--NK ATAKK--Q-FYTNIM-LFFAQK-- | 1047 |
| EFR89594 | 754 | HHAHDAYLNGVVANTLLKYPQL-EPEFVVGDYHQFDW-----FKA--NK ATAKK--Q-FYTNIM-LFFAQK-- | 813 |
| WP_038409211 | 985 | HHAHDAYLNGVVANTLLKYPQL-EPEFVVGDYHQFDW-----FKA--NK ATAKK--Q-FYTNIM-LFFAQK-- | 1044 |
| EFR95520 | 604 | HHAHDAYLNGVVANTLLKYPQL-EPEFVVGDYHQFDW-----FKA--NK ATAKK--Q-FYTNIM-RFFAKE-- | 663 |
| WP_003723650 | 985 | HHAHDAYLNGVVANTLLKYPQL-EPEFVVGDYHQFDW-----FKA--NK ATAKK--Q-FYTNIM-LFFAQK-- | 1044 |
| WP_003727705 | 985 | HHAHDAYLNGVVANTLLKYPQL-EPEFVVGDYHQFDW-----FKA--NK ATAKK--Q-FYTNIM-LFFAQK-- | 1044 |
| WP_003730785 | 985 | HHAHDAYLNGVVANTLLKYPQL-EPEFVVGDYHQFDW-----FKA--NK ATAKK--Q-FYTNIM-LFFAQK-- | 1044 |
| WP_003733029 | 988 | HHAHDAYLNGVVANTLLKYPQL-EPEFVVGEYHQFGW-----FKA--NK ATAKK--Q-FYTNIM-LFFAQK-- | 1047 |
| WP_003739838 | 985 | HHAHDAYLNGVVANTLLKYPQL-EPEFVVGEYHQFDW-----FKA--NK ATAKK--Q-FYTNIM-LFFAQK-- | 1044 |
| WP_014601172 | 985 | HHAHDAYLNGVVANTLLKYPQL-EPEFVVGEYHQFDW-----FKA--NK ATAKK--Q-FYTNIM-LFFGQK-- | 1044 |
| WP_023548323 | 985 | HHAHDAYLNGVVANTLLKYPQL-EPEFVVGEYHQFDW-----FKA--NK ATAKK--Q-FYTNIM-LFFAQK-- | 1044 |
| WP_031665337 | 985 | HHAHDAYLNGVVANTLLKYPQL-EPEFVVGEYHQFDW-----FKA--NK ATAKK--Q-FYTNIM-LFFAQK-- | 1044 |
| WP_031669209 | 985 | HHAHDAYLNGVVANTLLKYPQL-EPEFVVGEYHQFDW-----FKA--NK ATAKK--Q-FYTNIM-LFFAQK-- | 1044 |
| WP_033920898 | 985 | HHAHDAYLNGVVANTLLKYPQL-EPEFVVGEYHQFDW-----FKA--NK ATAKK--Q-FYTNIM-LFFGQK-- | 1044 |
| AKI42028 | 988 | HHAHDAYLNGVVANTLLKYPQL-EPEFVVGEYHQFDW-----FKA--NK ATAKK--Q-FYTNIM-LFFAQK-- | 1047 |
| AKI50529 | 988 | HHAHDAYLNGVVANTLLKYPQL-EPEFVVGEYHQFDW-----FKA--NK ATAKK--Q-FYTNIM-LFFAQK-- | 1047 |
| EFR83390 | 433 | HHAHDAYLNCVVANTLLKYPQL-EPEFVVGDYHQFDW-----FKA--NK ATAKK--Q-FYTNIM-LFFAKK-- | 492 |
| WP_046323366 | 985 | HHAHDAYLNGVVANTLLKYPQL-ESEFVVGDYKVYDV S---EQEi-GK ATAKY--F-FYTNIM-NFFKTEIT | 1044 |
| AKE81011 | 998 | HHAHDAYIVALIGGFMRDRYPNMdSKAVYSEYMKMFR------g----g-FVINSM-NYPY-EV- | 1067 |
| CUO82355 | 981 | HHAHDAYIACIVGQFMHQNFEHL-DAKIIYGEYGQYK------KNy--KK ---NYg--FILNSM-NHLQSDI- | 1042 |
| WP_033162887 | 983 | HHAHDAYLNAVVGTALIKKYPKL-ESEFVVGDYKVYDV---KNy--KK ---NYg--FILNSM-NHLQSDI- | 1042 |
| AGZ01981 | 1015 | HHAHDAYLNAVVGTALIKKYPKL-ESEFVVGDYKVYDV S---EQEi-GK ATAKY--F-FYSNIM-NFFKTEIT | 1084 |

| | | | |
|---|---|---|---|
| AKA60242 | 982 | HHAHDAYLNAVVGTALIKYPKL-ESEFYYGDYKYDV S---EQEi--GK ATAKY--F-FYSNIM-NFFKTEIT | 1051 |
| AKS40380 | 982 | HHAHDAYLNAVVGTALIKYPKL-ESEFYYGDYKYDV S---EQEi--GK ATAKY--F-FYSNIM-NFFKTEIT | 1051 |
| 4UN5_B | 986 | HHAHDAYLNAVVGTALIKYPKL-ESEFYYGDYKYDV S---EQEi--GK ATAKY--F-FYSNIM-NFFKTEIT | 1055 |
| 5AXW_A | 1052 | LAN-GEIRKRPLIE TNGET-GE-IWDKGRDFATVRKVLS-MPQVNIVKKTEVQT GGFSK ESIL-PKR- | 1114 |
| WP_010922251 | | | |
| WP_039695303 | 1059 | YAD-GTVFERPIIE T-NAD-GE-IAWNKQIDFEKVRKVLS-YPQVNIVKKVETQT GGFSK ESIL-PKG- | 1120 |
| WP_045635197 | 1056 | YAD-GTIVKRENIE Y-SKDtGE-IAWNKEKDFAIIKKVLS-LPQVNIVKKREVQT GGFSK ESIL-PKG- | 1118 |
| WP_009880683 | 772 | YKYsHRVDKKPNRE VNNLN-GL---YDKDND--KLKKLINkSPEKLLMYHHDPQT --YQK KLIMeQYGd | 852 |
| WP_010922251 | 736 | LAN-GEIRKRPLIE TNGET-GE-IVWDKGRDFATVRKVLS-MPQVNIVKKTEVQT GGFSK ESIL-PKR- | 798 |
| WP_011054416 | 1052 | LAN-GEIRKRPLIE TNGET-GE-IVWDKGRDFATVRKVLS-MPQVNIVKKTEVQT GGFSK ESIL-PKR- | 1114 |
| WP_011284745 | 1052 | LAN-GEIRKRPLIE TNGET-GE-IVWDKGRDFATVRKVLS-MPQVNIVKKTEVQT GGFSK ESIL-PKR- | 1114 |
| WP_011285506 | 1052 | LAN-GEIRKRPLIE TNGET-GE-IVWDKGRDFATVRKVLS-MPQVNIVKKTEVQT GGFSK ESIL-PKR- | 1114 |
| WP_011527619 | 1052 | LAN-GEIRKRPLIE TNGET-GE-IVWDKGRDFATVRKVLS-MPQVNIVKKTEVQT GGFSK ESIL-PKR- | 1114 |
| WP_012560673 | 1052 | LAN-GEIRKRPLIE TNGET-GE-IVWDKGRDFATVRKVLS-MPQVNIVKKTEVQT GGFSK ESIL-PKR- | 1114 |
| WP_014407541 | 1051 | LAN-GEIRKRPLIE TNGET-GE-IVWDKGRDFATVRKVLS-MPQVNIVKKTEVQT GGFSK ESIL-PKR- | 1113 |
| WP_020905136 | 1052 | LAN-GEIRKRPLIE TNGET-GE-IVWDKGRDFATVRKVLS-MPQVNIVKKTEVQT GGFSK ESIL-PKR- | 1114 |
| WP_023080005 | 1051 | LAN-GEIRKRPLIE TNGET-GE-IVWDKGRDFATVRKVLS-MPQVNIVKKTEVQT GGFSK ESIL-PKR- | 1113 |
| WP_023610282 | 1051 | LAN-GEIRKRPLIE TNGET-GE-IVWDKGRDFATVRKVLS-MPQVNIVKKTEVQT GGFSK ESIL-PKR- | 1113 |
| WP_030125963 | 1052 | LAN-GEIRKRPLIE TNGET-GE-IVWDKGRDFATVRKVLS-MPQVNIVKKTEVQT GGFSK ESIL-PKR- | 1114 |
| WP_030126706 | 1052 | LAN-GEIRKRPLIE TNGET-GE-IVWDKGRDFATVRKVLS-MPQVNIVKKTEVQT GGFSK ESIL-PKR- | 1114 |
| WP_031488318 | 1052 | LAN-GEIRKRPLIE TNGET-GE-IVWDKGRDFATVRKVLS-MPQVNIVKKTEVQT GGFSK ESIL-PKR- | 1114 |
| WP_032460140 | 1052 | LAN-GEIRKRPLIE TNGET-GE-IVWDKGRDFATVRKVLS-MPQVNIVKKTEVQT GGFSK ESIL-PKR- | 1114 |
| WP_032461047 | 1052 | LAN-GEIRKRPLIE TNGET-GE-IVWDKGRDFATVRKVLS-MPQVNIVKKTEVQT GGFSK ESIL-PKR- | 1114 |
| WP_032462016 | 1052 | LAN-GEIRKRPLIE TNGET-GE-IVWDKGRDFATVRKVLS-MPQVNIVKKTEVQT GGFSK ESIL-PKR- | 1114 |
| WP_032462936 | 1052 | LAN-GEIRKRPLIE TNGET-GE-IVWDKGRDFATVRKVLS-MPQVNIVKKTEVQT GGFSK ESIL-PKR- | 1114 |
| WP_032464890 | 877 | LAN-GEIRKRPLIE TNGET-GE-IVWDKGRDFATVRKVLS-MPQVNIVKKTEVQT GGFSK ESIL-PKR- | 939 |
| WP_033888930 | 1052 | LAN-GEIRKRPLIE TNGET-GE-IVWDKGRDFATVRKVLS-MPQVNIVKKTEVQT GGFSK ESIL-PKR- | 1114 |
| WP_038431314 | 1051 | LAN-GEIRKRPLIE TNGET-GE-IVWDKGRDFATVRKVLS-MPQVNIVKKTEVQT GGFSK ESIL-PKR- | 1113 |
| WP_038432938 | 1052 | LAN-GEIRKRPLIE TNGET-GE-IVWDKGRDFATVRKVLS-MPQVNIVKKTEVQT GGFSK ESIL-PKR- | 1114 |
| WP_038434062 | 963 | LAN-GEIRKRPLIE TNGET-GE-IVWDKGRDFATVRKVLS-MPQVNIVKKTEVQT GGFSK ESIL-PKR- | 1025 |
| BAQ51233 | 227 | LAN-GEIRKRPLIE TNGET-GE-IVWDKGRDFATVRKVLS-MPQVNIVKKTEVQT GGFSK ESIL-PKR- | 289 |
| KGE60162 | 1 | --------IE TNGET-GE-IVWDKGRDFATVRKVLS-MPQVNIVKKTEVQT GGFSK ESIL-PKR- | 52 |
| KGE60856 | 1052 | LAN-GEIRKRPLIE TNGET-GE-IVWDKGRDFATVRKVLS-MPQVNIVKKTEVQT GGFSK ESIL-PKR- | 1114 |
| WP_002989955 | 1042 | --------DIQ T-NED-GE-IAWNKEKHIKILRKVLS-YPQVNIVKKTEBQT GGFSK ESIL-PKG- | 1093 |
| WP_003030002 | 1059 | YSN-GKVIVRPVVE Y-SKD-TEqIAWDKKSNFRTICKVLS-YPQVNIVKKVETQT GGFSK ESIL-PKG- | 1121 |
| WP_003065552 | 1050 | LAD-GTVVVKDDIE VNNDT-GE-IVWDKKKHFATVRKVLS-YPQNNIVKKTEIQT GGFSK ESIL-AHG- | 1112 |
| WP_001040076 | 1058 | LAD-GSIVVRPVIE TGRYM-GK-TAWDKKKHFATVRKVLS-YPQNNIVKKTEIQT GGFSK ESIL-AHG- | 1120 |
| WP_001040078 | 1050 | LAD-GTVVVKDDIE VNNDT-GE-IVWDKKKHFATVRKVLS-YPQNNIVKKTEIQT GGFSK ESIL-AHG- | 1112 |
| WP_001040080 | 1050 | LAD-GTVVVKDDIE VNNDT-GE-IVWDKKKHFATVRKVLS-YPQNNIVKKTEIQT GGFSK ESIL-AHG- | 1112 |
| WP_001040081 | 1050 | LAD-GTVVVKDDIE VNNDT-GE-IAWDKKKHFATVRKVLS-YPQNNIVKKTEIQT GGFSK ESIL-AHS- | 1112 |
| WP_001040083 | 1050 | LAD-GTVVVKDDIE VNNET-GE-IVWDKKKHFATVRKVLS-YPQNNIVKKTEIQT GGFSK ESIL-AHG- | 1112 |
| WP_001040085 | 1050 | LAD-ETVVVKDDIE VNNDT-GE-IVWDKKKHFATVRKVLS-YPQNNIVKKTEIQT GGFSK ESIL-AHS- | 1112 |
| WP_001040087 | 1050 | LAD-GTVVVKDDIE VNNDT-GE-IVWDKKKHFATVRKVLS-YPQNNIVKKTEIQT GGFSK ESIL-AHG- | 1112 |
| WP_001040088 | 1050 | LAD-GTVVVKDDIE VNNDT-GE-IVWDKKKHFATVRKVLS-YPQNNIVKKTEIQT GGFSK ESIL-AHG- | 1112 |
| WP_001040089 | 1050 | LAD-GTVVVKDDIE VNNDT-GE-IVWDKKKHFATVRKVLS-YPQNNIVKKTEIQT GGFSK ESIL-AHG- | 1112 |
| WP_001040090 | 1050 | LAD-GTVVVKDDIE VNNDT-GE-IVWDKKKHFATVRKVLS-YPQNNIVKKTEIQT GGFSK ESIL-AHG- | 1112 |
| WP_001040091 | 1050 | LAD-GTVVVKDDIE VNNDT-GE-IVWDKKKHFATVRKVLS-YPQNNIVKKTEIQT GGFSK ESIL-AHG- | 1112 |
| WP_001040092 | 1050 | LAD-GTVVVKDDIE VNNDT-GE-IVWDKKKHFATVRKVLS-YPQNNIVKKTEIQT GGFSK ESIL-AHG- | 1112 |
| WP_001040094 | 1050 | LAD-GTVVVKDDIE VNNDT-GE-IVWDKKKHFATVRKVLS-YPQNNIVKKTEIQT GGFSK ESIL-AHG- | 1112 |
| WP_001040095 | 1050 | LAD-GTVVVKDDIE VNNDT-GE-IVWDKKKHFATVRKVLS-YPQNNIVKKTEIQT GGFSK ESIL-AHG- | 1112 |
| WP_001040096 | 1050 | LAD-GTVVVKDDIE VNNDT-GE-IVWDKKKHFATVRKVLS-YPQNNIVKKTEIQT GGFSK ESIL-AHG- | 1112 |
| WP_001040097 | 1050 | LAD-GTVVVKDDIE VNNDT-GE-IVWDKKKHFATVRKVLS-YPQNNIVKKTEIQT GGFSK ESIL-AHG- | 1112 |

-continued

| ID | Start | Sequence | End |
|---|---|---|---|
| WP_001040098 | 1050 | LAD-GTVVVKDDIE VNNDT-GE-IVWDKKKHFATVRKVLS-YPQVNIVKKTEIQT GGFSK ESIL-AHG- | 1112 |
| WP_001040099 | 1050 | LAD-GTVVVKDDIE VNNDT-GE-IVWDKKKHFATVRKVLS-YPQVNIVKKTEIQT GGFSK ESIL-AHG- | 1112 |
| WP_001040100 | 1050 | LAD-GTVVVKDDIE VNNDT-GE-IVWDKKKHFATVRKVLS-YPQVNIVKKTEIQT GGFSK ESIL-AHG- | 1112 |
| WP_001040104 | 1050 | LAD-GTVVVKDDIE VNNDT-GE-IVWDKKKHFATVRKVLS-YPQVNIVKKTEIQT GGFSK ESIL-AHG- | 1112 |
| WP_001040105 | 1050 | LAD-GTVVVKDDIE VNNDT-GE-IVWDKKKHFATVRKVLS-YPQNNIVKKTEIQT GGFSK ESIL-AHG- | 1112 |
| WP_001040106 | 1050 | LAD-GTVVVKDDIE VNNDT-GE-IVWDKKKHFATVRKVLS-YPQNNIVKKTEIQT GGFSK ESIL-AHG- | 1112 |
| WP_001040107 | 1050 | LAD-GTVVVKDDIE VNNDT-GE-IVWDKKKHFATVRKVLS-YPQVNIVKKTEIQT GGFSK ESIL-AHG- | 1112 |
| WP_001040108 | 1050 | LAD-GTVVVKDDIE VNNDT-GE-IVWDKKKHFATVRKVLS-YPQVNIVKKTEIQT GGFSK ESIL-AHG- | 1112 |
| WP_001040109 | 1050 | LAD-GTVVVKDDIE VNNDT-GE-IVWDKKKHFATVRKVLS-YPQVNIVKKTEIQT GGFSK ESIL-AHG- | 1112 |
| WP_001040110 | 1050 | LAD-ETVVVKDDIE VNNET-GE-IAWDKKKHFATVRKVLS-YPQNNIVKKTEIQT GGFSK ESIL-AHS- | 1112 |
| WP_015058523 | 1050 | LAD-GTVVVKDDIE VNNDT-GE-IVWDKKKHFATVRKVLS-YPQVNIVKKTEIQT GGFSK ESIL-AHG- | 1112 |
| WP_017643650 | 1050 | LAD-GTVVVKDDIE VNNET-GE-IVWDKKKHFATVRKVLS-YPQVNIVKKTEVQT GGFSK ESIL-AHG- | 1112 |
| WP_017647151 | 1050 | LAD-GTVVVKDDIE VNNDT-GE-IVWDKKKHFATVRKVLS-YPQNNIVKKTEIQT GGFSK ESIL-AHG- | 1112 |
| WP_017648376 | 1050 | LAD-GTVVVKDDIE VNNDT-GE-IVWDKKKHFATVRKVLS-YPQNNIVKKTEIQT GGFSK ESIL-AHG- | 1112 |
| WP_017649527 | 1050 | LAD-GTVVVKDDIE VNNDT-GE-IVWDKKKHFATVRKVLS-YPQVNIVKKTEIQT GGFSK ESIL-AHG- | 1112 |
| WP_017771611 | 1050 | LAD-GTVVVKDDIE VNNDT-GE-IVWDKKKHFATVRKVLS-YPQVNIVKKTEIQT GGFSK ESIL-AHG- | 1112 |
| WP_017771984 | 1050 | LAD-GTVVVKDDIE VNNDT-GE-IVWDKKKHFATVRKVLS-YPQVNIVKKTEIQT GGFSK ESIL-AHG- | 1112 |
| CFQ25032 | 1050 | LAD-GTVVVKDDIE VNNDT-GE-IVWDKKKHFATVRKVLS-YPQVNIVKKTEIQT GGFSK ESIL-AHG- | 1112 |
| CFV16040 | 1050 | LAD-GTVVVKDDIE VNNDT-GE-IVWDKKKHFATVRKVLS-YPQNNIVKKTEIQT GGFSK ESIL-AHG- | 1112 |
| KLJ37842 | 1064 | LAD-GTVVVKDDIE VNNDT-GE-IAWDKKKHFATVRKVLS-YPQNNIVKKTEIQT GGFSK ESIL-AHG- | 1126 |
| KLJ72361 | 1050 | LAD-GTVVVKDDIE VNNDT-GE-IVWDKKKHFATVRKVLS-YPQVNIVKKTEIQT GGFSK ESIL-AHG- | 1112 |
| KLL20707 | 1050 | LAD-GTVVVKDDIE VNNDT-GE-IVWDKKKHFATVRKVLS-YPQVNIVKKTEIQT GGFSK ESIL-AHG- | 1112 |
| KLL42645 | 1050 | LAD-GTVVVKDDIE VNNDT-GE-IVWDKKKHFATVRKVLS-YPQNNIVKKTEIQT GGFSK ESIL-AHG- | 1112 |
| WP_047207273 | 1050 | LAD-GTVVIKDDIE VNNDT-GE-IVWDKKKHFATVRKVLS-YPQNNIVKKTEIQT GGFSK ESIL-AHG- | 1112 |
| WP_047209694 | 1050 | LAD-GTVVVKDDIE VNNDT-GE-IVWDKKKHFATVRKVLS-YPQNNIVKKTEIQT GGFSK ESIL-AHG- | 1112 |
| WP_050198062 | 1050 | LAD-GTVVVKDDIE VNNDT-GE-IVWDKKKHFATVRKVLS-YPQVNIVKKTEIQT GGFSK ESIL-AHG- | 1112 |
| WP_050201642 | 1050 | LAD-GTVVVKDDIE VNNDT-GE-IVWDKKKHFATVRKVLS-YPQNNIVKKTEIQT GGFSK ESIL-AHG- | 1112 |
| WP_050204027 | 1050 | LAD-GTVVVKDDIE VNNDT-GE-IVWDKKKHFATVRKVLS-YPQNNIVKKTEIQT GGFSK ESIL-AHG- | 1112 |
| WP_050881965 | 1050 | LAD-GTVVVKDDIE VNNDT-GE-IVWDKKKHFATVRKVLS-YPQNNIVKKTEIQT GGFSK ESIL-AHG- | 1112 |
| WP_050886065 | 1050 | LAD-ETVVVKDDIE VNNDT-GE-IVWDKKKHFATVRKVLS-YPQNNIVKKTEIQT GGFSK ESIL-AHG- | 1112 |
| AHN30376 | 1050 | LAD-GTVVVKDDIE VNNET-GE-IAWDKKKHFATVRKVLS-YPQNNIVKKTEIQT GGFSK ESIL-AHS- | 1112 |
| EAO78426 | 1050 | LAD-GTVVVKDDIE VNNDT-GE-IVWDKKKHFATVRKVLS-YPQNNIVKKTEIQT GGFSK ESIL-AHG- | 1112 |
| CCW42055 | 1050 | LAD-GTVVVKDDIE VNNDT-GE-IVWDKKKHFATVRKVLS-YPQNNIVKKTEIQT GGFSK ESIL-AHG- | 1112 |
| WP_003041502 | 1051 | FAD-GTVVERPDIE T-SED-GE-IAWNKQTDFKIVRKVLS-YPQVNIVKKTEBQT HGLDR PSPK-PKP- | 1122 |
| WP_037593752 | 1043 | ------DIQ T-NED-GE-IAWNKEKHIKILRKVLS-YPQVNIVKKTEBQT GGFSK ESIL-PKG- | 1094 |
| WP_049516684 | 1043 | ------DIQ T-NED-GE-IAWNNEKHIKILRKVLS-YPQVNIVKKTEBQT GGFSK ESIL-PKG- | 1094 |
| GAD46167 | 1063 | YSN-GKVIVRPVVE Y-SKDtGE-IAWNKEKDFATVRKVLA-MPQVNIVKKTEVQT GGFSK ESIL-PKG- | 1125 |
| WP_018363470 | 1061 | LAN-GEIRKRPLIE TNGET-GE-VVWNKEKDFATVRKVLS-YPQVNIVKKTEVQT GGFSK ESIL-SKR- | 1123 |
| WP_003043819 | 1042 | ------DIQ T-NED-GE-IAWNKEKHIKILRKVLS-YPQVNIVKKTEVQT GGFSK ESIL-PKG- | 1093 |
| WP_066269658 | 1052 | FAD-GTVVERPDIE T-SED-GE-IAWNKEKDFATVRKVLS-YPQVNIVKKVEKQT GRFSK ESIL-PKG- | 1113 |
| WP_048800889 | 1051 | LAN-GEIRKRPLIE TNEET-GE-IVWDKGRDFATVRKVLS-MPQVNIVKKTEVQT GALTN ESIY-ARG- | 1113 |
| WP_012767106 | 1051 | LAN-GEIRKRPLIE TNEET-GE-IVWDKGRDFATVRKVLS-MPQVNIVKKTEVQT GALTN ESIY-ARG- | 1113 |
| WP_014612333 | 1051 | LAN-GEIRKRPLIE TNEET-GE-IVWNKGRDFATVRKVLS-MPQVNIVKKTEVQT GALTN ESIY-ARG- | 1113 |
| WP_015017095 | 1051 | LAN-GEIRKRPLIE TNEET-GE-IVWDKGRDFATVRKVLS-IPQVNIVKKTEVQT GALTN ESIY-ARG- | 1113 |
| WP_015057649 | 1051 | LAN-GEIRKRPLIE TNEET-GE-IVWNKGRDFATVRKVLS-MPQVNIVKKTEVQT GALTN ESIY-ARG- | 1113 |
| WP_048327215 | 1051 | LAN-GEIRKRPLIE TNEET-GE-IVWDKGRDFATVRKVLS-IPQVNIVKKTEVQT GALTN ESIY-ARG- | 1113 |
| WP_049519324 | 1044 | L------H VNSD--GE-EIWNANKHLPIIKNVLS-IPQVNIVKKTEVQT GGFYK ESIL-SKG- | 1094 |
| WP_012515931 | 1044 | L------H VNSD--GE-EIWNANKHLPIIKNVLS-IPQVNIVKKTEVQT GGFYK ESIL-SKG- | 1094 |
| WP_021320964 | 1044 | L------H VNSD--GE-EIWNNANKHLPIIKNVLS-IPQVNIVKKTEVQT GGFYK ESIL-SKG- | 1094 |
| WP_037581760 | 1044 | L------H VNSD--GE-EIWNNANKHLPIIKNVLS-IPQVNIVKKTEVQT GALTN ESIL-SKG- | 1094 |
| WP_004232481 | 1062 | YAD-GRVFERPDIE T-NAD-GE-IAWNKQRDFNIVRKVLS-YPQVNIVKKTEVQT GGFSK ESIY-ARG- | 1123 |
| WP_099854540 | 1057 | YAD-GTVFERPVIE T-NAD-GE-IAWNKQIDFEKVRKVLS-YPQVNIVKKVETQT GGFSK ESIL-SKG- | 1118 |
| WP_012962174 | 1057 | YSN-GKVVVRPVIE C-SKDtGE-IAWNKQTDFEKVRRVLS-YPQVNIVKKVETQT GGFSK ESIL-PKG- | 1119 |

```
WP_039695303  1059  YAD-GTVFERPIIE  T-NAD-GE-IAWNKQIDFEKVRKVLS-YPQVNIVKKVETQT  GGFSK  ESIL-PKG-  1120
WP_014334983  1062  YAD-GRVFERPDIE  T-NAD-GE-VVWNKQKDFDIVRKVLS-YPQVNIVKKVEAQT  GGFSK  ESIL-SKG-  1123
WP_003099269  1052  LAD-DTIFTRPQIE  VNTET-GE-IWDKVKDMQTIRKVMS-YPQVNIVMKTEVQT  GGFSK  ESIW-PKG-  1114
AHY15608      1052  LAD-DTIFTRPQIE  VNTET-GE-IWDKVKDMQTIRKVMS-YPQVNIVMKTEVQT  GGFSK  ESIW-PKG-  1114
AHY17476      1052  LAD-DTIFTRPQIE  VNTET-GE-IWDKVKDMQTIRKVMS-YPQVNIVMKTEVQT  GGFSK  ESIW-PKG-  1114
ESR09100      ----  --------------  ----------------------------------------  -----  ---------  ----
AGM98575      1052  LAD-DTIFTRPQIE  VNTET-GE-IVWDKVKDMQTIRKVMS-YPQVNIVMKTEVQT  GGFSK  ESIW-PKG-  1114
ALF27331      1042  ---------DVR    T-DKN-GE-IIWKKDEHISNIKKVLS-YPQVNIVKKVEEQT  GGFSK  ESIL-PKG-  1093
WP_018372492  1056  --K------K      IVWDKKEIENIVKKVIY-SSPVNIVKKREEQS         GALFK  QSNM-AVGy  1108
WP_045618028  1057  YAD-GTIVKRENIE  Y-SKDtGE-IAWNKEKDFATIKKVLS-LPQVNIVKKTEEQT  GGLFD  NNIV-SKKk  1124
WP_045635197  1056  YAD-GTIVKRENIE  Y-SKDtGE-IAWNKEKDFAIIKKVLS-YPQVNIVKKVEEQT  GGFSK  ESIL-PKG-  1118
WP_002263549  1042  ---------DVR    T-DKN-GE-IIWKKDEHISNIKKVLS-YPQVNIVKKVEEQT  GGFSK  ESIL-PKG-  1093
WP_002263887  1042  ---------DVR    T-DKN-GE-IIWKKDEHISNIKKVLS-YPQVNIVKKVEEQT  GGFSK  ESIL-PKG-  1093
WP_002264920  1042  ---------DVR    T-DKN-GE-IIWKKDEHISNIKKVLS-YPQVNIVKKVEEQT  GGFSK  ESIL-PKG-  1093
WP_002269043  1042  ---------DVR    T-DKN-GE-IIWKKDEHISNIKKVLS-YPQVNIVKKVEEQT  GGFSK  ESIL-PKG-  1093
WP_002269448  1042  ---------DVR    T-DKN-GE-IIWKKDEHISNIKKVLS-YPQVNIVKKVEEQT  GGFSK  ESIL-PKG-  1093
WP_002271977  1042  ---------DVR    T-DKN-GE-IIWKKDEHISNIKKVLS-YPQVNIVKKVEEQT  GGFSK  ESIL-PKG-  1093
WP_002272766  1042  ---------DVR    T-DKN-GE-IIWKKDEHISNIKKVLS-YPQVNIVKKVEEQT  GGFSK  ESIL-PKG-  1093
WP_002273241  1042  ---------DVR    T-DKN-GE-IIWKKDEHISNIKKVLS-YPQVNIVKKVEEQT  GGFSK  ESIL-PKG-  1093
WP_002275430  1042  ---------DVR    T-DKN-GE-IIWKKDEHISNIKKVLS-YPQVNIVKKVEEQT  GGFSK  ESIL-PKG-  1093
WP_002276448  1042  ---------DRN    T-DRN-GE-IAWDKTKHITTVKKVLS-YPQVNIVKKVEEQT  GGLFD  ----PKS-   1093
WP_002277050  1047  LAD-DQIVERPMIE  VNDET-GE-IIWKKDEHISNIKKVLS-YPQVNIVKKVEEQT  GGFSK  ESIL-PKG-  1111
WP_002277364  1042  ---------DVR    T-DKN-GE-IIWKKDEHISNIKKVLS-YPQVNIVKKVEEQT  GGFSK  ESIL-PKG-  1093
WP_002279025  1042  ---------DVR    T-DKN-GE-IIWKKDEHISNIKKVLS-YPQVNIVKKVEEQT  GGFSK  ESIL-PKG-  1093
WP_002279859  1042  ---------DVR    T-DKN-GE-IIWKKDEHISNIKKVLS-YPQVNIVKKVEEQT  GGFSK  ESIL-PKG-  1093
WP_002280230  1042  ---------DVR    T-DKN-GE-IIWKKDEYISNIKKVLS-YPQVNIVKKVEEQT  GGFSK  ESIL-PKG-  1093
WP_002281696  1042  ---------DVR    T-DKN-GE-IIWKKDEHISNIKKVLS-YPQVNIVKKVEEQT  GGFSK  ESIL-PKG-  1093
WP_002282247  1047  LAD-DQIVERPMIE  VNDET-GE-IAWDKTKHITTVKKVLS-YPQVNIVKKVEEQT  GGLFD  ----PKS-   1111
WP_002282906  1042  ---------DVR    I-DKN-GE-IIWKKDEHISNIKKVLS-YPQVNIVKKVEEQT  GGFSK  ESIL-PKG-  1093
WP_002283846  1042  ---------DVR    T-DKN-GE-IIWKKDEHISNIKKVLS-YPQVNIVKKVEEQT  GGFSK  ESIL-PKG-  1093
WP_002287255  1042  ---------DVR    T-DKN-GE-IIWKKDEHISNIKKVLS-YPQVNIVKKVEEQT  GGFSK  ESIL-PKG-  1093
WP_002288990  1042  ---------DVR    T-DKN-GE-IIWKKDEHISNIKKVLS-YPQVNIVKKVEEQT  GGFSK  ESIL-PKG-  1093
WP_002289641  1042  ---------DVR    T-DKN-GE-IIWKKDEHISNIKKVLS-YPQVNIVKKVEEQT  GGFSK  ESIL-PKG-  1093
WP_002290427  1042  ---------DVR    T-DKN-GE-IIWKKDEHISNIKKVLS-YPQVNIVKKVEEQT  GGFFK  ESIL-PKG-  1093
WP_002295753  1042  ---------DVR    T-DKN-GE-IIWKKDEYISNIKKVLS-YPQVNIVKKVEEQT  GGFSK  ESIL-PKG-  1093
WP_002296423  1042  ---------DVR    T-DKN-GE-IIWKKDEHISNIKKVLS-YPQVNIVKKVEEQT  GGFFK  ESIL-PKG-  1093
WP_002304487  1056  ---------DVR    T-DKN-GE-IIWKKDEYISNIKKVLS-YPQVNIVKKVEEQT  GGFSK  ESIL-PKG-  1107
WP_002305844  1042  ---------DVR    T-DKN-GE-IIWKKDEYISNIKKVLS-YPQVNIVKKVEEQT  GGFSK  ESIL-PKG-  1093
WP_023072203  1042  ---------DVR    T-DKN-GE-IIWKKDEHISNIKKVLS-YPQVNIVKKVEEQT  GGFSK  ESIL-PKG-  1093
WP_023103390  1042  ---------DVR    T-DKN-GE-IIWKKDEYISNIKKVLS-YPQVNIVKKVEEQT  GGFSK  ESIL-PKG-  1093
WP_023352408  1042  ---------DVR    T-DKN-GE-IIWKKDEHISNIKKVLS-YPQVNIVKKVEEQT  GGFSK  ESIL-PKG-  1093
WP_012997688  1042  ---------DVR    T-DKN-GE-IIWKKDEHISNIKKVLS-YPQVNIVKKVEEQT  GGFSK  ESIL-PKG-  1093
WP_014677909  1042  ---------DVR    T-DKN-GE-IIWKKDEHISNIKKVLS-YPQVNIVKKVEEQT  GGFSK  ESIL-PKG-  1093
WP_019312892  1042  ---------DVR    T-DKN-GE-IIWKKDEYISNIKKVLS-YPQVNIVKKVEEQT  GGFSK  ESIL-PKG-  1093
WP_019313659  1042  ---------DVR    T-DKN-GE-IIWKKDEHISNIKKVLS-YPQVNIVKKVEEQT  GGFFK  ESIL-PKG-  1093
WP_019314093  1042  ---------DVR    T-DKN-GE-IIWKKDEHISNIKKVLS-YPQVNIVKKVEEQT  GGFSK  ESIL-PKG-  1093
WP_019315370  1047  LAD-DQIVERPMIE  VNDET-GE-IIWKKDEYISNIKKVLS-YPQVNIVKKVEEQT  GGFSK  ESIL-PKG-  1111
WP_019803776  1042  ---------DVR    T-DKN-GE-IIWKKDEHISNIKKVLS-YPQVNIVKKVEEQT  GGFSK  ESIL-PKG-  1093
WP_019805234  1042  ---------DVR    T-DKN-GE-IIWKKDEYISNIKKVLS-YPQVNIVKKVEEQT  GGFSK  ESIL-PKG-  1093
WP_024783594  1042  ---------DVR    T-DKN-GE-IIWKKDEHISNIKKVLS-YPQVNIVKKVEEQT  GGLFD  ----PKS-   1093
WP_024784288  1042  ---------DVR    T-DKN-GE-IIWKKDEHISNIKKVLS-YPQVNIVKKVEEQT  GGFSK  ESIL-PKG-  1093
WP_024784666  1042  ---------DVR    T-DKN-GE-IIWKKDEHISNIKKVLS-YPQVNIVKKVEEQT  GGFFK  ESIL-PKG-  1093
WP_024784894  1042  ---------DVR    T-DKN-GE-IIWKKDEHISNIKKVLS-YPQVNIVKKVEEQT  GGFSK  ESIL-PKG-  1093
```

-continued

| | | | | | |
|---|---|---|---|---|---|
| WP_024786433 | 1047 | LAD-DQIVERPMIE | VNDET-GE- | IAWDKTKHITTVKKVLS- | YPQVNIVKKVEEQT | GGLFD | -----PKS- | 1111 |
| WP_049473442 | 1042 | ------------DVR | T-DKN-GE- | IIWKKDEHISNIKKVLS- | YPQVNIVKKVEEQT | GGFSK | ESIL-PKG- | 1093 |
| WP_049474547 | 1042 | ------------DVR | T-DKN-GE- | IIWKKDEHISNIKKVLS- | YPQVNIVKKVEEQT | GGFSK | ESIL-PKG- | 1093 |
| EMC03581 | 1035 | ------------DVR | T-DKN-GE- | IIWKKDEHISNIKKVLS- | LPQVNIVKKVEEQT | GGFSK | ESIL-PKG- | 1086 |
| WP_000428612 | 1059 | YAD-GTIVKRENIE | Y-SKDtGE- | IAWNKEKDFATIKKVLS- | LPQVNIVKKREVQT | GGFSK | ESIL-PKG- | 1121 |
| WP_000428813 | 1057 | YAD-GTIVKRENIE | Y-SKDtGE- | IAWNKEKDFATIKKVLS- | YPQVNIVKKREVQT | GGFSK | ESIL-PKG- | 1119 |
| WP_049523028 | 1052 | YAD-GTIIQRGNVE | Y-SKDtGE- | IAWNKKRDFAIVRKVLS- | YPQVNIVKKTEEQT | GGFSK | ESIL-PKG- | 1114 |
| WP_003107102 | 1021 | LAD-GTVITRPQIE | TNTET-GE- | IVWDKVKDIKTIRKVLS- | IPQINVKKTEVQT | GGFSK | ESIL-SKR- | 1083 |
| WP_054279288 | 1053 | LAN-GNIIKRSPIE | VNEET-GE- | IVWDKIKDFGTVRKVLS- | APQVNIVKKTEIQT | GGFSN | ETIL-SKG- | 1115 |
| WP_049531101 | 1057 | YAD-GTIVKRENIE | Y-SKDtGE- | IAWNKEIDFATIRKKLS- | LSQVNIVKKTEEQT | GGLFD | NNIV-SKKk | 1124 |
| WP_049538452 | 1057 | YAD-GTIVKRENIE | Y-SKDtGE- | IAWNKEKDFATIRKKLS- | LPQVNIVKKTEEQT | GGLFD | NNIV-SKKk | 1124 |
| WP_049549711 | 1059 | YAD-GTIVKRENIE | Y-SNDtGE- | IAWNKEKDFATIKKVLS- | YPQVNIVKKTEEQT | GGLFD | NNIV-SKEk | 1126 |
| WP_007896501 | 1058 | LAD-GTLMKRPVIE | TNTET-GE- | VVWDKVKDFKTIRKVLS- | YPQVNIVKKTEIQS | GAFSK | ESVL-SKG- | 1120 |
| EFR44625 | 1010 | LAD-GTLMKRPVIE | TNTET-GE- | VVWDKVKDFKTIRKVLS- | YPQVNIVKKTEIQS | GAFSK | ESVL-SKG- | 1072 |
| WP_002897477 | 1056 | YAD-GTIRKRENIE | Y-SKDtGE- | IAWDKEKDFATIKKVLS- | YPQVNIVKKREVQT | GGFSK | ESIL-PKG- | 1118 |
| WP_002906454 | 1056 | YAD-GTIKKENIE | Y-SNDtGE- | IAWNKEKDFATIKKVLS- | LPQVNIVKKTEEQT | GGLFD | NNIV-SKKk | 1123 |
| WP_009729476 | 1057 | YAD-GTIVKRENIE | Y-SKDtGE- | IAWNKEKDFATIKKVLS- | LPQVNIVKKREVQT | GGFSK | ESIL-PKG- | 1119 |
| CQR24647 | 1047 | LAD-GRVVEKPVIE | ANEET-GE- | IAWDKTKHFANVKKVLS- | YPQVSIVKKVEEQT | GGFSK | ESIL-PKG- | 1109 |
| WP_000066813 | 1061 | YAD-GTIVKRENIE | Y-SKDtGE- | IAWNKEKDFATVKKVLS- | LPQVNIVKKREVQT | GGFSK | ESIL-PKG- | 1123 |
| WP_009754323 | 1057 | YAD-GTIVKRENIE | Y-SKDtGE- | IAWNKEKDFVTIKKVLS- | YPQVNIVKKREVQT | GGFSK | ESIL-PKG- | 1119 |
| WP_044674937 | 1049 | YSKtGEVRIRPVIE | VNKET-GE- | IVWDKKSDFRTVRKVLS- | YPQVNIVKKVEMQT | GGFSK | ESIL-QHG- | 1112 |
| WP_044676715 | 1051 | YSKtGEVRIRPVIE | VNKET-GE- | IVWDKKSDFRTVRKVLS- | YPQVNIVKKVEMQT | GGFSK | ESIL-QHG- | 1114 |
| WP_044680361 | 1051 | YSKtGEVRIRPVIE | VNKET-GE- | IVWDKKSDFRTVRKVLS- | YPQVNIVKKVEMQT | GGFSK | ESIL-QHG- | 1114 |
| WP_044681799 | 1049 | YSKtGEVRIRPVIE | VNKET-GE- | IVWDKKSDFKIVRKVLS- | YPQVNIVKKVEMQT | GGFSK | ESIL-QHG- | 1112 |
| WP_049533112 | 1051 | FAD-GTVVERPDIE | T-SED-GE- | IAWNKQTDFKIVRKVLS- | YPQVNIVKKTEVQT | HGLDR | PSPK-PKP- | 1122 |
| WP_029090905 | 1008 | -KQ----------- | --NSTtGE- | VKWMNPEVDIAKLKRILN- | FKQCNIVRKVEEQS | GALFK | ETIY-PVEe | 1061 |
| WP_065006696 | 1039 | -D------------ | -----Q--- | GK-LIWNP-DLINEIKKCFY- | YKDCYCTTKLDQKS | GQLFN | -TVL-SNDa | 1084 |
| AIT42264 | 1052 | LAN-GEIRKRPLIE | TNGET-GE- | IVWDKGRDFATVRKVLS- | MPQVNIVKKTEVQT | GGFSK | ESIL-PKR- | 1114 |
| WP_034440723 | 1042 | ------------LA | --NPD-GE- | IAWEKDKDLNTIRKVLS- | SKQINIIKKAEEGK | GRLFK | ETIN-SRPs | 1092 |
| AKQ21048 | 1052 | LAN-GEIRKRPLIE | TNGET-GE- | IVWDKGRDFATVRKVLS- | MPQVNIVKKTEVQT | GGFSK | ESIL-PKR- | 1114 |
| WP_004636532 | 1043 | -E------------ | ---------- | ILWDTERHLSTIKRVLS- | WKQMNIVKKVEKQK | GQLWK | ETIY-PKG- | 1092 |
| WP_002364836 | 1048 | -E------------ | ---------- | VNEET-GE- ILWSN- | SYLKTIKKELN-YHQMNIVKKVEVQK | GGFSK | ESIK-PKG- | 1098 |
| WP_016631044 | 999 | -E------------ | ---------- | P RFTKD-GE- ILWSN- | SYLKTIKKELN-YHQMNIVKKVEVQK | GGFSK | ESIK-PKG- | 1049 |
| EMS75795 | 783 | -E------------ | ---------- | Y SYDEN-GE- IFWDKARHIPQIKKVIS- | SHQVNIVKKVEVQT | GGFSK | ETVN-PKG- | 834 |
| WP_002373311 | 1048 | -E------------ | ---------- | P RFTKD-SE- ILWSN- | SYLKTIKKELN-YHQMNIVKKVEVQK | GGFSK | ESIK-PKG- | 1098 |
| WP_002378009 | 1048 | -E------------ | ---------- | P RFTKD-GE- ILWSN- | SYLKTIKKELN-YHQMNIVKKVEVQK | GGFSK | ESIK-PKG- | 1098 |
| WP_002407324 | 1048 | -E------------ | ---------- | P RFTKD-GE- ILWSN- | SYLKTIKKELN-YHQMNIVKKVEVQK | GGFSK | ESIK-PKG- | 1098 |
| WP_002413717 | 1048 | -E------------ | ---------- | P RFTKD-GE- ILWSN- | SYLKTIKKELN-YHQMNIVKKVEVQK | GGFSK | ESIK-PKG- | 1098 |
| WP_010775580 | 1050 | -E------------ | ---------- | P RFTKD-GE- ILWSN- | SYLKTIKKELN-YHQMNIVKKVEVQK | GGFSK | ESIK-PKG- | 1100 |
| WP_010818269 | 1048 | -E------------ | ---------- | P RFTKD-GE- ILWSN- | SYLKTIKKELN-YHQMNIVKKVEVQK | GGFSK | ESIK-PKG- | 1098 |
| WP_010824395 | 1048 | -E------------ | ---------- | P RFTKD-GE- ILWSN- | SYLKTIKKELN-YHQMNIVKKVEVQK | GGFSK | ESIK-PKG- | 1098 |
| WP_016622645 | 1048 | -E------------ | ---------- | P RFTKD-GE- ILWSN- | SYLKTIKKELN-YHQMNIVKKVEVQK | GGFSK | ESIK-PKG- | 1098 |
| WP_033624816 | 1048 | -E------------ | ---------- | P RFTKD-GE- ILWSN- | SYLKTIKKELN-YHQMNIVKKVEVQK | GGFSK | ESIK-PKG- | 1098 |
| WP_033625576 | 1048 | -T------------ | ---------- | P VCDEN-GE- IFWDKSKSIAQVKKVIN- | HHHMNIVKKTEIQK | GGFSK | ETVE-PKK- | 1098 |
| WP_337789179 | 1048 | -T------------ | ---------- | P VCDEN-GE- IFWDKSKSIAQVKKVIN- | HHHMNIVKKTEIQK | GGFSK | ETVE-PKK- | 1098 |
| WP_002310644 | 1049 | -T------------ | ---------- | P VCDEN-GE- IFWDKSKSIAQVKKVIN- | HHHMNIVKKTEIQK | GGFSK | ETVE-PKK- | 1100 |
| WP_002312694 | 1050 | -T------------ | ---------- | P VCDEN-GE- IFWDKSKSIAQVKKVIN- | HHHMNIVKKTEIQK | GGFSK | ETVE-PKK- | 1101 |
| WP_002314015 | 1050 | -T------------ | ---------- | P VCDEN-GE- IFWDKSKSIAQVKKVIN- | HHHMNIVKKTEIQK | GGFSK | ETVE-PKK- | 1101 |
| WP_002320716 | 1050 | -T------------ | ---------- | P VCDEN-GE- IFWDKSKSIAQVKKVIN- | HHHMNIVKKTEIQK | GGFSE | ETVE-PKK- | 1100 |
| WP_002330729 | 1049 | -T------------ | ---------- | P VCDEN-GE- IFWDKSKSIAQVKKVIN- | HHHMNIVKKTEIQK | GGFSK | ETVE-PKK- | 1101 |
| WP_002335161 | 1050 | -T------------ | ---------- | P VCDEN-GE- IFWDKSKSIAQVKKVIN- | HHHMNIVKKTEIQK | GGFSK | ETVE-PKK- | 1101 |
| WP_002345439 | 1050 | -T------------ | ---------- | P VCDEN-GE- IFWDKSKSIAQVKKVIN- | HHHMNIVKKTEIQK | GGFSK | ETVE-PKK- | 1101 |
| WP_034867970 | 1040 | -E------------ | ---------- | P FCDEN-GE- IYWEKSHHLPRIKKVLS- | SHQVNVKKVEQQK | GGFYK | ETVN-SKE- | 1091 |

```
WP_047937432  1050 --T--------P VCDEN-GE-IFWDKSKSIAQVKKVIN-HHMNIVKKTEIQK GGFSK ETVE-PKK- 1101
WP_010720994  1040 --E--------P FCDEN-GE-IYWEKSHHLPRIKKVLS-SHQVNVKKVEQQK GGFYK ETVN-SKE- 1091
WP_010737004  1040 --E--------P FCDEN-GE-IYWEKSHHLPRIKKVLS-SHQVNVKKVEQQK GGFYK ETVN-SKE- 1091
WP_034700478  1040 --E--------P FCDEN-GE-IYWEKSHHLPRIKKVLS-SHQVNVKKTEIQK GGFYK ETVN-SKE- 1091
WP_007209003  1038 --D--------P IINDD-GE-ILWNKQETIAQVIKTLG-MHQVNVKKVEKQK GGFSK ESIQ-PKG- 1089
WP_023519017  1034 --I-------- I ICDEQ-GE-VIWNKKRDLSTIKKTIG-AHQVNIVKKVEKQK GGFYK ETIN-SKA- 1085
WP_010770040  1046 --A--------V IIDEN-GE-ILWDK-KNIATVKKVMS-YPQMNIVKKPEIQT GSFSK ETIK-PKG- 1096
WP_048604708  1043 --K--------V IILWNQ-KKIVTVKKVMN-YRQMNIVKKTEIQK GGFSK ESIL-PKG- 1094
WP_010750235  1043 --Q--------Q FCDEN-GE-IFWDKRKHIQQIKKVIS-SHQVNIVKKTEVQT GSFYK ETVN-TKE- 1094
A1116583      1091 LAN-GEIRKRPLIE TNGET-GE-VVWDKGRDFATVRKVLS-MPQVNIVKKTEVQT GGFSK ESIL-PKR- 1153
WP_029073316  1053 --D-------- T-GE-VVWDP-EWISRIKKCFY-YKDCFVTKKLEENN GSFFN -TVR-PNDe 1099
WP_031589969  1053 --E--------P T-GE-IVWDP-NYIDRIKKCFY-YKDCFVTKKLEENN GTFFN -TVL-PNDt 1099
KDA45870      1035 YPF-         WDKARDLPTIKRYLY-RAQVNKVRKAERQT GGFSD EMLV-PKS- 1078
WP_039099354  1044 --E------- LVDEN-TEaVIWNKESGLAYLNKIYQ-FKKILVTREVHENS GALFN QTLYaAKDd 1097
AKP02966      1063 --N------GTTQ --DRntGE-IIWNVG-FRDKILKLFN-YHQCNVTRKTEIKT GQPYD QTIYsPKNp 1118
WP_010991369  1045 --D--------R IIDEN-GE-ILWDK-KYLDTVKKVMS-YRQMNIVKKTEIQK GEFSK ATIK-PKG- 1095
WP_033838504  1045 --D--------R IIDEN-GE-ILWDK-KYLDTVKKVMS-YRQMNIVKKTEIQK GEFSK ATIK-PKG- 1095
EHN60060      1048 --D--------R IIDEN-GE-ILWDK-KYLDTVKKVMS-YRQMNIVKKTEIQK GEFSK ATIK-PKG- 1098
EFR89594      814  --N--------Q IIDKN-GE-ILWDN-RYLDTIKKVLS-YRQMNIVKKTEIQK GEFSN ATVN-PKG- 864
WP_038409211  1045 --N--------Q IIDKN-GE-ILWDN-RYLDTIKKVLS-YRQMNIVKKTEIQK GEFSN ATVN-PKG- 1095
EFR95520      664  --E--------R IIDEN-GE-ILWDK-KYLETIKKVLD-YRQMNIVKKTEIQK GEFSK ATIK-PKG- 714
WP_003723650  1045 --E--------R IIDEN-GE-ILWDK-KYLETIKKVLD-YRQMNIVKKTEIQK GEFSK ATIK-PKG- 1095
WP_003727705  1045 --D--------R IIDEN-GE-ILWDK-KYLETIKKVLD-YRQINIVKKTEIQK GEFSK ATIK-PKG- 1095
WP_003730785  1045 --D--------R IIDEN-GE-ILWDK-KYLETIKKVLD-YRQINIVKKTEIQK GEFSK ATIK-PKG- 1095
WP_003733029  1045 --D--------R IIDEN-GE-ILWDK-KYLETVKKVLG-YRQMNIVKKTEIQK GEFSK VTPN-PKG- 1095
WP_003739838  1045 --D--------R IIDEN-GE-ILWDK-KYLETVKKVLD-YRQMNIVKKTEIQK GEFSK ATIK-PKG- 1095
WP_014601172  1045 --E--------R IIDEN-GE-ILWDK-KYLETIKKVLD-YRQMNIVKKTEIQK GEFSN QNPK-PRG- 1095
WP_023548323  1045 --E--------R IIDEN-GE-ILWDK-KYLETIKKVLN-YRQMNIVKKTEIQK GEFSN QNPK-PRG- 1095
WP_031665537  1045 --D--------R IIDEN-GE-ILWDK-KYLETIKKVLD-YRQMNIVKKTEIQK GEFSK ATIK-PKG- 1095
WP_031669209  1045 --D--------R IIDEN-GE-ILWDK-KYLETVKKVLG-YRQMNIVKKTEIQK GEFSN VTPN-PKG- 1095
WP_033920898  1048 --E--------R IIDEN-GE-ILWDK-KYLETIKKVLD-YRQMNIVKKTEIQK GEFSN QNPK-PRG- 1098
AKI42028      1048 --E--------R IIDEN-GE-ILWDK-KYLETIKKVLN-YRQMNIVKKTEIQK GEFSN QNPK-PRG- 1098
AKI_50529     493  --E--------R IIDEN-GE-ILWDK-KYLETIKKVLD-YRQMNIVKKTEIQK GEFSN ATIK-PKG- 543
EFR83390      1045 --D--------R IIDEN-GE-ILWDK-KYLDTIKKVLN-YRQMNIVKKTEIQK GEFSN ATAN-PKG- 1095
WP_046323366  1068 LAN-GEIRKRPLIE TNGET-GE-IVWDKGRDFATVRKVLS-MPQVNIVKKTEVQT GGFSK ESIL-PKR- 1130
AKE81011      1068 --D--------       GK-LIWNP-DLINEIKKCFY-YKDCYCITKLDQKS GQMFN -TVL-PNDa 1088
CUO82355      1043 --D--------       --T-GE-VMWDP-AKIGKIKSCFY-YKDVYTKKLEQNS GTLFN -TVL-PNDa 1089
WP_033162887  1085 LAN-GEIRKRPLIE TNGET-GE-IVWDKGRDFATVRKVLS-MPQVNIVKKTEVQT GGFSK ESIL-PKR- 1147
AGZ_01981     1052 LAN-GEIRKRPLIE TNGET-GE-IVWDKGRDFATVRKVLS-MPQVNIVKKTEVQT GGFSK ESIL-PKR- 1114
AKA60242      1052 LAN-GEIRKRPLIE TNGET-GE-IVWDKGRDFATVRKVLS-MPQVNIVKKTEVQT GGFSK ESIL-PKR- 1114
AKS40380      1056 LAN-GEIRKRPLIE TNGET-GE-IVWDKGRDFATVRKVLS-MPQVNIVKKTEVQT GGFSK ESIL-PKR- 1118
4UN5_B        1115 --NSD KLIA----RKKDW-DPKKYGGFDSPIVAYSV-LVVAK--VE-KGKSKKLKSVKELLVGITIME RSSFEK 1176
WP_010922251  1121 --DSD KLIPRKIKKV-YW-DIKKYGGEDSPIVAYSV-FVVAD--VE-KGKAKKLKTVKELVGISIME RSFFEE 1185
WP_039695303  1119 --NSD KLIPRKT-KDILL-DTTKYGGEDSPIVAYSI-LLIAD--IE-KGKAKKLKTVKILVGITIME KAAFEE 1183
WP_045635197  853  --EKN -LYKYYeTGNYL--TKYSKKDNGPVIKKI---------------KYYGNKLNAHLDITDDYPNS -VKLsL 912
5AXw_A        799  --NSD KLIA----RKKDW-DPKKYGGFDSPIVAYSV-LVVAK--VE-KGKSKKLKSVKELVGITIME RSSFEK 860
WP_009980683  1115 --NSD KLIA----RKKDW-DPKKYGGFDSPIVAYSV-LVVAK--VE-KGKSKKLKSVKELVGITIME RSSFEK 1176
WP_010922251  1115 --NSD KLIA----RKKDW-DPKKYGGFDSPIVAYSV-LVVAK--VE-KGKSKKLKSVKELLGITIME RSSFEK 1176
WP_010554416  1115 --NSD KLIA----RKKDW-DPKKYGGFDSPIVAYSV-LVVAK--VE-KGKSKKLKSVKELLGITIME RSSFEK 1176
WP_011284745  1115 --NSD KLIA----RKKDW-DPKKYGGFDSPIVAYSV-LVVAK--VE-KGKSKKLKSVKELLGITIME RSSFEK 1176
WP_011285506  1115 --NSD KLIA----RKKDW-DPKKYGGFDSPIVAYSV-LVVAK--VE-KGKSKKLKSVKELLGITIME RSSFEK 1176
WP_011527619  1115 --NSD KLIA----RKKDW-DPKKYGGFDSPIVAYSV-LVVAK--VE-KGKSKKLKSVKELLGITIME RSSFEK 1176
WP_012566673  1115 --NSD KLIA----RKKDW-DPKKYGGFDSPIVAYSV-LVVAK--VE-KGKSKKLKSVKELVGITIME RSSFEK 1176
```

-continued

| | | | |
|---|---|---|---|
| WP_014407541 | 1114 | --NSD KLIA-----RKKDW-DPKKYGGFDSPIVAYSV-LVVAK--VE--KGKSKKLKSVKELLGLGITIME RSSFEK | 1175 |
| WP_020905136 | 1115 | --NSD KLIA-----RKKDW-DPKKYGGFDSPIVAYSV-LVVAK--VE--KGKSKKLKSVKELLGITIME RSSFEK | 1176 |
| WP_023080005 | 1114 | --NSD KLIA-----RKKDW-DPKKYGGFDSPIVAYSV-LVVAK--VE--KGKSKKLKSVKELLGITIME RSSFEK | 1175 |
| WP_023610282 | 1115 | --NSD KLIA-----RKKDW-DPKKYGGFDSPIVAYSV-LVVAK--VE--KGKSKKLKSVKELLGITIME RSSFEK | 1176 |
| WP_030125963 | 1115 | --NSD KLIA-----RKKDW-DPKKYGGFDSPIVAYSV-LVVAK--VE--KGKSKKLKSVKELLGITIME RSSFEK | 1176 |
| WP_030126706 | 1115 | --NSD KLIA-----RKKDW-DPKKYGGFDSPIVAYSV-LVVAK--VE--KGKSKKLKSVKELLGITIME RSSFEK | 1176 |
| WP_031488318 | 1115 | --NSD KLIA-----RKKDW-DPKKYGGFDSPIVAYSV-LVVAK--VE--KGKSKKLKSVKELLGITIME RSSFEK | 1176 |
| WP_032460140 | 1115 | --NSD KLIA-----RKKDW-DPKKYGGFDSPIVAYSV-LVVAK--VE--KGKSKKLKSVKELVGITIME RSSFEK | 1176 |
| WP_032461047 | 1115 | --NSD KLIA-----RKKDW-DPKKYGGFDSPIVAYSV-LVVAK--VE--KGKSKKLKSVKELLGITIME RSSFEK | 1176 |
| WP_032462016 | 1115 | --NSD KLIA-----RKKDW-DPKKYGGFDSPIVAYSV-LVVAK--VE--KGKSKKLKSVKELLGITIME RSSFEK | 1176 |
| WP_032462936 | 1115 | --NSD KLIA-----RKKDW-DPKKYGGFDSPIVAYSV-LVVAK--VE--KGKSKKLKSVKELLGITIME RSSFEK | 1176 |
| WP_032464890 | 1115 | --NSD KLIA-----RKKDW-DPKKYGGFDSPIVAYSV-LVVAK--VE--KGKSKKLKSVKELLGITIME RSSFEK | 1176 |
| WP_033888930 | 940 | --NSD KLIA-----RKKDW-DPKKYGGFDSPIVAYSV-LVVAK--VE--KGKSKKLKSVKELLGITIME RSSFEK | 1001 |
| WP_038431314 | 1115 | --NSD KLIA-----RKKDW-DPKKYGGFDSPIVAYSV-LVVAK--VE--KGKSKKLKSVKELLGITIME RSSFEK | 1176 |
| WP_038432938 | 1114 | --NSD KLIA-----RKKDW-DPKKYGGFDSPIVAYSV-LVVAK--VE--KGKSKKLKSVKELLGITIME RSSFEK | 1175 |
| WP_038434062 | 1115 | --NSD KLIA-----RKKDW-DPKKYGGFDSPIVAYSV-LVVAK--VE--KGKSKKLKSVKELLGITIME RSSFEK | 1176 |
| BAQ51233 | 1026 | --NSD KLIA-----RKKDW-DPKKYGGFDSPIVAYSV-LVVAK--VE--KGKSKKLKSVKELLGITIME RSSFEK | 1087 |
| KGE60162 | 290 | --NSD KLIA-----RKKDW-DPKKYGGFDSPIVAYSV-LVVAK--VE--KGKSKKLKSVKELLGITIME RSSFEK | 351 |
| KGE60856 | 53 | --NSD KLIA-----RKKDW-DPKKYGGFDSPIVAYSV-LVVAK--VE--KGKSKKLKSVKELLGITIME RSSFEK | 114 |
| WP_002989955 | 1115 | --NSD KLIA-----RKKDW-DPKKYGGFDSPIVAYSV-LVVAK--VE--KGKSKKLKSVKELLGITIME RSSFEK | 1176 |
| WP_003030002 | 1094 | --ESD KLIPRKT-KNSYW-NPKKYGGEDSPVVAYSI-LVFAD--VE--KGKSKKLRKVQDMVGITIME KKRFEK | 1158 |
| WP_003065552 | 1122 | --DSD KLIPRKTKKA-YW-DIKKYGGEDSPIVAYSV-FVVAD--VE--KGKAKKLKTVKELVGLSIME RSFFEE | 1186 |
| WP_001040076 | 1113 | --NSD KLIPRKT-KDIYL-DPKKYGGEDSPIVAYSV-LVVAD--IK--KGKAQKLKTVTELLGITIME RSRFEK | 1177 |
| WP_001040078 | 1121 | --NSD KLIPRKT-KDIYL-DPKKYGGEDSPIVAYSV-LVVAD--IK--KGKAQKLKTVTELLGITIME RSKFEK | 1185 |
| WP_001040080 | 1113 | --NSD KLIPRKT-KDIYL-DPKKYGGEDSPIVAYSV-LVVAD--IK--KGKAQKLKTVTELLGITIME RSRFEK | 1177 |
| WP_001040081 | 1113 | --NSD KLIPRKT-KDIYL-DPKKYGGEDSPIVAYSV-LVVAD--IK--KGKAQKLKTVTELLGITIME RSRFEK | 1177 |
| WP_001040083 | 1113 | --NSD KLIPRKT-KDIYL-DPKKYGGEDSPIVAYSV-LVVAD--IK--KGKAQKLKTVTELLGITIME RSRFEK | 1177 |
| WP_001040085 | 1113 | --NSD KLIPRKT-KDIYL-DPKKYGGEDSPIVAYSV-LVVAD--IK--KGKAQKLKTVTELLGITIME RSRFEK | 1177 |
| WP_001040087 | 1113 | --NSD KLIPRKT-KDIYL-DPKKYGGEDSPIVAYSV-LVVAD--IK--KGKAQKLKTVTELLGITIME RSRFEK | 1177 |
| WP_001040088 | 1113 | --NSD KLIPRKT-KDIYL-DPKKYGGEDSPIVAYSV-LVVAD--IK--KGKAQKLKTVTELLGITIME RERFEK | 1177 |
| WP_001040089 | 1113 | --NSD KLIPRKT-KDIYL-DPKKYGGEDSPIVAYSV-LVVAD--IK--KGKAQKLKTVTELLGITIME RSRFEK | 1177 |
| WP_001040090 | 1113 | --NSD KLIPRKT-KDIYL-DPKKYGGEDSPIVAYSV-LVVAD--IK--KGKAQKLKTVTELLGITIME RSRFEK | 1177 |
| WP_001040091 | 1113 | --NSD KLIPRKT-KDIYL-DPKKYGGEDSPIVAYSV-LVVAD--IK--KGKAQKLKTVKELIGITIME RSRFEK | 1177 |
| WP_001040092 | 1113 | --NSD KLIPRKT-KDIYL-DPKKYGGEDSPIVAYSV-LVVAD--IK--KGKAQKLKTVTELLGITIME RSRFEK | 1177 |
| WP_001040094 | 1113 | --NSD KLIPRKT-KDIYL-DPKKYGGEDSPIVAYSV-LVVAD--IK--KGKAQKLKTVTELLGITIME RSRFEK | 1177 |
| WP_001040095 | 1113 | --NSD KLIPRKT-KDIYL-DPKKYGGEDSPIVAYSV-LVVAD--IK--KGKAQKLKTVTELLGITIME RSRFEK | 1177 |
| WP_001040096 | 1113 | --NSD KLIPRKT-KDIYL-DPKKYGGEDSPIVAYSV-LVLAD--IK--KGKAQKLKTVTELLGITIME RSRFEK | 1177 |
| WP_001040097 | 1113 | --NSD KLIPRKT-KDIYL-DPKKYGGEDSPIVAYSV-LVVAD--IK--KGKAQKLKTVTELLGITIME RSRFEK | 1177 |
| WP_001040098 | 1113 | --NSD KLIPRKT-KDIYL-DPKKYGGEDSPIVAYSV-LVVAD--IK--KGKAQKLKTVTELLGITIME RSRFEK | 1177 |
| WP_001040099 | 1113 | --NSD KLIPRKT-KDIYL-DPKKYGGEDSPIVAYSV-LVVAD--IK--KGKAQKLKTVTELLGITIME RSRFEK | 1177 |
| WP_001040100 | 1113 | --NSD KLIPRKT-KDIYL-DPKKYGGEDSPKVAYSV-LVVAD--IK--KGKAQKLKTVTELLGITIME RSRFEK | 1177 |
| WP_001040104 | 1113 | --NSD KLIPRKT-KDIYL-DPKKYGGEDSPIVAYSV-LVVAD--IK--KGKAQKLKTVTELLGITIME RSRFEK | 1177 |
| WP_001040105 | 1113 | --NSD KLIPRKT-KDIYL-DPKKYGGEDSPIVAYSV-LVVAD--IK--KGKAQKLKTVTELLGITIME RSRFEK | 1177 |
| WP_001040106 | 1113 | --NSD KLIPRKT-KDIYL-DPKKYGGEDSPIVAYSV-LVVAD--IK--KGKAQKLKTVTELLGITIME RFRFEK | 1177 |
| WP_001040107 | 1113 | --NSD KLIPRKT-KDIYL-DPKKYGGEDSPIVAYSV-LVVAD--IK--KGKAQKLKTVTELLGITIME RFRFEK | 1177 |
| WP_001040108 | 1113 | --NSD KLIPRKT-KDIYL-DPKKYGGEDSPIVAYSV-LVVAD--IK--KGKAQKLKTVTELLGITIME RFRFEK | 1177 |
| WP_001040109 | 1113 | --NSD KLIPRKT-KDIYL-DPKKYGGEDSPIVAYSV-LVVAD--IK--KGKAQKLKTVTELLGITIME RERFEK | 1177 |
| WP_001040110 | 1113 | --NSD KLIPRKT-KDIYL-DPKKYGGEDSPIVAYSV-LVLAD--IK--KGKAQKLKTVKELLGITIME RERFEK | 1177 |
| WP_015058523 | 1113 | --NSD KLIPRKT-KDIYL-DPKKYGGEDSPIVAYSV-LVVAD--IK--KGKAQKLKTVTELLGITIME RERFEK | 1177 |
| WP_017643650 | 1113 | --NSD KLIPRKT-KDIYL-DPKKYGGEDSPIVAYSV-LVVAD--IK--KGKAQKLKTVTELLGITIME RSRFEK | 1177 |
| WP_017647151 | 1113 | --NSD KLIPRKT-KDIYL-DPKKYGGEDSPIVAYSV-LVVAD--IK--KGKAQKLKTVTELLGITIME RSRFEK | 1177 |
| WP_017648376 | 1113 | --NSD KLIPRKT-KDIYL-DPKKYGGEDSPIVAYSV-LVVAD--IK--KGKAQKLKTVTELLGITIME RSRFEK | 1177 |
| WP_017649527 | 1113 | --NSD KLIPRKT-KDIYL-DPKKYGGEDSPIVAYSV-LVVAD--IK--KGKAQKLKTVTELLGITIME RSRFEK | 1177 |

| | | | |
|---|---|---|---|
| WP_017771611 | 1113 | --NSD KLIPRKT-KDIYL-DPKKYGGFDSPIVAYSV-LVVAD--IK--KGKAQKLKTVTELLGITIME RFRPEK | 1177 |
| WP_017771984 | 1113 | --NSD KLIPRKT-KDIYL-DPKKYGGFDSPIVAYSV-LVAAD--IK--KGKAQKLKTVTELLGITIME RSRFEK | 1177 |
| CFQ25032 | 1113 | --NSD KLIPRKT-KDIYL-DPKKYGGFDSPIVAYSV-LVVAD--IK--KGKAQKLKTVTELLGITIME RSRPEK | 1177 |
| CFV16040 | 1113 | --NSD KLIPRKT-KDIYL-DPKKYGGFDSPIVAYSV-LVVAD--IK--KGKAQKLKTVTELLGITIME RSRYEK | 1177 |
| KLJ37842 | 1113 | --NSD KLIPRKT-KDIYL-DPKKYGGFDSPIVAYSV-LVVAD--IK--KGKAQKLKTVTELLGITIME RSRFEK | 1177 |
| KLJ72361 | 1113 | --NSD KLIPRKT-KDIYL-DPKKYGGFDSPIVAYSV-LVVAD--IK--KGKAQKLKTVTELLGITIME RSRFEK | 1177 |
| KLL20707 | 1127 | --NSD KLIPRKT-KDIYL-DPKKYGGFDSPIVAYSV-LVVAD--IK--KGKAQKLKTVTELLGITIME RSRFEK | 1191 |
| KLL42645 | 1113 | --NSD KLIPRKT-KDIYL-DPKKYGGFDSPIVAYSV-LVVAD--IK--KGKAQKLKTVTELLGITIME RSRPEK | 1177 |
| WP_047207273 | 1113 | --NSD KLIPRKT-KDIYL-DPKKYGGFDSPIVAYSV-LVVAD--IK--KGKAQKLKTVTELLGITIME RFRFEK | 1177 |
| WP_047209694 | 1113 | --NSD KLIPRKT-KDIYL-DPKKYGGFDSPIVAYSV-LVVAD--IK--KGKAQKLKTVTELLGITIME RSRFEK | 1177 |
| WP_050198062 | 1113 | --NSD KLIPRKT-KDIYL-DPKKYGGFDSPIVAYSV-LVVAD--IK--KGKAQKLKTVTELLGITIME RSRFEK | 1177 |
| WP_050201642 | 1113 | --NSD KLIPRKT-KDIYL-DPKKYGGFDSPIVAYSV-LVVAD--IK--KGKAQKLKTVTELLGITIME RSRFEK | 1177 |
| WP_050204027 | 1113 | --NSD KLIPRKT-KDIYL-DPKKYGGFDSPIVAYSV-LVVAD--IK--KGKAQKLKTVTELLGITIME RSRFEK | 1177 |
| WP_050881965 | 1113 | --NSD KLIPRKT-KDIYL-DPKKYGGFDSPIVAYSV-LVVAD--IK--KGKAQKLKTVTELLGITIME RSRFEK | 1177 |
| WP_050886065 | 1113 | --NSD KLIPRKT-KDIYL-DPKKYGGFDSPIVAYSV-LVLAD--IK--KGKAQKLKTVKELIGITIME RERFEK | 1177 |
| AHN30376 | 1113 | --NSD KLIPRKT-KDIYL-DPKKYGGFDSPIVAYSV-LVVAD--IK--KGKAQKLKTVTELLGITIME RSRFEK | 1177 |
| EAO78426 | 1113 | --NSD KLIPRKT-KDIYL-DPKKYGGFDSPIVAYSV-LVVAD--IK--KGKAQKLKTVTELLGITIME RSRPEK | 1177 |
| CCW42055 | 1123 | --DSS ENLVGVK-RNL---DPKKYGGYAGISNSYAV-LVKAI--IE--KGVKKKETMVLEFQGISILD RITFEK | 1185 |
| WP_003041502 | 1095 | --ESD KLIPRKT-KNSYW-NPKKYGGFDSPVVAYSI-LVFAD--VE--KGKSKKLRKVQDMVGITIME KKRFEK | 1159 |
| WP_037593752 | 1095 | --ESD KLIPRKT-KNSYW-NPKKYGGFDSPVVAYSI-LVFAD--VE--KGKSKKLRKVQDMVGITIME KKRFEK | 1159 |
| WP_049516684 | 1094 | --ESD KLIPRKT-KNSYW-NPKKYGGFDSPVVAYSI-LVFAD--VE--KGKSKKLRKVQDMVGITIME KKRFEK | 1158 |
| GAD46167 | 1126 | --ESA KLIP----RKKGW-DIRKYGGFDSPTVAYSV-LVVAD--VE--KGKAKKLKSVKVLVGISIME KGSYEK | 1190 |
| WP_018363470 | 1124 | --ESA KLIP----RKKGW-DIRKYGGFDSPTVAYSV-LVVAD--VE--KGKAKKLKSVKVLVGISIME KGSYEK | 1185 |
| WP_003043819 | 1094 | --ESD KLIPRKT-KNSYW-DPKKYGGFDSPVVAYSI-LVFAD--VE--KGKSKKLRKVQDMVGITIME KKRFEK | 1158 |
| WP_006269658 | 1114 | --DSD KLIARKTKEN-YW-DIKKYGGFDSPTVAYSV-LVFAD--IK--KGKAKKLKELVGISIME RPFFEK | 1178 |
| WP_048800889 | 1114 | --SFD KLIS----RKHRF-ESSKYGGFGSPTVTYSV-LVVAKsKVQ--DGKVKKIKTGKELIGMTLLD KLVFEK | 1177 |
| WP_012767106 | 1114 | --SFD KLIS----RKHRF-ESSKYGGFGSPTVTYSV-LVVAKsKVQ--DGKVKKIKTGKELIGITLLD KLVFEK | 1177 |
| WP_014612333 | 1114 | --SFD KLIS----RKHRF-ESSKYGGFGSPTVTYSV-LVVAKcKVQ--DGKVKKIKTGKELIGITLLD KLVFEK | 1177 |
| WP_015017095 | 1114 | --SFD KLIS----RKHRF-ESSKYGGFGSPTVTYSV-LVVAKsKVQ--DGKVKKIKTGKELIGITLLD KLVFEK | 1177 |
| WP_015057649 | 1114 | --SFD KLIS----RKHRF-ESSKYGGFGSPTVTYSV-LVVAKsKVQ--DGKVKKIKTGKELIGITLLD KLVFEK | 1177 |
| WP_048327215 | 1095 | --NSD KLIP----RKNNW-DIRKYGGFDSPTVAYSV-LVIAK--ME--KGKAKVLKPVKEMVGITIME RTAFEK | 1156 |
| WP_049519324 | 1095 | --NSD KLIP----RKNNW-DIRKYGGFDSPTVAYSV-LVIAK--ME--KGKAKVLKPVKEMVGITIME RIAFEK | 1156 |
| WP_012515931 | 1124 | --DSD KLIPRKTKKL-QW-ETQKYGGFDSPTVAYSV-LVVAD--VE--KGKIRKLKTVKELVGISIME RSSFEE | 1188 |
| WP_021320964 | 1119 | --DSD KLIPRKTKV-YW-DIKKYGGFDSPTVKELVGISIME RSFFEE | 1183 |
| WP_037581760 | 1120 | --DSD KLIPRKTKKF-RW-DTPKYGGFDSPTVAYSV-LVVAD--VE--KGKAKKLKTVKELVGISIME RSFFEE | 1184 |
| WP_004232481 | 1121 | --DSD KLIPRKIkKV-YW-DIKKYGGFDSPTVAYSV-FVVAD--VE--KGKAKKLKTVKELVGISIME RSFFEE | 1185 |
| WP_009854540 | 1124 | --DSD KLIPRKIkKV-YW-NIKKYGGFDSPTVAYSV-LVVAD--IE--KGKAKKLKTIKELVGIKIME RSFFEE | 1188 |
| WP_012962174 | 1115 | --DSD KLIA----RKKSW-DPKKYGGFDSPVIAYSV-LVVAK--IA--KGKTQKLKTIKELVGIKIME QDEFEK | 1176 |
| WP_039695303 | 1115 | --DSD KLIA----RKKSW-DPKKYGGFDSPVIAYSV-LVVAK--IA--KGKTQKLKTIKELVGIKIME QDEFEK | 1176 |
| WP_003099269 | 1 | --- | 8 |
| AHY15608 | 1115 | --DSD KLIA----RKKSW-DPKKYGGFDSPIIAYSV-LVVAK--IA--KGKTQKLKTIKELVGIKIME QDEFEK | 1176 |
| AHY17476 | 1094 | ME KGKTQKLKTIKELVGIKIME QDEFEK | 1158 |
| ESR09100 | 1109 | --NN KLIPIKS-G---L-SPEKYGGFIEPAESYSLaIFYID--IN---GKKPKKKSTIIAISRME KKDYEK | 1167 |
| AGM98575 | 1125 | vvDAS KLIPRKIkTV-YW-DIKKYGGFDSPTVAYSV-LVVAD--IE--KGKAKKLKTVKEMVGITVQD KKKFEA | 1188 |
| AL F27331 | 1119 | --NSD KLIPRKT-KKFYW-RKKDw-SVDKYGGFDSPTVAYSI-LVIAN--IE--KGKSKKLKLVKDLVGITIME RTIFEK | 1183 |
| WP_018372492 | 1094 | --NSD KLIPRKT-KKFYW-RKKDw-SVDKYGGFDSPTVAYSI-LLIAD--IE--KGKAKKLKTVKELVGITIME KAAFEE | 1158 |
| WP_045618028 | 1094 | --NSD KLIPRKT-KKFYW-DTTKYGGFDSPTVAYSI-LLIAD--IE--KGKAKKLKTVKELVGITIME KAAFEE | 1158 |
| WP_045635197 | 1094 | --NSD KLIPRKT-KKFYW-DIKKYGGFDSPTVAYSI-LVIAD--IE--KGKSKKLKTVKALVGVTIME KMTFER | 1158 |
| WP_002263887 | 1094 | --NSD KLIPRKT-KKFYW-DIKKYGGFDSPIVAYSI-LVIAD--IE--KGKSKKLKTVKALVGVTIME KMTFER | 1158 |
| WP_002264920 | 1094 | --NSD KLIPRKT-KKFYW-DIKKYGGFDSPIVAYSI-LVIAD--IE--KGKSKKLKTVKALVGVTIME KMTFER | 1158 |
| WP_002269043 | 1094 | --NSD KLIPRKT-KKFYW-DIKKYGGFDSPIVAYSI-LVIAD--IE--KGKSKKLKTVKALVGVTIME KMTFER | 1158 |

-continued

| ID | | | | |
|---|---|---|---|---|
| WP_002269448 | 1094 | --NSD KLIPRKT-KKFYW-DTKKYGGEDSPIVAYSI-LVIAD--IE--KGKSKKLKTVKALVGVTIME KMTFER | 1158 |
| WP_002271977 | 1094 | --NSD KLIPRKT-KKFYW-DTKKYGGEDSPIVAYSI-LVIAD--IE--KGKSKKLKTVKALVGVTIME KMTFER | 1158 |
| WP_002272766 | 1094 | --NSD KLIPRKT-KKFYW-DTKKYGGEDSPIVAYSI-LVIAD--IE--KGKSKKLKTVKALVGVTIME KMTFER | 1158 |
| WP_002273241 | 1094 | --NSD KLIPRKT-KKFYW-DTKKYGGEDSPIVAYSI-LVIAD--IE--KGKSKKLKTVKALVGVTIME KMTFER | 1158 |
| WP_002275430 | 1094 | --NSD KLIPRKT-KKFYW-DTKKYGGEDSPIVAYSI-LVIAD--IE--KGKSKKLKTVKALVGVTIME KMTFER | 1158 |
| WP_002276448 | 1094 | --NSD KLIPRKT-KKFYW-DTKKYGGEDSPIVAYSI-LVIAD--IE--KGKSKKLKTVKALVGVTIME KMTFER | 1158 |
| WP_002777050 | 1112 | --PLE KLVPLKK----AL-NPEKYGGYQKPTTAYPI-LLIVD--------------------------- KKRPEQ | 1166 |
| WP_002773364 | 1094 | --NSD KLIPRKT-KKFYW-DTKKYGGEDSPIVAYSI-LVIAD--IE--KGKSKKLKTVKALVGVTIME KMTFER | 1158 |
| WP_002779025 | 1094 | --NSD KLIPRKT-KKFYW-DTKKYGGEDSPIVAYSI-LVIAD--IE--KGKSKKLKTVKALVGVTIME KMTFER | 1158 |
| WP_002279859 | 1094 | --DSD KLIPRKT-KKFYW-DTKKYGGEDSPIVAYSI-LVIAD--IE--KGKSKKLKTVKALVGVTIME KMTFER | 1158 |
| WP_002280230 | 1094 | --NSD KLIPRKT-KKFYW-DTKKYGGEDSPIVAYSI-LVIAD--IE--KGKSKKLKTVKALVGVTIME KMTFER | 1158 |
| WP_002281696 | 1094 | --NSD KLIPRKT-KKFYW-DTKKYGGEDSPIVAYSI-LVIAD--IE--KGKSKKLKTVKALVGVTIME KMTFER | 1158 |
| WP_002282247 | 1112 | --PLE KLVPLKK----AL-NPEKYGGYQKPTTAYPI-LLIVD------------TKQLIPISVMD KKRPEQ | 1166 |
| WP_002282906 | 1094 | --NSD KLIPRKT-KKFYW-DTKKYGGEDSPIVAYSI-LVIAD--IE--KGKSKKLKTVKALVGVTIME KMTFER | 1158 |
| WP_002283846 | 1094 | --NSD KLIPRKT-KKFYW-DTKKYGGEDSPIVAYSI-LVIAD--IE--KGKSKKLKTVKALVGVTIME KMTFER | 1158 |
| WP_002287255 | 1094 | --NSD KLIPRKT-KKFYW-DTKKYGGEDSPIVAYSI-LVIAD--IE--KGKSKKLKTVKALVGVTIME KMTFER | 1158 |
| WP_002289990 | 1094 | --NSY KLIPRKT-KKFYW-DTKKYGGEDSPIVAYSI-LVIAD--IE--KGKSKKLKTVKALVGVTIME KMTFER | 1158 |
| WP_002289641 | 1094 | --NSD KLIPRKT-KKFYW-DTKKYGGEDSPIVAYSI-LVIAD--IE--KGKSKKLKTVKALVGVTIME KMTFER | 1158 |
| WP_002290427 | 1094 | --DSD KLIPRKT-KKFYW-DTKKYGGEDSPIVAYSI-LVIAD--IE--KGKSKKLKTVKALVGVTIME KMTFER | 1158 |
| WP_002295753 | 1094 | --NSD KLIPRKT-KKFYW-DTKKYGGEDSPIVAYSI-LVIAD--IE--KGKSKKLKTVKALVGVTIME KMTFER | 1158 |
| WP_002296423 | 1108 | --NSD KLIPRKT-KKFYW-DTKKYGGEDSPIVAYSI-LVIAD--IE--KGKSKKLKTVKALVGVTIME KMTFER | 1172 |
| WP_002304487 | 1094 | --NSD KLIPRKT-KKFYW-DTKKYGGEDSPIVAYSI-LVIAD--IE--KGKSKKLKTVKALVGVTIME KMTFER | 1158 |
| WP_002305844 | 1094 | --NSD KLIPRKT-KKFYW-DTKKYGGEDSPIVAYSI-LVIAD--IE--KGKSKKLKTVKALVGVTIME KMTFER | 1158 |
| WP_002307203 | 1094 | --NSD KLIPRKT-KKFYW-DTKKYGGEDSPIVAYSI-LVIAD--IE--KGKSKKLKTVKALVGVTIME KMTFER | 1158 |
| WP_002310390 | 1094 | --DSD KLIPRKT-KKFYW-DTKKYGGEDSPIVAYSI-LVIAD--IE--KGKSKKLKTVKALVGVTIME KMTFER | 1158 |
| WP_002352408 | 1094 | --DSD KLIPRKT-KKFYW-DTKKYGGEDSPIVAYSI-LVIAD--IE--KGKSKKLKTVKALVGVTIME KMTFER | 1158 |
| WP_012997688 | 1094 | --NSD KLIPRKT-KKFYW-DTKKYGGEDSPIVAYSI-LVIAD--IE--KGKSKKLKTVKALVGVTIME KMTFER | 1158 |
| WP_014677909 | 1094 | --NSD KLIPRKT-KKFYW-DTKKYGGEDSPIVAYSI-LVIAD--IE--KGKSKKLKTVKALVGVTIME KMTFER | 1158 |
| WP_019312892 | 1094 | --NSD KLIPRKT-KKFYW-DTKKYGGEDSPIVAYSI-LVIAD--IE--KGKSKKLKTVKALVGVTIME KMTFER | 1158 |
| WP_019313659 | 1094 | --NSD KLIPRKT-KKFYW-DTKKYGGEDSPIVAYSI-LVIAD--IE--KGKSKKLKTVKALVGVTIME KMTFER | 1158 |
| WP_019314093 | 1094 | --NSD KLIPRKT-KKFYW-DTKKYGGEDSPIVAYSI-LVIAD--IE--KGKSKKLKTVKALVGVTIME KMTFER | 1158 |
| WP_019315370 | 1094 | --NSD KLIPRKT-KKFYW-DTKKYGGEDSPIVAYSI-LVIAD--IE--KGKSKKLKTVKALVGVTIME KMTFER | 1158 |
| WP_019803776 | 1094 | --DSD KLIPRKT-KKFYW-DTKKYGGEDSPIVAYSI-LVIAD--IE--KGKSKKLKTVKALVGVTIME KMTFER | 1158 |
| WP_019805234 | 1094 | --NSD KLIPRKT-KKFYW-DTKKYGGEDSPIVAYSI-LVIAD--IE--KSKSKKLKTVKALVGVTIME KMTFER | 1158 |
| WP_024783594 | 1112 | --PLE KLVPLKK----AL-NPEKYGGYQKPTTAYPI-LLIVD------------TKQLIPISVMD KKRPEQ | 1166 |
| WP_024784288 | 1094 | --NSD KLIPRKT-KKEYW-DTTKYGGEDSPIVAYSI-LVIAD--IE--KGKSKKLKTVKALVGVTIME KMTFER | 1158 |
| WP_024784666 | 1094 | --NSD KLIPRKT-KNVQL-DTTKYGGEDSPIVAYSI-LLIAD--VE--KGKSKKLKTVKSLIGITIME KVKPEA | 1158 |
| WP_024784894 | 1094 | --DSD KLIP----RKNNW-DPKKYGGFGSPIIAYSV-LVVAK--VT--KGKSQKIKSVKELVGITIME QNEFEK | 1158 |
| WP_024786433 | 1112 | --PLE KLVPLKK----AL-NPEKYGGYQKPTTAYPI-LLIVD------------TKQLIPISVMD KKRPEQ | 1166 |
| WP_024473442 | 1094 | --NSD KLIPRKT-KKEYW-DIKKYGGEDSPIVAYSI-LVIAD--IE--KGKSKKLKTVKALVGVTIME KMTFER | 1158 |
| WP_049474547 | 1094 | --NSD KLIPRKT-KKEYW-DIKKYGGEDSPIVAYSI-LVIAD--IE--KGKSKKLKTVKALVGVTIME KMTFER | 1158 |
| EMC03581 | 1087 | --NSD KLIPRKT-KDILW-DTTKYGGEDSPIVAYSI-LLIAD--IE--KGKAKRLKTVKILVGITIME KATPEK | 1151 |
| WP_000428612 | 1122 | --NSD KLIPRKT-KDILW-ETTKYGGEDSPIVAYSI-LLIAD--IE--KGKAKKLKTVKILVGITIME KAAFEE | 1186 |
| WP_000428613 | 1120 | --PLE KLVPLKK----AL-NPEKYGGYQKPTTAYPI-LLIVD------------TKQLIPISVMD KKRPEQ | 1184 |
| WP_049523028 | 1115 | --NSD KLIPRKT-KNVQL-DTTKYGGEDSPIVAYSI-LLIGI--VE--KGKSKKLKTVKSLIGITIME KVKPEA | 1179 |
| WP_003107102 | 1084 | --DSD KLIP----RKNNW-DPKKYGGFGSPIIAYSV-LVVAK--VT--KGKSQKIKSVKELVGITIME QNEFEK | 1145 |
| WP_054279288 | 1116 | KSS KLIP----RKNKWrDTTKYGGENTPTVAYSV-LVVAK--VE--KGKAKKLKPVKELVGITIME RTKPEA | 1178 |
| WP_049531101 | 1125 | vvDAS KLIPIKS-G---L-SPEKYGGYARPTIAYSV-LVIAD--IE--KGKIKKLKRIKEMIGITVQD KKKFEA | 1188 |
| WP_049538452 | 1125 | vvDAS KLIPIKS-G---L-SPEKYGGYARPTIAYSV-LVIAD--IE--KGKIKKLKRIKEMIGITVQD KKIFES | 1188 |
| WP_049549711 | 1127 | vvDAS KLIPIKS-G---L-SPEKYGGYARPTIAYSV-LVIAD--IE--KGKIKKLKRIKEMIGITIQD KKKFEA | 1190 |
| WP_007896501 | 1121 | --NSD KLIE----RKKGW-DPKKYGGEDSPNTAYSI-FVVAK--VA--KRKAQKLKTVKEIVGITIME QAEYEK | 1182 |
| EFR44625 | 1073 | --NSD KLIE----RKKGW-DPKKYGGEDSPNTAYSI-FVVAK--VA--KRKAQKLKTVKEIVGITIME QAEYEK | 1134 |
| WP_002897477 | 1119 | --NSD KLIPRKT-KDILW-DTTKYGGEDSPVIAYSI-LLIAD--IE--KGKAKKLKTVKILVGITIME KAAFEE | 1183 |

| | | | |
|---|---|---|---|
| WP_002906454 | 1124 | vvDAS KLIPIKS-S---L-SPEKyGGYARPTIAYSV-LVIAD--IEkgKGKAKKLKRIKEIVGITIQD KKKPES | 1189 |
| WP_009729476 | 1120 | --NSD KLIPRKT-KDILw-DTTKYGGEDSPVIAYSI-LLIAD--IE--KGKAKKLKTVKILVGITIME KDAFEK | 1184 |
| CQR24647 | 1110 | --GSD KLIARKT-KNNYL-STQKYGGFDSPVIAYSI-MFVAD--IE--KGKSKRLKTVKEMIGITIME RSRPES | 1174 |
| WP_000066813 | 1124 | --NSD KLIPRKT-KEILw-DTTKYGGEDSPVIAYSI-LLIAD--IE--KGKAKKLKTVKILVGITIME KATFEK | 1188 |
| WP_009754323 | 1120 | --NSD KLIPRKT-KDILw-DTTKYGGEDSPVIAYSI-LLIAD--IE--KGKAKKLKTVKILVGITIME KAAFEK | 1184 |
| WP_044674937 | 1113 | --DSD KLIPRKT-EKFYL-DIKKYGGEDSPTIAYSV-LLIAD--IE--KGKAKKLKRVKELIGITIME RMAFEK | 1177 |
| WP_044676715 | 1115 | --DSD KLIPRKT-EKFYL-DIKKYGGEDSPTIAYSV-LLIAD--IE--KGKAKKLKRVKELIGITIME RMAFEK | 1179 |
| WP_044680361 | 1113 | --DSD KLIPRKT-EKFYL-DIKKYGGEDSPTIAYSV-LLIAD--IE--KGKAKKLKRVKELIGITIME RMAFEK | 1177 |
| WP_044681799 | 1115 | --DSD KLIPRKT-EKFYL-DIKKYGGEDSPTIAYSV-LLIAD--IE--KGKAKKLKRVKELIGITIME RMAFEK | 1179 |
| WP_049533112 | 1123 | --DSS ENLVGVK-RNL---DPKKYGGYAGISNSYAV-lvKAI--IE--KGVKKKETMVLEFQGISILD RITFEK | 1185 |
| WP_029090905 | 1062 | --SSS KTIP----LKKHL-DTAIYGGYTAVNYASYA--LIQ-FK---KGRKLK--REIIGIPLAV QTRIDN | 1117 |
| WP_006506696 | 1085 | haDKG AVVP----vNKNRS-DVHKYGGFSG--LQYTI---VA--IEggKKKGKKTELVKKISGVPLHL KAASIN | 1149 |
| AIT42264 | 1115 | --NSD KLIA----RKKDW-DPKKYGGFDSPIVAYSV-LVVAK--VE--KGKSKKLKSVKELLGITIME RSSFEK | 1176 |
| WP_034440723 | 1093 | k-KTE KRIP----IKNNL-DPNIYGGYIEEKMAYYI----AlnyLE--NGKTKK-----AIVGISIKD KKDFEG | 1149 |
| AKQ21048 | 1115 | --NSD KLIA----RKKDW-DPKKYGGFDSPIVAYSV-LVVAK--VE--KGKSKKLKSVKELLGITIME RSSFEK | 1176 |
| WP_004636532 | 1093 | --DSS KLIP----VKEGM-DPQKYGGLSQVSEAFAV-VIT---HE--KGKKKQLK--SDLISIPIVD QKAYEQ | 1150 |
| WP_002364836 | 1099 | --PSN KLIP----VKNGL-DPQKYGGFDPSPVVAYTV-LF--T--HE--KGK-KPL-IKQEILGITIME KTRPEQ | 1156 |
| WP_016663044 | 1050 | --PSN KLIP----VKNGL-DPQKYGGFDPSPVVAYTV-LF--T--HE--KGK-KPL-IKQEILGITIME KTRPEQ | 1107 |
| EMS75795 | 835 | --KPD KLIQ----RKAGW-DVSKYGGFGGSPVVAYAV-API----YE--KGKAR--KKAKAIEGITIMK QSLFEQ | 892 |
| WP_002373311 | 1099 | --PSN KLIP----VKNGL-DPQKYGGFDPSPVVAYTV-LF--T--HE--KGK-KPL-IKQEILGITIME KTRPEQ | 1156 |
| WP_002378009 | 1099 | --PSN KLIP----VKNGL-DPQKYGGFDPSPVVAYTV-LF--T--HE--KGK-KPL-IKQEILGITIME KTRPEQ | 1156 |
| WP_002407324 | 1099 | --PSN KLIP----VKNGL-DPQKYGGFDPSPVVAYTV-LF--T--HE--KGK-KPL-IKQEILGITIME KTRPEQ | 1156 |
| WP_002413717 | 1099 | --PSN KLIP----VKNGL-DPQKYGGFDPSPVVAYTV-LF--T--HE--KGK-KPL-IKQEILGITIME KTRPEQ | 1156 |
| WP_010777580 | 1101 | --PSN KLIP----VKNGL-DPQKYGGFDPSPVVAYTV-LF--T--HE--KGK-KPL-IKQEILGITIME KTRPEQ | 1158 |
| WP_010818269 | 1099 | --PSN KLIP----VKNGL-DPQKYGGFDPSPVVAYTV-LF--T--HE--KGK-KPL-IKQEILGITIME KTRPEQ | 1156 |
| WP_010824395 | 1099 | --PSN KLIP----VKNGL-DPQKYGGFDPSPVVAYTV-LF--T--HE--KGK-KPL-IKQEILGITIME KTRPEQ | 1156 |
| WP_016622645 | 1099 | --PSN KLIP----VKNGL-DPQKYGGFDPSPVVAYTV-LF--T--HE--KGK-KPL-IKQEILGITIME KTRPEQ | 1156 |
| WP_033624816 | 1099 | --PSN KLIP----VKNGL-DPQKYGGFDPSPVVAYTV-LF--T--HE--KGK-KPL-IKQEILGITIME KTRPEQ | 1156 |
| WP_033625576 | 1099 | --PSN KLIP----VKNGL-DPQKYGGFDPSPVVAYTV-LF--T--HE--KGK-KPL-IKQEILGITIME KTKFEQ | 1156 |
| WP_033789179 | 1099 | --PSN KLIP----VKNGL-DPQKYGGFDPSPVVAYTV-LF--T--HE--KGK-KPL-IKQEILGITIME KTRPEQ | 1156 |
| WP_002310644 | 1101 | --DSS KLLP----RKNNW-DPAKYGGLGSPNVAYTV-AFT----YE--KGKAR--KRTNALEGITIME REAFEQ | 1158 |
| WP_002312694 | 1102 | --DSS KLLP----RKNNW-DPAKYGGLGSPNVAYTV-AFT----YE--KGKAR--KRTNALEGITIME REAFEQ | 1159 |
| WP_002314015 | 1102 | --DSS KLLP----RKNNW-DPAKYGGLGSPNVAYTV-AFT----YE--KGKAR--KRTNALEGITIME REAFEQ | 1159 |
| WP_002320716 | 1102 | --DSS KLLP----RKNNW-DPAKYGGLGSPNVAYTV-AFT----YE--KGKAR--KRTNALEGITIME REAFEQ | 1159 |
| WP_002330729 | 1101 | --DSS KLIR----RKQQW-NTKKYGGFDSPVVAYAI---LLS--FD--KGK-RKARSFK-IVGITIQD RESFEG | 1158 |
| WP_002335161 | 1102 | --NPE KLIP----RKASL-DPLKYGGYGSPDSPVAYTV-IFI----FE--KGK-QK--KVIKGIEGITVME QLRFEQ | 1159 |
| WP_002345439 | 1102 | --DSD KLIS----RKTNW-SPKLYGGFDSPQVAYTV-II--T--YE--KGK-KVRA-KAIVGITIME QSLFKK | 1159 |
| WP_048604708 | 1094 | --DSD KLIS----RKKEW-DTTKYGGFDSPNVAYSV-VI--R--YE--KGK-TRKLV-KTIVGITIME RAAFEK | 1151 |
| WP_010750235 | 1095 | --KPD KLIK----RKNNH-DVTKYGGFGSPVVAYAV-VFT----YE--KGKNH--KKAKAIEGITIME QALFEK | 1152 |
| AII16583 | 1154 | --NSD KLIA----vNKLRS-NVHKYGGFEG--LKYSI---VA--IKgkKKKGKKIIDVNKLVGIPLMY RSSFEK | 1215 |
| WP_029073316 | 1100 | hsEKG AKVP----vNKLRS-NVNHKYGGFEG--LKYSI---VA--IKgkKKKGKKIIDVNKLVGIPLMY KNVDDE | 1164 |
| WP_031589969 | 1100 | nsDKD ATVP----vNKYRS-NVNKYGGFSG--VNSFI---VA--IKgkKKKGKKVIEVNKLIGIPLMY KNADEE | 1138 |
| KDA45870 | 1079 | --DSG KLLP----RKEGL-DPVKYGGYAKAVESYAV-LITAD-eVK--IKnkKGDLYKCGVETSWLAQLKQ KKAFLK | 1170 |
| WP_039099354 | 1098 | k-ASG QLIPAKQGRPTAL---YGGYSGKTVAYMC---IVR--IKnkKGDLYKCGVETSWLAQLKQ SKKYEA | 1138 |
| AKP02966 | 1119 | k-     KLIA----QKKDM-DPNIYGGFSGDNKSSIT--IVK-T--ID-----NNKIKPVA--IPIRLIN ----DK | 1172 |

```
                                                                                                                                                -continued
WP_010991369    1096   --NSS----KLIP----RKTNW-DPMKYGGLDSPNMAYAV-VI--E--YA--KGK-NKLVFEKKIIRVTIME RKAFEK    1154
WP_033838504    1096   --NSS----KLIS----RKTNW-DPMKYGGLDSPNMAYAV-VI--E--YA--KGK-NKLVFEKKIIRVTIME RKAFEK    1154
EHN60060        1099   --NSS----KLIS----RKTNW-DPMKYGGLDSPNMAYAV-VI--E--YA--KGK-NKLVFEKKIIRVTIME RKAFEK    1157
EFR89594        865    --NSS----KLIP----RKADW-NPIKYGGFDGSNMAYSI-VI--E--YE--KRK-KKTVIKKELIQINIME RVAFEK    923
WP_038409211    1096   --NSS----KLIS----RKADW-NPIKYGGFDGSNMAYSI-VI--E--YE--KRK-KKTVIKKELIQINIME RVAFEK    1154
EFR95520        715    --NSS----KLIP----RKENW-DPMKYGGLDSPNMAYAV-II--E--HA--KGK-KKIVIEKKLIQINIME RKMFEK    773
WP_003723650    1096   --NSS----KLIP----RKENW-DPMKYGGLDSPNMAYAV-II--E--HA--KGK-KKIVIEKKLIQINIME RKMFEK    1154
WP_003727705    1096   --NSS----KLIP----RKENW-DPVKYGGLDSPNMAYAV-II--E--HA--KGK-KKIVIEKKLIQINIME RKMFEK    1154
WP_003730785    1096   --NSS----KLIP----RKENW-DPVKYGGLDSPNMAYAV-II--E--HA--KGK-RKVRIEKKLIQINIME REAFEK    1154
WP_003733029    1096   --KSN----KLIP----RKKDW-DPIKYGGFDGSKMAYAV-II--E--YE--KQK-RKVRIEKKLIQINIME RKAFEK    1154
WP_003739838    1096   --NSS----KLIP----RKENW-DPMKYGGLDSPNMAYAV-II--E--HA--KGK-KKLIFEKKIIRITIME RKMFEK    1154
WP_014601172    1096   --NSS----KLIP----RKENW-DPMKYGGLDSPNMAYAV-II--E--HA--KGK-KKLIFEKKIIRITIME RKMFEK    1154
WP_023548323    1096   --DSS----KLIP----KKTNL-NPIKYGGFEGSNMAYAI-II--E--HA--KRK-KKVTIEKKLIQINIME RKAFEK    1154
WP_031666337    1096   --NSS----KLIP----RKENW-DPMKYGGLDSPNMAYAI-II--E--HA--KGK-KRIVIEKKLIQINIME RKMFEK    1154
WP_031669209    1096   --KSN----KLIP----RKKDW-DPIKYGGFDGSKMAYAI-II--E--YE--KQK-RKVRIEKKLIQINIME REAFEK    1154
WP_033920898    1096   --DSS----KLIP----KKTNL-NPIKYGGFEGSNMAYAI-II--E--HE--KRK-KKVTIEKKLIQINIME RKAFEK    1154
AKI42028        1099   --NSS----KLIP----RKENW-DPMKYGGLDSPNMAYAV-II--E--HA--KGK-KKLIFEKKIIRITIME RKMFEK    1157
AKI50529        1099   --DSS----KLIP----KKTNL-NPIKYGGFEGSNMAYAI-II--E--HE--KRK-KKVTIEKKLIQINIME RKAFEK    1157
EFR83390        544    --NSS----KLIP----RKADW-DPIKYGGFDGSNMAYAV-VI--E--HE--KRK-KKTVIKKELIQINIME RTAFEK    602
WP_046323366    1096   --NSD----KLIA----RKKDW-DPKKYGGFDGSPIVAYSV-LVVAK-VE--KGKSKKLKSVKELLGITIME RSSFEK    1154
AKE81011        1131   hsAKG----AVIP----vNKNRK-DVNKYGGFSG--LQYVI----AA--IEgtKKKGKKLVKRKLSGIPLYL KQADIK    1192
CU082355        1089   hsEKG----ATVP----INKYRA-DVHKYGGFGN--VQSII----VA--IEghKKKGKKLIDVRKLISIPLHL KNAPVE    1153
WP_033162887    1090   --NSD----KLIA----RKKDW-DPKKYGGFGPDSPIVAYSV-LVVAK-VE--KGKSKKLKSVKELLGITIME RSSFEK    1154
AGZ01981        1148   --NSD----KLIA----RKKDW-DPKKYGGFGPDSPIVAYSV-LVVAK-VE--KGKSKKLKSVKELLGITIME RSSFEK    1209
AKA60242        1115   --NSD----KLIA----RKKDW-DPKKYGGFGPDSPIVAYSV-LVVAK-VE--KGKSKKLKSVKELLGITIME RSSFEK    1176
AKS40380        1115   --NSD----KLIA----RKKDW-DPKKYGGFGPDSPIVAYSV-LVVAK-VE--KGKSKKLKSVKELLGITIME RSSFEK    1176
4UN5_B          1119   --NSD----KLIA----RKKDW-DPKKYGGFGPDSPIVAYSV-LVVAK-VE--KGKSKKLKSVKELLGITIME RSSFPEK   1180
WP_010922251    1177   NPI---DFLE--AKGYKE--V-KKDLIIK--LPKYSLFE---LENGRKRMLAS-QFLQKGNELALPSKYVNFLYLA       1239

WP_039695303    1186   NPV---EFLE--NKGYHN--I-REDKLIK--LPKYSLFE--FEGGRRRLLAS ASELQKGNEMVLPGYLVELLYHA        1248
WP_045635197    1184   NPI---TFLE--NKGYHN--V-RKENILC--LPKYSLFE---LENGRPRLLAS AKELQKGNEIVLPVYLTTLLYHS       1246
5AXW_A          913    KPYrfdVYLD--NGVYKFvtV-KNLDVIK---KENYYE---VNSKAYEEAKK -KKISNQAEFIASFYNNDLIKIN        978
WP_009880683    861    DPV---DFLE--AKGYKE--V-RKDLIIK--LPKYSLFE---LENGRKRMLAS -GELQKGNELALPSKYVNFLYLA       923
WP_010922251    1177   NPI---DFLE--AKGYKE--V-KKDLIIK--LPKYSLFE---LENGRKRMLAS -GELQKGNELALPSKYVNFLYLA       1239
WP_011054416    1177   DPI---DFLE--AKGYKE--V-RKDLIIK--LPKYSLFE---LENGRKRMLAS -GELQKGNELALPSKYVNFLYLA       1239
WP_011284745    1177   NPI---DFLE--AKGYKE--V-RKDLIIK--LPKYSLFE---LENGRKRMLAS -GELQKGNELALPSKYVNFLYLA       1239
WPO11285506     1177   NPI---DFLE--AKGYKE--V-RKDLIIK--LPKYSLFE---LENGRKRMLAS -GELQKGNELALPSKYVNFLYLA       1239
WP_011527619    1177   NPI---DFLE--AKGYKE--V-RKDLIIK--LPKYSLFE---LENGRKRMLAS -GELQKGNELALPSKYVNFLYLA       1239
WP_012560673    1176   DPV---DFLE--AKGYKE--V-RKDLIIK--LPKYSLFE---LENGRKRMLAS -GELQKGNELALPSKYVNFLYLA       1238
WP_014407541    1176   NPI---DFLE--AKGYKE--V-RKDLIIK--LPKYSLFE---LENGRKRMLAS -GELQKGNELALPSKYVNFLYLA       1238
WP_020905136    1176   NPI---DFLE--AKGYKE--V-RKDLIIK--LPKYSLFE---LENGRKRMLAS -GELQKGNELALPSKYVNFLYLA       1238
WP_023080005    1176   NPI---DFLE--AKGYKE--V-RKDLIIK--LPKYSLFE---LENGRKRMLAS -GELQKGNELALPSKYVNFLYLA       1238
WP_023610282    1177   NPI---DFLE--AKGYKE--V-RKDLIIK--LPKYSLFE---LENGRKRMLAS -GELQKGNELALPSKYVNFLYLA       1239
WP_023125963    1177   NPI---DFLE--AKGYKE--V-RKDLIIK--LPKYSLFE---LENGRKRMLAS -GELQKGNELALPSKYVNFLYLA       1239
WP_030126706    1177   NPI---DFLE--AKGYKE--V-RKDLIIK--LPKYSLFE---LENGRKRMLAS -GELQKGNELALPSKYVNFLYLA       1239
WP_031488318    1177   NPI---DFLE--AKGYKE--V-RKDLIIK--LPKYSLFE---LENGRKRMLAS -GELQKGNELALPSKYVNFLYLA       1239
WP_032460140    1177   DPV---DFLE--AKGYKE--V-RKDLIIK--LPKYSLFE---LENGRKRMLAS -GELQKGNELALPSKYVNFLYLA       1239
WP_032461047    1177   NPI---DFLE--AKGYKE--V-RKDLIIK--LPKYSLFE---LENGRKRMLAS -GELQKGNELALPSKYVNFLYLA       1239
WP_032462016    1177   NPI---DFLE--AKGYKE--V-RKDLIIK--LPKYSLFE---LENGRKRMLAS -GELQKGNELALPSKYVNFLYLA       1239
WP_032462936    1177   NPI---DFLE--AKGYKE--V-RKDLIIK--LPKYSLFE---LENGRKRMLAS -GELQKGNELALPSKYVNFLYLA       1239
WP_032464890    1002   NPI---DFLE--AKGYKE--V-RKDLIIK--LPKYSLFE---LENGRKRMLAS -GELQKGNELALPSKYVNFLYLA       1064
WP_033889930    1177   NPI---DFLE--AKGYKE--V-RKDLIIK--LPKYSLFE---LENGRKRMLAS -GELQKGNELALPSKYVNFLYLA       1239
WP_038431314    1177   NPI---DFLE--AKGYKE--V-RKDLIIK--LPKYSLFE---LENGRKRMLAS -GELQKGNELALPSKYVNFLYLA       1239
```

```
                                -continued
WP_038432938   1176  NPI---DFLE---AKGYKE--V-RKDLIIK--LPKYSLFE---LENGRKRMLAS--GELQKGNELALPSKYVNFLYLA   1238
WP_038434062   1177  NPI---DFLE---AKGYKE--V-RKDLIIK--LPKYSLFE---LENGRKRMLAS--GELQKGNELALPSKYVNFLYLA   1239
BAQ51233       1088  NPI---DFLE---AKGYKE--V-KKDLIIK--LPKYSLFE---LENGRKRMLAS--GELQKGNELALPSKYVNFLYLA   1150
KGE60162        352  DPI---DFLE---AKGYKE--V-RKDLIIK--LPKYSLFE---LENGRKRMLAS--GELQKGNELALPSKYVNFLYLA    414
KGE60856        115  DPI---DFLE---AKGYKE--V-RKDLIIK--LPKYSLFE---LENGRKRMLAS--GELQKGNELALPSKYVNFLYLA    177
WP_002989955   1177  NPI---DFLE---AKGYKE--V-RKDLIIK--LPKYSLFE---LENGRKRMLAS--GELQKGNELALPSKYVNFLYLA   1239
WP_003030002   1159  HPV---DFLE---QRGYRN--V-RLEKIIK--LPKYSLFE---LENKRRLLAS--ARELQKGNELVIPQRFTLLYHS   1221
WP_003065552   1187  NPV---EFLE---NKGYHN--I-REDKLIK--LPKYSLFE---PEGGKRRLLAS--ASELQKGNEMVIPGHLVKLLYHA   1249
WP_001040076   1178  NPS---AFLE---SKGYLN--I-RTDKLII--LPKYSLFE---LENGRRRLLAS--AGELQKGNELALPTQFMKFLYLA   1240
WP_001040078   1178  NPS---AFLE---SKGYLN--I-RDDKLMI--LPKYSLFE---LENGRRRLLAS--AGELQKGNELALPTQFMKFLYLA   1240
WP_001040080   1178  NPS---AFLE---SKGYLN--I-RADKLII--LPKYSLFE---LENGRRRLLAS--AGETIDRLQKGNELALPTQFMKFLYLA   1248
WP_001040081   1178  NPS---AFLE---SKGYLN--I-RADKLII--LPKYSLFE---LENGRRRLLAS--AGELQKGNELALPTQFMKFLYLA   1240
WP_001040083   1178  NPS---AFLE---SKGYLN--I-RADKLII--LPKYSLFE---LENGRRRLLAS--AGELQKGNELALPTQFMKFLYLA   1240
WP_001040085   1178  NPS---AFLE---SKGYLN--I-RADKLII--LPKYSLFE---LENGRRRLLAS--AGELQKGNELALPTQYMKFLYLA   1240
WP_001040087   1178  NPS---AFLE---SKGYLN--I-RADKLII--LPKYSLFE---LENGRRRLLAS--ADELQKGNELALPTQFMKFLYLA   1240
WP_001040088   1178  NPS---AFLE---SKGYLN--I-RDDKLMI--LPKYSLFE---LENGRRRLLAS--AGELQKGNELALPTQFMKFLYLA   1240
WP_001040089   1178  NPS---AFLE---SKGYLN--I-RDDKLMI--LPKYSLFE---LENGRRRLLAS--AGELQKGNELALPTQFMKFLYLA   1240
WP_001040090   1178  NPS---AFLE---SKGYLN--I-RDDKLMI--LPKYSLFE---LENGRRRLLAS--AGELQKGNELALPTQYMKFLYLA   1240
WP_001040091   1178  NPS---AFLE---SKGYLN--I-RTDKLII--LPKYSLFE---LENGRRRLLAS--AGELQKGNELALPTQYMKFLYLA   1240
WP_001040092   1178  NPS---AFLE---SKGYLN--I-RADKLII--LPKYSLFE---LENGRRRLLAS--AGELQKGNELALPTQYMKFLYLA   1240
WP_001040094   1178  NPS---AFLE---SKGYLN--I-RDDKLMI--LPKYSLFE---LENGRRRLLAS--AGELQKGNELALPTQYMKFLYLA   1240
WP_001040095   1178  NPS---AFLE---SKGYLN--I-RTDKLII--LPKYSLFE---LENGRRRLLAS--AGELQKGNELALPTQYMKFLYLA   1240
WP_001040096   1178  NPS---AFLE---SKGYLN--I-RTDKLII--LPKYSLFE---LENGRRRLLAS--AGELQKGNELALPTQYMKFLYLA   1240
WP_001040097   1178  NPS---AFLE---SKGYLN--I-RDDKLMI--LPKYSLFE---LENGRRRLLAS--AGELQKGNELALPTQYMKFLYLA   1240
WP_001040098   1178  NPS---AFLE---SKGYLN--I-RDDKLMI--LPKYSLFE---LENGRRRLLAS--AGELQKGNELALPTQFMKFLYLA   1240
WP_001040099   1178  NPS---AFLE---SKGYLN--I-RDDKLMI--LPKYSLFE---LENGRRRLLAS--AGELQKGNELALPTQFMKFLYLA   1240
WP_001040100   1178  NPS---AFLE---SKGYLD--I-RDDKLMI--LPKYSLFE---LENGRRRLLAS--AGELQKGNELALPTQFMKFLYLA   1240
WP_001040104   1178  NPS---AFLE---SKGYLN--I-RDDKLMI--LPKYSLFE---LENGRRRLLAS--AGELQKGNELALPTQYMKFLYLA   1240
WP_001040105   1178  NPS---AFLE---SKGYLN--I-RADKLII--LPKYSLFE---LENGRRRLLAS--AGELQKGNELALPTQYMKFLYLA   1240
WP_001040106   1178  NPS---AFLE---SKGYLN--I-RDDKLMI--LPKYSLFE---LENGRRRLLAS--AGELQKGNELALPTQYMKFLYLA   1240
WP_001040107   1178  NPS---AFLE---SKGYLN--I-RDDKLMI--LPKYSLFE---LENGRRRLLAS--AGELQKGNELALPTQYMKFLYLA   1240
WP_001040108   1178  NPS---AFLE---SKGYLN--I-RDDKLMI--LPKYSLFE---LENGRRRLLAS--AGELQKGNELALPTQYMKFLYLA   1240
WP_001040109   1178  NPS---AFLE---SKGYLN--I-RDDKLMI--LPKYSLFE---LENGRRRLLAS--AGELQKGNELALPTQYMKFLYLA   1240
WP_001040110   1178  NPS---AFLE---SKGYLN--I-RDDKLMI--LPKYSLFE---LENGRRRLLAS--AGELQKGNELALPTQYMKFLYLA   1240
WP_015058523   1178  NPS---AFLE---SKGYLN--I-RTDKLII--LPKYSLFE---LENGRRRLLAS--AGELQKGNELALPTQYMKFLYLA   1240
WP_017643650   1178  NPS---AFLE---SKGYLN--I-RDDKLMI--LPKYSLFE---LENGRRRLLAS--AGELQKGNELALPTQYMKFLYLA   1240
WP_017647151   1178  NPS---AFLE---SKGYLN--I-RDDKLMI--LPKYSLFE---LENGRRRLLAS--AGELQKGNELALPTQYMKFLYLA   1240
WP_017648376   1192  NPS---AFLE---SKGYLN--I-RDDKLMI--LPKYSLFE---LENGRRRLLAS--AGELQKGNELALPTQYMKFLYLA   1254
WP_017649527   1178  NPS---AFLE---SKGYLN--I-RADKLII--LPKYSLFE---LENGRRRLLAS--AGELQKGNELALPTQYMKFLYLA   1240
WP_017771611   1178  NPS---AFLE---SKGYLN--I-RDDKLMI--LPKYSLFE---LENGRRRLLAS--AGELQKGNELALPTQYMKFLYLA   1240
WP_017771984   1178  NPS---AFLE---SKGYLN--I-RDDKLMI--LPKYSLFE---LENGRRRLLAS--AGELQKGNELALPTQYMKFLYLA   1240
CFQ25032       1178  NPS---AFLE---SKGYLN--I-RDDKLMI--LPKYSLFE---LENGRRRLLAS--AGELQKGNELALPTQYMKFLYLA   1240
CFV16040       1178  NPS---AFLE---SKGYLN--I-RDDKLMI--LPKYSLFE---LENGRRRLLAS--AGELQKGNELALPTQYMKFLYLA   1240
KLJ37842       1178  NPS---AFLE---SKGYLN--I-RADKLII--LPKYSLFE---LENGRRRLLAS--AGELQKGNELALPTQYMKFLYLA   1240
KLJ72361       1178  NPS---AFLE---SKGYLN--I-RDDKLMI--LPKYSLFE---LENGRRRLLAS--AGELQKGNELALPTQYMKFLYLA   1240
KLL20707       1178  NPS---AFLE---SKGYLN--I-RDDKLMI--LPKYSLFE---LENGRRRLLAS--AGELQKGNELALPTQYMKFLYLA   1240
KLL42645       1178  NPS---AFLE---SKGYLN--I-RDDKLMI--LPKYSLFE---LENGRRRLLAS--AGELQKGNELALPTQYMKFLYLA   1240
WP_047207273   1178  NPS---AFLE---SKGYLN--I-RDDKLMI--LPKYSLFE---LENGRRRLLAS--AGELQKGNELALPTQYMKFLYLA   1240
WP_047209694   1178  NPS---AFLE---SKGYLN--I-RDDKLMI--LPKYSLFE---LENGRRRLLAS--AGELQKGNELALPTQYMKFLYLA   1240
WP_050198062   1178  NPS---AFLE---SKGYLN--I-RDDKLMI--LPKYSLFE---LENGRRRLLAS--AGELQKGNELALPTQYMKFLYLA   1240
WP_050201642   1178  NPS---AFLE---SKGYLN--I-RDDKLMI--LPKYSLFE---LENGRRRLLAS--AGELQKGNELALPTQYMKFLYLA   1240
WP_050204027   1178  NPS---AFLE---SKGYLN--I-RDDKLMI--LPKYSLFE---LENGRRRLLAS--AGELQKGNELALPTQYMKFLYLA   1240
WP_050881965   1178  NLS---AFLE---SKGYLN--I-RADKLII--LPKYSLFE---LENGRRRLLAS--AGELQKGNELALPTQFMKFLYLA   1240
```

```
WP_050886065   1178 NPS---AFLE---SKGYLN--I-RADKLII--LPKYSLFE---LENGRRRLLAS AGELQKGNELALPTQFMKFLYLA 1240
AHN30376       1178 NPS---AFLE---SKGYLN--I-RTDKLII--LPKYSLFE---LENGRRRLLAS AGELQKGNELALPTQYMKFLYLA 1240
EAO78426       1178 NPS---AFLE---SKGYLN--I-RADKLII--LPKYSLFE---LENGRRRLLAS AGELQKGNELALPTQFMKFLYLA 1240
CCW42055       1178 NPS---AFLE---SKGYLN--I-RTDKLII--LPKYSLFE---LENGRRRLLAS AGELQKGNELALPTQFMKFLYLA 1240
WP_003041502   1186 DKR---AFLL---GKGYKD--I-K--KIIE--LPKYSLFE---LKDGSRRMLAS RGEIHKGNELFVPQKFTLLYHA 1253
WP_037593752   1160 NPV---DFLE---QRGYRN--V-RLEKIIK--LPKYSLFE---LENKRRRLLAS ARELQKGNELVIPQRFTLLYHS 1222
WP_049516684   1160 HPV---DFLE---QRGYRN--V-RLEKIIK--LPKYSLFE---LENKRRRLLAS ARELQKGNELVIPQRFTLLYHS 1222
GAD46167       1159 NPV---DFLE---QRGYRN--V-RLEKIIK--LPKYSLFE---LENKRRRLLAS ARELQKGNELVIPQRFTLLYHS 1221
WP_018363470   1191 EFLK---NKGYQN--V-QEDKLMK--LPKYSLFE---FEGGRRRLLAS ATELQKGNEIMLSAHLVALLYHA 1253
WP_003043819   1186 DPI---GFLE---AKGYKD--I-KKELIFK--LPKYSLFE---LENGRRRMLAS --ELQKANELVLPQHLVRLLYYT 1248
WP_006269658   1159 NPV---DFLE---QRGYRN--V-RLEKIIK--LPKYSLFE---LENKRRRLLAS AKELQKGNELVIPQRFTLLYHS 1221
WP_048800089   1179 NPI---MFLE---SKGYRN--I-QKDKLIK--LPKYSLFE---FEGGRRRLLAS AVELQKGNEMVLPQYLNNLLYHA 1241
WP_012767106   1178 NPL---KFIE---DKGYGN--V-QIDKCIK--LPKYSLFE---FENGTRRMLAS RGDLQKANEMFLPAKLVTLLY- 1245
WP_014612333   1178 NPL---KFIE---DKGYGN--V-QIDKCIK--LPKYSLFE---FENGTRRMLAS RGDLQKANEMFLPAKLVTLLY- 1245
WP_015017095   1178 NPL---KFIE---DKGYGN--V-QIDKCIK--LPKYSLFE---FENGTRRMLAS RGDLQKANEMFLPAKLVTLLY- 1245
WP_015057649   1178 NPL---KFIE---DKGYGN--V-QIDKCIK--LPKYSLFE---FENGTRRMLAS RGDLQKANEMFLPAKLVTLLY- 1245
WP_048327215   1178 NPL---KFIE---DKGYGN--V-QIDKCIK--LPKYSLFE---FENGTRRMLAS RGDLQKANEMFLPAKLVTLLY- 1245
WP_049519324   1178 NPL---KFIE---DKGYGN--V-QIDKCIK--LPKYSLFE---FENGTRRMLAS RGDLQKANEMFLPAKLVTLLY- 1245
WP_012515931   1157 NPV---VFLE---ARGYRE--I-QEHLIIK--LPKYSLFE---LENGRRRLLAS --SELQKGNELFLPVDYMTFLYLA 1219
WP_021320964   1157 NPV---VFLE---AKGYRE--I-QEHLIIK--LPKYSLFE---LENGRRRLLAS --SELQKGNELFLPVDYMTFLYLA 1219
WP_037581760   1189 NPV---VFLE---AKGYHN--V-QEDKLIK--LPKYSLFE---LENGRRRLLAS --SELQKGNELFLPVDYMTFLYLA 1251
WP_004232481   1184 NPV---SFLE---KKGYHN--V-QEDKLIK--LPKYSLFE---FEGGRRRLLAS ATELQKGNELVLPQYMVNLLYHS 1246
WP_009854540   1185 NPV---EFLE---NKGYHN--I-REDKLIK--LPKYSLFE---LENGRRRLLAS ASELQKGNEMVLSRHLVELLYHA 1247
WP_012962174   1186 NPV---VFLE---VFLE---KKGYQN--V-QIDNLIK--LPKYSLFE---FEGGRRRLLAS ASELQKGNEMVLPGYLVELLYHA 1248
WP_039695303   1189 NPV---EFLE---NKGYHN--I-REDKLIK--LPKYSLFE---LENGRRRLLAS ASELQKGNEVMLPAHLVELLYHA 1251
WP_014334983   1177 DPI---SFLE---KKGYHN--V-QEDKLIK--LPKYSLFE---FEGGRRRLLAS ATELQKGNEVMLPGYIVELLYHA 1239
WP_003092269   1177 DPI---AFLE---KKGYQD--I-QTSSIIK--LPKYSLFE---LENGRKRLLAS --ELQKGNELALPNKYVKFYLA 1239
AHY15608       9    DPI---AFLE---KKGYQD--I-QTSSIIK--LPKYSLFE---LENGRKRLLAS --ELQKGNELALPNKYVKFYLA 71
ESR09100       1177 DPI---AFLE---KKGYQD--I-QTSSIIK--LPKYSLFE---LENGRKRLLAS --KELQKGNELALPNKYVKFYLA 1239
AGM98575       1159 NPV---AFLE---RRGYRN--V-QEENIVK--LPKYSLFE---LENGRRRLLAS --ELQKGNELALPNHLGTMLYHA 1228
ALF27331       1168 EPEr---FLA---QKGFER--V-EKT--IK--LPKYSLFE---MEKGRRRLLAS SGEIQKGNQVLLPEHLIRLLSYA 1228
WP_018372492   1189 NPI---AYLE---ECGYKN--I-NPNLIIK--LPKYSLFE---FNNGQRRLLAS SIELQKGNELIVPYHFTALLYHA 1251
WP_045618028   1184 NPI---TFLE---NKGYHN--V-RKENILC--LPKYSLFE---LENGRRRLLAS AKELQKGNEIVLPVYLTTLLYHS 1246
WP_045635197   1159 DPV---AFLE---RKGYRN--V-QEENIIK--LPKYSLFK---LENGRRRLLAS ARELQKGNEIVLPNHLGTLLYHA 1221
WP_002263549   1159 DPV---AFLE---RKGYRN--V-QEENIIK--LPKYSLFK---LENGRRRLLAS ARELQKGNEIVLPNHLGTLLYHA 1221
WP_002263887   1159 DPV---AFLE---RKGYRN--V-QEENIIK--LPKYSLFK---LENGRRRLLAS ARELQKGNEIVLPNHLGTLLYHA 1221
WP_002264920   1159 DPV---AFLE---RKGYRN--V-QEENIIK--LPKYSLFK---LENGRRRLLAS ARELQKGNEIVLPNHLGTLLYHA 1221
WP_002269043   1159 DPV---AFLE---RKGYRN--V-QEENIIK--LPKYSLFK---LENGRKRLLAS ARELQKGNEIVLPNHLGTLLYHA 1221
WP_002269448   1159 DPV---AFLE---RKGYRN--V-QEENIIK--LPKYSLFK---LENGRKRLLAS ARELQKGNEIVLPNHLGTLLYHA 1221
WP_002271977   1159 DPV---AFLE---RKGYRN--V-QEENIIK--LPKYSLFK---LENGRKRLLAS ARELQKGNEIVLPNHLGTLLYHA 1221
WP_002272766   1159 DPV---AFLE---RKGYRN--V-QEENIIK--LPKYSLFK---LENGRKRLLAS ARELQKGNEIVLPNHLGTLLYHA 1221
WP_002273241   1159 DPV---AFLE---RKGYRN--V-QEENIIK--LPKYSLFK---LENGRKRLLAS ARELQKGNEIVLPNHLGTLLYHA 1221
WP_002275430   1159 DPV---AFLE---RKGYRN--V-QEENIIK--LPKYSLFK---LENGRKRLLAS ARELQKGNEIVLPNHLGTLLYHA 1221
WP_002276448   1159 DPV---AFLE---RKGYRN--V-QEENIIK--LPKYSLFK---LENGRKRLLAS ARELQKGNEIVLPNHLGTLLYHA 1221
WP_002277050   1167 NPV---KFLK---DKGYQQ--I-EKNNFVK--LPKYTLVD---IGNGIKRLWAS SKEVHKGNQLVVSKKSQDLLYHA 1229
WP_002273364   1159 DPV---AFLE---RKGYRN--V-QEENIIK--LPKYSLFK---LENGRKRLLAS ARELQKGNEIVLPNHLGTLLYHA 1221
WP_002279025   1159 DPV---AFLE---RKGYRN--V-QEENIIK--LPKYSLFK---LENGRKRLLAS ARELQKGNEIVLPNHLGTLLYHA 1221
WP_002279859   1159 DPV---AFLE---RKGYRN--V-QEENIIK--LPKYSLFK---LENGRKRLLAS ARELQKGNEIVLPNHLGTLLYHA 1221
WP_002280230   1159 DPV---AFLE---RKGYRN--V-QEENIIK--LPKYSLFK---LENGRKRLLAS ARELQKGNEIVLPNHLGTLLYHA 1221
WP_002281696   1159 DPV---AFLE---RKGYRN--V-QEENIIK--LPKYSLFK---LENGRKRLLAS ARELQKGNEIVLPNHLGTLLYHA 1221
WP_002282247   1167 NPV---KFLK---DKGYQQ--I-EKNNFVK--LPKYTLVD---IGNGIKRLWAS SKEVHKGNQLVVSKKSQDLLYHA 1229
WP_002282906   1159 DPV---AFLE---RKGYRN--V-QEENIIK--LPKYSLFK---LENGRKRLLAS ARELQKGNEIVLPNHLGTLLYHA 1221
```

-continued

```
WP_002283846  1159  DPV---AFLE---RKGYRN--V-QEENIIK---LPKYSLFK---LENGRKRLLAS  ARELQKGNEIVLPNHLGTLLYHA  1221
WP_002287255  1159  DPV---AFLE---RKGYRN--V-QEENIIK---LPKYSLFK---LENGRKRLLAS  ARELQKGNEIVLPNHLGTLLYHA  1221
WP_002288990  1159  DPV---AFLE---RKGYRN--V-QEENIIK---LPKYSLFK---LENGRKRLLAS  ARELQKGNEIVLPNHLGTLLYHA  1221
WP_002289641  1159  DPV---AFLE---RKGYRN--V-QEENIIK---LPKYSLFK---LENGRKRLLAS  ARELQKGNEIVLPNHLGTLLYHA  1221
WP_002290427  1159  DPV---AFLE---RKGYRN--V-QEENIIK---LPKYSLFK---LENGRKRLLAS  ARELQKGNEIVLPNHLGTLLYHA  1221
WP_002295753  1159  DPI---AFLE---RKGYRN--V-QEENIIK---LPKYSLFK---LENGRKRLLAS  ARELQKGNEIVLPNHLGTLLYHA  1221
WP_002296423  1159  DPV---AFLE---RKGYRN--V-QEENIIK---LPKYSLFK---LENGRKRLLAS  ARELQKGNEIVLPNHLGTLLYHA  1221
WP_002304487  1159  DPI---AFLE---RKGYRN--V-QEENIIK---LPKYSLFK---LENGRKRLLAS  ARELQKGNEIVLPNHLETLLYHA  1235
WP_002305844  1173  DPV---AFLE---RKGYRN--V-QEENIIK---LPKYSLFK---LENGRKRLLAS  ARELQKGNEIVLPNHLGTLLYHA  1221
WP_002307203  1159  DPI---AFLE---RKGYRN--V-QEENIIK---LPKYSLFK---LENGRKRLLAS  ARELQKGNEIVLPNHLGTLLYHA  1221
WP_002310390  1159  DPV---AFLE---RKGYRN--V-QEENIIK---LPKYSLFK---LENGRKRLLAS  ARELQKGNEIVLPNHLGTLLYHA  1221
WP_002352408  1159  DPV---AFLE---RKGYRN--V-QEENIIK---LPKYSLFK---LENGRKRLLAS  ARELQKGNEIVLPDHLGTLLYHA  1221
WP_012997688  1159  DPV---AFLE---RKGYRN--V-QEENIIK---LPKYSLFK---LENGRKRLLAS  ARELQKGNEIVLPNHLGTLLYHA  1221
WP_014677909  1159  DPV---AFLE---RKGYRN--V-QEENIIK---LPKYSLFK---LENGRKRLLAS  ARELQKGNEIVLPNHLGTLLYHA  1221
WP_019112892  1159  DPV---AFLE---RKGYRN--V-QEENIIK---LPKYSLFK---LENGRKRLLAS  ARELQKGNEIVLPNHLGTLLYHA  1221
WP_019113659  1159  DPV---AFLE---RKGYRN--V-QEENIIK---LPKYSLFK---LENGRKRLLAS  ARELQKGNEIVLPNHLGTLLYHA  1221
WP_019114093  1159  DPI---AFLE---RKGYRN--V-QEENIIK---LPKYSLFK---LENGRKRLLAS  ARELQKGNEIVLPNHLGTLLYHA  1221
WP_019315370  1159  DPV---AFLE---RKGYRN--V-QEENIIK---LPKYSLFK---LENGRKRLLAS  ARELQKGNEIVLPNHLGTLLYHA  1221
WP_019803776  1159  DPV---AFLE---RKGYRN--V-QEENIIK---LPKYSLFK---LENGRKRLLAS  ARELQKGNEIVLPNHLGTLLYHA  1221
WP_019805234  1159  DPV---AFLE---RKGYRN--V-QEENIIK---LPKYSLFK---LENGRKRLLAS  ARELQKGNEIVLPNHLGTLLYHA  1221
WP_024783594  1159  DPV---AFLE---RKGYRN--V-QEENIIK---LPKYSLFK---LENGRKRLLAS  ARELQKGNEIVLPNHLGTLLYHA  1221
WP_024784288  1167  NPV---KFLK---DKGYQQ--I-EKNNFVK---LPKYTLVD---IGNGIKRLWAS  SKEVHKGNQLVVSKKSQDLLYHA  1229
WP_024784666  1159  DPV---AFLE---RKGYRN--V-QEENIIK---LPKYSLFK---LENGRKRLLAS  ARELQKGNEIVLPNHLGTLLYHA  1221
WP_024784894  1167  NPV---KFLK---DKGYQQ--I-EKNNFVK---LPKYTLVD---IGNGIKRLWAS  SKEVHKGNQLVVSKKSQDLLYHA  1229
WP_024786433  1159  DPV---AFLE---RKGYRN--V-QEENIIK---LPKYSLFK---LENGRKRLLAS  ARELQKGNEIVLPNHLGTLLYHA  1221
WP_049473442  1159  DPV---AFLE---RKGYRN--V-QEENIIK---LPKYSLFK---LENGRKRLLAS  ARELQKGNEIVLPNHLGTLLYHA  1221
WP_049474547  1152  DPV---AFLE---RKGYRN--V-QEENIIK---LPKYSLFK---LENGRKRLLAS  ARELQKGNEIVLPNHLGTLLYHA  1214
EMC03581      1187  SPI---AFLE---NKGYHN--V-RKENILC---LPKYSLFE---LKNGRRRMLAS  AKELQKGNEIVLPVHLTTLLYHA  1249
WP_000428612  1185  NPI---TFLE---NKGYHN--V-RKENILC---LPKYSLFE---LENGRRRLLAS  SIELQKGNELIIPVHLTALLYHS  1247
WP_000428613  1180  NPV---AFLE---GKGYQN--V-VEENIIR---LPKYSLFE---LENGRRRMLAS  AKELQKGNEMVLPSYLIALLYHA  1242
WP_049523028  1146  DRI---TFLE---KKGYQD--I-QEHLMIT---LPKFSLFE---LENGRRRLLAS  --ELQKGNELSLPNKYIQFLYLA  1208
WP_003107102  1179  NPI---TFLE---SKGYHD--I-QEHLMIT---LPKYSLFE---LENGRRRLLAS  --ELQKGNEMVLPQHLVTFLYRV  1241
WP_054279288  1189  NPT---AYLE---EYGYKN--I-NPNLIIK---LPKYSLFK---FNDGQRRLLAS  SIELQKGNELILPYHFTLLLYHA  1251
WP_049531101  1189  NPI---AYLE---ECGYKN--I-NPNLIIK---LPKYSLFE---FNGGQRRLLAS  SIELQKGNELILPYHFTALLYHT  1251
WP_049538452  1191  NPI---AYLE---ECGYKN--I-NPNLIIK---LPKYSLFE---FNGGQRRLLAS  SIELQKGNELILPYHFTALLYHA  1253
WP_049549711  1183  DNI---AFLE---KKGYQD--I-QEKLLIK---LPKYSLFE---LENGRRRLLAS  --EFQKGNELALSGKYMKFLYLA  1245
WP_007896501  1186  DNI---AFLE---KKGYQD--I-QEKLLIK---LPKYSLFE---LENGRRRLLAS  --EFQKGNELALSGKYMKFLYLA  1197
EFR44625      1135  SETslgAYIA---EQIKSE-VelIN---grILKYQLIS---NNgNRLYIAG      AIELQKGNEMFLPQQFVNLLYHA  1246
WP_002897477  1184  NPI---TFLE---NKGYHN--V-RKENILC---LPKYSLFE---LESGRRRMLAS  AKELQKGNEIVLPVYLTLLLYHS  1246
WP_002906454  1190  NPV---TYLE---ECGYKN--I-NSNLIIK---LPKYSLFE---FNDGQRRLLAS  SIELQKGNELIIPYHLTALLYHA  1252
WP_009729476  1185  NPI---AFLE---NKGYKN--V-CKENILC---LPKYSLFE---LENGRRRLLAS  AKELQKCNEIVLPVYLTTLLYHS  1247
CQR24647      1175  NSV---TFLE---EKGYKN--I-RENTIIK---FPKYSLFE---LENGRRRLLAS  AIELQKGNEMFLPQQFVNLLYHA  1237
WP_000066813  1189  NPI---TFLE---NKGYHN--V-RKENILC---LPKYSLFE---LESGRRRMLAS  AKELQKGNEIVLPVYLTTLLLYHS  1251
WP_009754323  1185  NPI---TFLE---NKGYHN--V-RKENILC---LPKYSLFE---LENGRRRLLAS  AKELQKGNEMILPPHLVTLLYHS  1247
WP_044674937  1178  NPI---EFLE---HKGYKN--I-LEKNIIK---LPKYSLFE---LENGRRRLLAS  AKELQKGNEMILPPHLVTLLYHS  1240
WP_044676715  1180  NPI---EFLE---HKGYKN--I-LEKNIIK---LPKYSLFE---LENGRRRLLAS  AKELQKGNEMILPPHLVTLLYHS  1242
WP_044680361  1180  NPI---EFLE---HKGYKN--I-LEKNIIK---LPKYSLFE---LENGRRRLLAS  AKELQKGNEMILPPHLVTLLYHS  1242
WP_044681799  1178  NPI---EFLE---HKGYKN--I-LEKNIIK---LPKYSLFE---LENGRRRLLAS  AKELQKGNEMILPPHLVTLLYHS  1240
WP_049533112  1186  DKR---AFLL---GKGYKD--I-K--KIIE---LPKYSLFE---LKDGSRRMLAS  RGEIHKGNELFVPQKFTTLLYHS  1253
WP_029090905  1118  SETslgAYIA---EQIKSE-VelIN---grILKYQLIS---NNgNRLYIAG      -SERHNARQLIVSDEAAKVIWLI  1181
WP_006506696  1150  EKI---NYIE-eKEGLSD-VrlIK--Dn-IPVNQMIEm---DGgEYLLTS      --EYVNARQLVLNEKQCALIADI  1211
AIT42264      1177  NPI---DFLE---AKGYKE-V-KKDLIIK---LPKYSLFE---LENGRKRMLAS  -GELQKGNELALPSKYVNFLYLA  1239
WP_034440723  1150  QTT---EYLG---KIGFNK---AsIIN---S--FKNYTLFE---LENGSRRMIVG  KGELQKGNQMYLPQNLLEFVYHL  1217
```

| | | | |
|---|---|---|---|
| AKQ21048 | 1177 | NPI---DFLE---AKGYKE--V-KKDLIIK--LPKYSLFE----LENGKRKMLAS--GELQKGNELALPSKYVNFLYLA | 1239 |
| WP_004636532 | 1151 | HPT---AYLE---EAGYNN--P-TV--LHE--LPKYQLFE----LEDGSRRMIAS--AKEFQKGNQMVLPELVELLYHA | 1211 |
| WP_002364836 | 1157 | NPI---LFLE---EKGFLR--P-RV--LMK--LPKYTLFE----PPEGRRLLAS--AKEAQKGNQMVLPEHLLTLLYHA | 1217 |
| WP_016631044 | 1108 | NPI---LFLE---EKGFLR--P-RV--LMK--LPKYTLYE----PPEGRRRLLAS--AKEAQKGNQMVLPEHLLTLLYHA | 1168 |
| EMS75795 | 893 | DPI---GFLS---NKGYSN--V-TKF--IK--LSKYTLYE----LENGRRRMVAS--KEAQKANSFILPEKLVTLLYHA | 953 |
| WP_002373311 | 1157 | NPI---LFLE---EKGFLR--P-RV--LMK--LPKYTLYE----FPEGRRRLLAS--AKEAQKGNQMVLPEHLLTLLYHA | 1217 |
| WP_002378009 | 1157 | NPI---LFLE---EKGFLR--P-RV--LMK--LPKYTLYQ----FPEGRRRLLAS--AKEAQKGNQMVLPEHLLTLLYHA | 1217 |
| WP_002407324 | 1157 | NPI---LFLE---EKGFLR--P-RV--LMK--LPKYTLYE----FPEGRRRLLAS--AKEAQKGNQMVLPEHLLTLLYHA | 1217 |
| WP_002413717 | 1159 | NPI---LFLE---EKGFLR--P-RV--LMK--LPKYTLYE----FPEGRRRLLAS--AKEAQKGNQMVLPEHLLTLLYHA | 1219 |
| WP_010775580 | 1157 | NPI---LFLE---EKGFLR--P-RV--LMK--LPKYTLYE----FPEGRRRLLAS--AKEAQKGNQMVLPEHLLTLLYHA | 1217 |
| WP_010818269 | 1157 | NPI---LFLE---EKGFLR--P-RV--LMK--LPKYTLYE----FPEGRRRLLAS--AKEAQKGNQMVLPEHLLTLLYHA | 1217 |
| WP_010824395 | 1157 | NPI---LFLE---EKGFLR--P-RV--LMK--LPKYTLYE----FPEGRRRLLAS--AKEAQKGNQMVLPEHLLTLLYHA | 1217 |
| WP_016622645 | 1157 | NPI---LFLE---EKGFLR--P-RV--LMK--LPKYTLYE----FPEGRRRLLAS--AKEAQKGNQMVLPEHLLTLLYHA | 1217 |
| WP_033624816 | 1157 | NPI---LFLE---EKGFLR--P-RV--LMK--LPKYTLYE----FPEGRRRLLAS--AKEAQKGNQMVLPERLLTLLYHA | 1217 |
| WP_033625576 | 1157 | NPI---LFLE---EKGFLR--P-RV--LMK--LPKYTLYE----FPEGRRRLLAS--AKEAQKGNQMVLPEHLLTLLYHA | 1217 |
| WP_033789179 | 1157 | NPI---LFLE---EKGFLR--P-RV--LMK--LPKYTLYE----FPEGRRRLLAS--AKEAQKGNQMVLPEHLLTLLYHA | 1217 |
| WP_002310644 | 1159 | SPV---LFLK---NKGYEQ--A-EIE--MK--LPKYALFE----LENGKRKMVAS--KEAQKANSFLLPEHLVTLLYHA | 1219 |
| WP_002312694 | 1160 | SPV---LFLK---NKGYEQ--A-EIE--MK--LPKYALFE----LENGKRKMVAS--KEAQKANSFLLPEHLVTLLYHA | 1220 |
| WP_002314015 | 1160 | SPV---LFLK---NKGYEQ--A-EIE--MK--LPKYALFE----LENGKRKMVAS--KEAQKANSFLLPEHLVTLLYHA | 1220 |
| WP_002320716 | 1160 | SPV---LFLK---NKGYEQ--A-EIE--MK--LPKYALFE----LENGKRKMVAS--KEAQKANSFLLPEHLVTLLYHA | 1220 |
| WP_002330729 | 1159 | SPV---LFLK---NKGYEQ--A-EIE--MK--LPKYALFE----LENGKRKMVAS--KEAQKANSFLLPEHLVTLLYHA | 1219 |
| WP_002335161 | 1160 | SPV---LFLK---NKGYEQ--A-EIE--MK--LPKYALFE----LENGKRKMVAS--KEAQKANSFLLPEHLVTLLYHA | 1220 |
| WP_002345439 | 1160 | SPV---LFLK---NKGYEQ--A-EIE--MK--LPKYALFE----LENGKRKMVAS--KEAQKANSFLLPEHLVTLLYHA | 1220 |
| WP_034867970 | 1150 | DPT---TFLK---EKGFPQ--V-TEF--IK--LPKYTLFE----FDNGRRRFLAS--KESQKGNPFILSDQLVTLLYHA | 1210 |
| WP_047937432 | 1160 | SPV---LFLK---NKGYEQ--A-EIE--MK--LPKYALFE----LENGKRKMVAS--KEAQKANSFLLPEHLVTLLYHA | 1220 |
| WP_010720994 | 1150 | DPT---TFLK---DKGFPQ--V-TEF--IK--LPKYTLFE----FDNGRRRFLAS--KESQKGNPFILSDQLVTLLYHA | 1210 |
| WP_010737004 | 1150 | DPT---TFLK---EKGFPQ--V-TEF--IK--LPKYTLFE----FDNGRRRFLAS--KESQKGNPFILSDQLVTLLYHA | 1210 |
| WP_034700478 | 1150 | DPT---TFLK---DKGFPH--V-TEF--IK--LPKYALFE----FDNGRRRFLAS--KESQKGNPFILSDQLVTLLYHA | 1210 |
| WP_007209003 | 1148 | NPIi---YLS---KKDYHN--pKVEAI---LPKYSLFE----FENGRRRMVAS--SETQKGNQLIIPGHLMELLYHS | 1208 |
| WP_023519017 | 1144 | DPR---EFLK---TKGYEG--V-KQW--LI--LPKYILFE----AQGGYRRMIAS--QETQKANSLILPENLVTLLYHA | 1204 |
| WP_010770040 | 1155 | DPV---SLLE---EKGYAN--P-EV--LIH--LPKYTLYE----LENGRRRLLAS--ANEAQKGNQVLPASLVTLLYHA | 1215 |
| WP_048604708 | 1152 | NER---EFLK---NKGYQN--P-QI--CMK--LPKYSLYE----FDDGRRRLLAS--AKEAQKGNQMVLPAHLVTFLYHA | 1212 |
| WP_010750235 | 1153 | DPI---SFLI---EKGYSN--V-NQF--IL--LPKYTLFE----LANGQRRMLAS--QELQKANSFILPEKLVTLLYHA | 1213 |
| AII16583 | 1216 | NPI---DFLE---AKGYKE--V-KKDLIIK--LPKYSLFE----LENGKRKMLAS--GELQKGNELALPSKYVNFLYLA | 1278 |
| WP_029073316 | 1165 | TKI---NYIK---eSEGLEE--VkIIK---E--ILKNQLIEi----NGGLFYVTS---EIVNARQLILDFNCTRIIDGI | 1225 |
| WP_031589969 | 1165 | IKI---NYLK---qAEDLEE--VqIGK---E--ILKNQLIEk----DGGLYYIVA----EIINAKQLILNESQTKLVCEI | 1225 |
| KDA45870 | 1139 | DPT---AYLA---SRGYTNvtNsFLL-----PKYSLLEd---PEGRRRLYAS--KEFQKANELILPQHLVELLYWV | 1199 |
| WP_039099354 | 1171 | QKI spQFTKv--KKQkGtiV-KVVEDFEv-IAPHILINqrfFDNGQELTLGS-------HNEQELILDKTAVKLLNGA | 1241 |
| AKP02966 | 1173 | KTL--qNWLE---ENVKHKksIqIIK--Nn-VPIGQIIY----SKKVGLLS---REIANRQQLILPEHSALLRIL | 1237 |
| WP_010991369 | 1155 | DEK---AFLE---EQGYRQ--P-KV--LAK--LPKYTLYE----CEEGRRRMLAS--ANEAQKGNQQVLPNHLVTLLHHA | 1215 |
| WP_033838504 | 1155 | DEK---AFLE---EQGYRQ--P-KV--LAK--LPKYTLYE----CEEGRRRMLAS--ANEAQKGNQQVLPNHLVTLLHHV | 1215 |
| EHN60060 | 1158 | DEK---AFLE---EQGYRQ--P-KV--LAK--LPKYTLYE----CEEGRRRMLAS--ANEAQKGNQVLPNHLVTLLHHV | 1218 |
| EFR89594 | 924 | DQK---AFLE---EKGYYS--P-KV--LTK--IPKYTLYE----CENGRRRMLGS--ANEAQKGNQMVLPNHLMTLLYHA | 984 |
| WP_038409211 | 1155 | DQK---AFLE---EKGYYS--P-KV--LTK--LPKYTLYE----CENGRRRMLGS--ANEAQKGNQMVLPNHLMTLLYHA | 1215 |
| EFR95520 | 774 | DEE---AFLE---EKGYRH--P-KV--LTK--IPKYTLYE----CEKGRRRMLGS--ANEAQKGNQLVLSNHLVSLLYHA | 834 |
| WP_003723650 | 1155 | DEE---AFLE---EKGYHQ--P-KV--LTK--LPKYTLYE----CEKGRRRMLSS--ANEAQKGNQLVLSNHLVSLLYHA | 1215 |
| WP_003727705 | 1155 | DEE---AFLE---EKGYHQ--P-KV--LTK--LPKYTLYE----CEKGRRRMLSS--ANEAQKGNQLVLSNHLVSLLYHA | 1215 |
| WP_003730785 | 1155 | DEK---AFLE---EKGYHQ--P-KV--LLK--LPKYTLYE----CKNGRRRMLGS--ANEAHKGNQMLLPNHLMALLYHA | 1215 |
| WP_003733029 | 1155 | DEK---TFLE---EKGYHQ--P-KV--LIK--VPKYTLYE----CKNGRRRMLGS--ANEAHKGNQMLLPNHLMALLYHA | 1215 |
| WP_003739838 | 1155 | DEK---SFLE---KQGYRQ--P-KV--LTK--LPKYTLYE----CENGRRRMLAS--ANEAQKGNQVLKGQLITLLHHA | 1215 |
| WP_014601172 | 1155 | DEK---AFLE---EKGYRH--P-KV--LTK--LPKYALYE----CEKGRRRMLGS--ANEAQKGNQVLSNHLVSLLYHA | 1215 |
| WP_023548323 | 1155 | DEE---VFLE---GKGYHQ--P-KV--LTK--LPKYTLYE----CENGRRRMLGS--ANEVHKGNQMLLPNHLMTLLYHA | 1215 |
| WP_031665337 | 1155 | DEE---AFLE---EKGYRH--P-KV--LTK--LPKYTLYE----CEKGRRRMLGS--ANEAQKGNQLVLSNHLVSLLYHA | 1215 |

| | | | |
|---|---|---|---|
| WP_031669209 | 1155 | DEK---TFLE----EKGYHQ--P-KV--LIK--VPKYTLYE---CENGRRRMLGS ANFAHKGNQMLLPNHLMALLYHA | 1215 |
| WP_033920898 | 1155 | DEK---VFLE----GKGYHQ--P-KV--LIK--LPKYALYE---CENGRRRMLGS ANEVHKGNQMLLPNHLMTLLYHA | 1215 |
| AKI42028 | 1158 | DEE---AFLE----EKGYRH--P-KV--LTK--LPKYTLYE---CEKGRRRMLAS ANEAQKGNQLVLSNHLVSLLYHA | 1218 |
| AKI_50529 | 603 | DEK---VFLE----EKGYRH--P-KV--LTK--LPKYTLYE---CENGRRRMLAS ANEAQKGNQMVLPNHLMTLLYHA | 663 |
| EFR83390 | 1155 | DQK---EFLE----GKGYRN--P-KV--ITK--IPKYTLYE---CENGRRRMLGS ANEAQKGNQMVLPNHLMTLLYHA | 1215 |
| AKE81011 | 1193 | NPI---DFLE----AKGYKE--V-KKDLIIK--LPKYSLFE---LENGRKRMLAS -GELQKGNELALPSKYVNFLYLA | 1255 |
| CUO82355 | 1154 | EYVE--kEEKLSD--VkIIK---Nn-IPlNQLIEi---DGRQYLLTS --ECVNAMQLVLNEQCKLIADI | 1215 |
| WP_033162887 | 1155 | EQL---SYIAspeHEDLID---VrIVK---E--lLkNQLIEi------DGGLYYVTS -EVTARQLSLNEQSCKLISEI | 1217 |
| AGZ01981 | 1210 | NPI---DFLE----AKGYKE--V-KKDLIIK--LPKYSLFE------LENGRKRMLAS -GELQKGNELALPSKYVNFLYLA | 1272 |
| AKA60242 | 1177 | NPI---DFLE----AKGYKE--V-KKDLIIK--LPKYSLFE------LENGRKRMLAS -GELQKGNELALPSKYVNFLYLA | 1239 |
| AKS40380 | 1181 | NPI---DFLE----AKGYKE--V-KKDLIIK--LPKYSLFE------LENGRKRMLAS -GELQKGNELALPSKYVNFLYLA | 1239 |
| 4UN5_B | 1181 | NPI---DFLE----AKGYKE--V-KKDLIIK--LPKYSLFE------LENGRKRMLAS -GELQKGNELALPSKYVNFLYLA | 1243 |
| WP_010922251 | 1240 | SHYEKLKgSPEDnEQKQL-FVEQHKHYLDEIIEQISEFSKRVILAD-ANLDKVL-S AYN-KH---RDKPIREq | 1305 |
| WP_039695303 | 1249 | HRAD---NFNS-TEYLN--YVSEHKKEFEKVLSCVEDFANLYVDVE-KNLSKIR-A VAD-SM---DNFSIEE- | 1308 |
| WP_045635197 | 1247 | KNVH----KLDE-PGHLE-YIQKHRNEFEDLILVSEFSQKVILAD--ANLEKIK-K LYA-DN---EQADIEI- | 1306 |
| 5AXW_A | 979 | GELYRVIgVNNDlLNRIE---VNMIDITYREYLENMNDKRPPRIIKT1aSKTQSIK-K LYEyKSk--KHPQIIKkg | 1056 |
| WP_009880683 | 924 | SHYEKLKgSPEDnEQKQL-FVEQHKHYLDEIIEQISEFSKRVILAD-ANLDKVL-S AYN-KH---RDKPIREq | 989 |
| WP_010922251 | 1240 | SHYEKLKgSPEDnEQKQL-FVEQHKHYLDEIIEQISEFSKRVILAD-ANLDKVL-S AYN-KH---RDKPIREq | 1305 |
| WP_011054416 | 1240 | SHYEKLKgSPEDnEQKQL-FVEQHKHYLDEIIEQISEFSKRVILAD-ANLDKVL-S AYN-KH---RDKPIREq | 1305 |
| WP_011284745 | 1240 | SHYEKLKgSPEDnEQKQL-FVEQHKHYLDEIIEQISEFSKRVILAD-ANLDKVL-S AYN-KH---RDKPIREq | 1305 |
| WP_011285506 | 1240 | SHYEKLKgSPEDnEQKQL-FVEQHKHYLDEIIEQISEFSKRVILAD-ANLDKVL-S AYN-KH---RDKPIREq | 1305 |
| WP_011527619 | 1240 | SHYEKLKgSPEDnEQKQL-FVEQHKHYLDEIIEQISEFSKRVILAD-ANLDKVL-S AYN-KH---RDKPIREq | 1305 |
| WP_012560673 | 1240 | SHYEKLKgSPEDnEQKQL-FVEQHKHYLDEIIEQISEFSKRVILAD-ANLDKVL-S AYN-KH---RDKPIREq | 1305 |
| WP_014407541 | 1239 | SHYEKLKgSPEDnEQKQL-FVEQHKHYLDEIIEQISEFSKRVILAD-ANLDKVL-S AYN-KH---RDKPIREq | 1304 |
| WP_020905136 | 1240 | SHYEKLKgSPEDnEQKQL-FVEQHKHYLDEIIEQISEFSKRVILAD-ANLDKVL-S AYN-KH---RDKPIREq | 1305 |
| WP_023080005 | 1239 | SHYEKLKgSPEDnEQKQL-FVEQHKHYLDEIIEQISEFSKRVILAD-ANLDKVL-S AYN-KH---RDKPIREq | 1304 |
| WP_023610282 | 1240 | SHYEKLKgSPEDnEQKQL-FVEQHKHYLDEIIEQISEFSKRVILAD-ANLDKVL-S AYN-KH---RDKPIREq | 1305 |
| WP_030125963 | 1240 | SHYEKLKgSPEDnEQKQL-FVEQHKHYLDEIIEQISEFSKRVILAD-ANLDKVL-S AYN-KH---RDKPIREq | 1305 |
| WP_030126706 | 1240 | SHYEKLKgSPEDnEQKQL-FVEQHKHYLDEIIEQISEFSKRVILAD-ANLDKVL-S AYN-KH---RDKPIREq | 1305 |
| WP_031488318 | 1240 | SHYEKLKgSPEDnEQKQL-FVEQHKHYLDEIIEQISEFSKRVILAD-ANLDKVL-S AYN-KH---RDKPIREq | 1305 |
| WP_032460140 | 1240 | SHYEKLKgSPEDnEQKQL-FVEQHKHYLDEIIEQISEFSKRVILAD-ANLDKVL-S AYN-KH---RDKPIREq | 1305 |
| WP_032461047 | 1239 | SHYEKLKgSPEDnEQKQL-FVEQHKHYLDEIIEQISEFSKRVILAD-ANLDKVL-S AYN-KH---RDKPIREq | 1304 |
| WP_032462016 | 1240 | SHYEKLKgSPEDnEQKQL-FVEQHKHYLDEIIEQISEFSKRVILAD-ANLDKVL-S AYN-KH---RDKPIREq | 1305 |
| WP_032462936 | 1240 | SHYEKLKgSPEDnEQKQL-FVEQHKHYLDEIIEQISEFSKRVILAD-ANLDKVL-S AYN-KH---RDKPIREq | 1305 |
| WP_032464890 | 1240 | SHYEKLKgSPEDnEQKQL-FVEQHKHYLDEIIEQISEFSKRVILAD-ANLDKVL-S AYN-KH---RDKPIREq | 1305 |
| WP_033888930 | 1065 | SHYEKLKgSPEDnEQKQL-FVEQHKHYLDEIIEQISEFSKRVILAD-ANLDKVL-S AYN-KH---RDKPIREq | 1130 |
| WP_038431314 | 1240 | SHYEKLKgSPEDnEQKQL-FVEQHKHYLDEIIEQISEFSKRVILAD-ANLDKVL-S AYN-KH---RDKPIREq | 1305 |
| WP_038432938 | 1239 | SHYEKLKgSPEDnEQKQL-FVEQHKHYLDEIIEQISEFSKRVILAD-ANLDKVL-S AYN-KH---RDKPIREq | 1304 |
| WP_038434062 | 1151 | SHYEKLKgSPEDnEQKQL-FVEQHKHYLDEIIEQISEFSKRVILAD-ANLDKVL-S AYN-KH---RDKPIREq | 1216 |
| BAQ51233 | 415 | SHYEKLKgSPEDnEQKQL-FVEQHKHYLDEIIEQISEFSKRVILAD-ANLDKVL-S AYN-KH---RDKPIREq | 480 |
| KGE60162 | 178 | SHYEKLKgSPEDnEQKQL-FVEQHKHYLDEIIEQISEFSKRVILAD-ANLDKVL-S AYN-KH---RDKPIREq | 243 |
| KGE60856 | 1240 | SHYEKLKgSPEDnEQKQL-FVEQHKHYLDEIIEQISEFSKRVILAD-ANLDKVL-S AYN-KH---RDKPIREq | 1305 |
| WP_002989955 | 1222 | YQIE---KNYE-PEHRE-YVEKHDEFKELLEYISVSRKVVLAD--NNLTKIE-M LFS-KN---KDAEVSS- | 1281 |
| WP_003030002 | 1250 | QRIN---SFNS-TKYLD-YVSAHKKEFVNQHVSYFDDIFQLINDFSKRVILAD--ANLEKIN-R LYQ-DNk--ENIVDE- | 1309 |
| WP_003065552 | 1241 | SRYNESKgKPEEiEKKQE-FVNQHVSYFDDILQLINDFSKRVILAD--ANLEKIN-K LYQ-DNk--ENISVDE- | 1306 |
| WP_001040076 | 1249 | SRYNESKgKPEEiEKKQE-FVNQHVSYFDDILQLINDFSKRVILAD--ANLEKIN-K LYQ-DNk--ENISVDE- | 1314 |
| WP_001040078 | 1241 | SRYNESKgKPEEiEKKQE-FVNQHVSYFDDILQLINDFSKRVILAD--ANLEKIN-K LYQ-DNk--ENISVDE- | 1306 |
| WP_001040080 | 1241 | SRYNESKgKPEEiEKKQE-FVNQHVSYFDDILQLINDFSKRVILAD--ANLEKIN-K LYQ-DNk--ENISVDE- | 1306 |
| WP_001040081 | 1241 | SRYNESKgKPEEiEKKQE-FVNQHVSYFDDILQLINDFSKRVILAD--ANLEKIN-K LYQ-DNk--ENISVDE- | 1306 |
| WP_001040083 | 1241 | SRYNESKgKPEEiEKKQE-FVNQHVSYFDDILQLINDFSKRVILAD--ANLEKIN-K LYQ-DNk--ENISVDE- | 1306 |
| WP_001040085 | 1241 | SRYNESKgKPEEiEKKQE-FVNQHVSYFDDILQLINDFSKRVILAD--ANLEKIN-K LYQ-DNk--ENISVDE- | 1306 |
| WP_001040087 | 1241 | SRYNESKgKPEEiEKKQE-FVNQHVSYFDDILQLINDFSKRVILAD--ANLEKIN-K LYQ-DNk--ENISVDE- | 1306 |

-continued

| | | | |
|---|---|---|---|
| WP_001040088 | 1241 | SRYNESKgKPEEiEKKQE--FVNQHVSYFDDILQLINDFSKRVILAD--ANLEKIN-K LYQ-DNk--ENISVDE-- | 1306 |
| WP_001040089 | 1241 | SRYNESKgKPEEiEKKQE--FVNQHVSYFDDILQLINDFSKRVILAD--ANLEKIN-K LYQ-DNk--ENISVDE-- | 1306 |
| WP_001040090 | 1241 | SRYNESKgKPEEiEKKQE--FVNQHVSYFDDILQLINDFSKRVILAD--ANLEKIN-K LYQ-DNk--ENISVDE-- | 1306 |
| WP_001040091 | 1241 | SRYNESKgKPEEiEKKQE--FVNQHVSYFDDILQLINDFSKRVILAD--ANLEKIN-K LYS-DNk--ENISVDE-- | 1306 |
| WP_001040092 | 1241 | SRYNESKgKPEEiEKKQE--FVNQHISYFDDILQLINDFSKRVILAD--ANLEKIN-K LYQ-DNk--DNTPVDE-- | 1306 |
| WP_001040094 | 1241 | SRYNELKgKPEEiEQKQE--FVVQHVSYFDDILQLINDFSNRVILAD--ANLEKIN-K LYQ-DNk--ENIPVDE-- | 1306 |
| WP_001040095 | 1241 | SRYNELKgKPEEiEQKQE--FVVQHVSYFDDILQLINDFSNRVILAD--ANLEKIN-K LYQ-DNk--ENIPVDE-- | 1306 |
| WP_001040096 | 1241 | SRYNELKgKPEEiEQKQE--FVVQHVSYFDDILQLINDFSNRVILAD--ANLEKIN-K LYQ-DNk--ENISVDE-- | 1306 |
| WP_001040097 | 1241 | SRYNELKgKPEEiEQKQE--FVVQHVSYFDDILQLINDFSNRVILAD--ANLEKIN-K LYQ-DNk--ENIPVDE-- | 1306 |
| WP_001040098 | 1241 | SRYNELKgKPEEiEQKQE--FVVQHVSYFDDILQLINDFSNRVILAD--ANLEKIN-K LYQ-DNk--ENIPVDE-- | 1306 |
| WP_001040099 | 1241 | SRYNELKgKPEEiEKKQE--FVVQHVSYFDDILQLINDFSNRVILAD--ANLEKIN-K LYQ-DNk--ENIPVDE-- | 1306 |
| WP_001040100 | 1241 | SRYNELKgKPEEiEKKQE--FVVQHVSYFDDILQLINDFSNRVILAD--ANLEKIN-K LYQ-DNk--ENIPVDE-- | 1306 |
| WP_001040104 | 1241 | SRYNELKgKPEEiEKKQE--FVNQHVSYFDDILQLINDFSKRVILAD--ANLEKIN-K LYQ-DNk--ENISVDE-- | 1306 |
| WP_001040105 | 1241 | SRYNELKgKPEEiEQKQE--FVVQHVSYFDDILQLINDFSNRVILAD--ANLEKIN-K LYQ-DNk--ENISVDE-- | 1306 |
| WP_001040106 | 1241 | SRYNELKgKPEEiEQKQE--FVVQHVSYFDDILQLINDFSNRVILAD--ANLEKIN-K LYQ-DNk--ENISVDE-- | 1306 |
| WP_001040107 | 1241 | SRYNELKgKPEEiEQKQE--FVVQHVSYFDDILQLINDFSNRVILAD--ANLEKIN-K LYQ-DNk--ENISVDE-- | 1306 |
| WP_001040108 | 1241 | SRYNELKgKPEEiEQKQE--FVVQHVSYFDDILQLINDFSNRVILAD--ANLEKIN-K LYQ-DNk--ENISVDE-- | 1306 |
| WP_001040109 | 1241 | SRYNELKgKPEEiEQKQE--FVVQHVSYFDDILQLINDFSNRVILAD--ANLEKIN-K LYQ-DNk--ENISVDE-- | 1306 |
| WP_001040110 | 1241 | SRYNELKgKPEEiEKKQE--FVVQHVSYFDDILQLINDFSNRVILAD--ANLEKIN-K LYS-DNk--DNTPVDE-- | 1306 |
| WP_015058523 | 1241 | SRYNELKgKPEEiEKKQE--FVNQHVSYFDDILQLINDFSKRVILAD--ANLEKIN-K LYQ-DNk--ENISVDE-- | 1306 |
| WP_017643650 | 1241 | SRYNESKgKPEEiEKKQE--FVNQHVSYFDDILQLINDFSKRVILAD--ANLEKIN-K LYQ-DNk--ENISVDE-- | 1306 |
| WP_017647151 | 1241 | SRYNESKgKPEEiEKKQE--FVNQHVSYFDDILQLINDFSKRVILAD--ANLEKIN-K LYQ-DNk--ENISVDE-- | 1306 |
| WP_017648376 | 1241 | SRYNESKgKPEEiEKKQE--FVNQHVSYFDDILQLINDFSKRVILAD--ANLEKIN-K LYQ-DNk--ENISVDE-- | 1306 |
| WP_017649527 | 1241 | SRYNESKgKPEEiEKKQE--FVVQHVSYFDDILQLINDFSNRVILAD--ANLEKIN-K LYQ-DNk--ENISVDE-- | 1306 |
| WP_017771611 | 1241 | SRYNESKgKPEEiEKKQE--FVVQHVSYFDDILQLINDFSKRVILAD--ANLEKIN-K LYQ-DNk--ENISVDE-- | 1306 |
| WP_017771984 | 1241 | SRYNESKgKPEEiEKKQE--FVNQHVSYFDDILQLINDFSKRVILAD--ANLEKIN-K LYQ-DNk--ENIPVDE-- | 1306 |
| CFQ25032 | 1241 | SRYNESKgKPEEiEKKQE--FVNQHVSYFDDILQLINDFSKRVILAD--ANLEKIN-K LYQ-DNk--ENISVDE-- | 1306 |
| CFV16040 | 1241 | SRYNESKgKPEEiEKKQE--FVVQHVSYFDDILQLINDFSNRVILAD--ANLEKIN-K LYQ-DNk--ENISVDE-- | 1306 |
| KLJ37842 | 1241 | SRYNESKgKPEEiEKKQE--FVNQHVSYFDDILQLINDFSKRVILAD--ANLEKIN-K LYQ-DNk--ENISVDE-- | 1306 |
| KLJ72361 | 1241 | SRYNESKgKPEEiEKKQE--FVNQHVSYFDDILQLINDFSKRVILAD--ANLEKIN-K LYS-DNk--DNTPVDE-- | 1306 |
| KLL20707 | 1255 | SRYNESKgKPEEiEKKQE--FVNQHVSYFDDILQLINDFSKRVILAD--ANLEKIN-K LYQ-DNk--ENISVDE-- | 1320 |
| KLL42645 | 1241 | SRYNESKgKPEEiEKKQE--FVNQHVSYFDDILQLINDFSKRVILAD--ANLEKIN-K LYQ-DNk--ENISVDE-- | 1306 |
| WP_047207273 | 1241 | SRYNESKgKPEEiEKKQE--FVNQHVSYFDDILQLINDFSKRVILAD--ANLEKIN-K LYQ-DNk--ENIPVDE-- | 1306 |
| WP_047209694 | 1241 | SRYNESKgKPEEiEKKQE--FVNQHVSYFDDILQLINDFSKRVILAD--ANLEKIN-K LYQ-DNk--ENISVDE-- | 1306 |
| WP_050198062 | 1241 | SRYNESKgKPEEiEKKQE--FVVQHVSYFDDILQLINDFSNRVILAD--ANLEKIN-K LYQ-DNk--ENISVDE-- | 1306 |
| WP_050201642 | 1241 | SRYNESKgKPEEiEKKQE--FVNQHVSYFDDILQLINDFSKRVILAD--ANLEKIN-K LYQ-DNk--ENISVDE-- | 1306 |
| WP_050204027 | 1241 | SRYNESKgKPEEiEKKQE--FVNQHVSYFDDILQLINDFSKRVILAD--ANLEKIN-K LYQ-DNk--ENISVDE-- | 1306 |
| WP_050881965 | 1241 | SRYNESKgKPEEiEKKQE--FVNQHVSYFDDILQLINDFSKRVILAD--ANLEKIN-K LYQ-DNk--ENISVDE-- | 1306 |
| WP_050886065 | 1241 | SRYNESKgKPEEiEKKQE--FVNQHVSYFDDILQLINDFSKRVILAD--ANLEKIN-K LYS-DNk--DNTPVDE-- | 1306 |
| AHN30376 | 1241 | SRYNESKgKPEEiEKKQE--FVNQHVSYFDDILQLINDFSKRVILAD--ANLEKIN-K LYQ-DNk--ENISVDE-- | 1306 |
| EAO78426 | 1241 | SRYNESKgKPEEiEKKQE--FVNQHVSYFDDILQLINDFSKRVILAD--ANLEKIN-K LYQ-DNk--ENISVDE-- | 1306 |
| CCW42055 | 1241 | SRYNESKgKPEEiEKKQE--FVNQHVSYFDDILQLINDFSKRVILAD--ANLEKIN-K LYQ-DNk--ENISVDE-- | 1306 |
| WP_003041502 | 1254 | KRIN----NPIN-KDHIE--YVKKHRDDFKELLNYVLEFNEKVGAT--KNGERLK-E AVA-DF--DSKSNEE-- | 1313 |
| WP_037593752 | 1223 | YQIE----KNYE-PEHRE--YVEKHKDEFKELLEYISVFSRKYVLAD--NNLTKIE-M LFS-KN--KDAEVSS-- | 1282 |
| WP_049516684 | 1223 | YRIE----KDYE-PEHRE--YVEKHKDEFKELLEYISVFSRKYVLAD--NNLTKIE-M LFS-KN--KDAEVSS-- | 1282 |
| GAD46167 | 1222 | YQIE----KNYE-PEHRE--YVEKHKDEFKELLEYISVFSRKYVLAD--NNLTKIE-M LFS-KN--KDAEVSS-- | 1281 |
| WP_018363470 | 1254 | HRIG----NFNS-AEHLK--YVSEHKKEFEEVLSCVENFANVVDVE--KNLSKIR-A AAD-SM--DNFSIEE-- | 1313 |
| WP_003043819 | 1249 | QNISATIgSNNLg-------YIEQHREEFKEIFEKIIDFSEKYILKN--KVNSNLK-S SFD-EQfavSDsIL--l | 1310 |
| WP_006269658 | 1222 | YRIE----KDYE-PEHRE--YVEKHKDEFKELLEYISVFSRKYVLAD--NNLTKIE-M LFS-KN--KDAEVSS-- | 1281 |
| WP_048800889 | 1242 | HRID----NSDN-SEHLK--YITEHKEEFGKLLSYIENFAKSYVDVD--KNLEKIQ-L AVE-KI--DSFSVKE-- | 1301 |
| WP_012767106 | 1246 | -HAHKIEsSKE--LEHEA--YILDHYNDLYQLLSYIERFASLYVDVE--KNISKVK-E LFS-NI--ESYSISEi | 1308 |
| WP_014612333 | 1246 | -HAHKIEsSKE--LEHEA--YILDHYNDLYQLLSYIERFASLYVDVE--KNISKVK-E LFS-NI--KDAEVSS-- | 1281 |
| WP_015017095 | 1246 | -HAHKIEsSKE--LEHEA--YILDHYNDLYQLLSYIERFASLYVDVE--KNISKVK-E LFS-NI--ESYSISEi | 1308 |

-continued

| | | | | |
|---|---|---|---|---|
| WP_015057649 | 1246 | -HAHKIEsSKE--LEHEA--YILDHYNDLYQLLSYIERFASLYVDVE--KNISKVK-E | LFS-NI---ESYSISEi | 1308 |
| WP_048327215 | 1246 | -HAHKIEsSKE--LEHEA--YILDHYNDLYQLLSYIERFASLYVDVE--KNISKVK-E | LFS-NI---ESYSISEi | 1308 |
| WP_049519324 | 1246 | -HAHKIEsSKE--LEHEA--YILDHYNDLYQLLSYIERFASLYVDVE--KNISKVK-E | LFS-NI---ESYSISEi | 1308 |
| WP_012515931 | 1220 | AHYHELIgsSEDvLRKKY--FVDRLHYFDDIIQMINDFAERHILAS--SNLEKIN-H | TYH-NN---SDLPINEr | 1285 |
| WP_021320964 | 1220 | AHYHELIgsSEDvLRKKY--FVERLHYFDDIIQMINDFAERHILAS--SNLEKIN-H | TYH-NN---SDLPINEr | 1285 |
| WP_037581760 | 1252 | QHVN----NSHK-PEHLN--YVKQHKDEFKDIFNLIISIARINILKP--KVVDNL-- | IN-EF---TEYGQED | 1308 |
| WP_004232481 | 1247 | HRAD----NFNS-TEYLN--YVSEHKKEFKVLSCVEDFANLYVDVE--KNLSKIR-A | VAD-SM---DNFSIEE | 1306 |
| WP_009854540 | 1248 | HRVN----SFNN-SEHLK--YVSEHKKEFGEVLSCVENFAKSYVDVE--KNLGKIR-A | VAD-KI---DTFSIED | 1307 |
| WP_012962174 | 1249 | HRAD----NFNS-TEYLN--YVSEHKKEFEKVLSCVEDFANLYVDVE--KNLSKIR-A | VAD-SM---DNFSIEE | 1308 |
| WP_039695303 | 1252 | HRID----SFNS-TEHLK--YVSEHKKEFEKVLSCVENFSNLYVDVE--KNLSKVR-A | AAE-SM---TNFSLEE | 1311 |
| WP_014334983 | 1240 | SHYTKFIgkEEDrEKKRS--YVESHLYYFDEIMQIIVEYSNRYILAD--SNLIKIQ-N | LYK-EKd---NFSIEq | 1305 |
| WP_003099269 | 1240 | SHYTKFIgkEEDrEKKRS--YVESHLYYFXEVKSSF---------------------- | | 1273 |
| AHY15608 | 72 | SHYTKFIgkEEDrEKKRS--YVESHLYYFX----------------------------- | | 1267 |
| ESR09100 | 1240 | SHYTKFIgkEEDrEKKRS--YVESHLYYFDEIMQIIVEYSNRYILAD--SNLIKIQ-N | LYK--Ek--DNFSIEq | 137 |
| AGM98575 | 1222 | KNIH----KVDE-PKHLD--YVKKHKDEFKELLDVVSNFSKKNILAE--SNLEKIE-E | LYA-QN---NNKDITE | 1281 |
| ALF27331 | 1229 | KKVDVLVkSKDD---DYD--LEEHRAEFAELLDCIKKFNDMYILAS--SNMSKIE-E | IYQ-KNi---DAPIEE | 1289 |
| WP_018372492 | 1252 | QRIN----KLSE-PIHKQ--YVETHQSEFKELLTAIISLSKKYI-QK--PNVESL- | LQQ-AP---DQSDKDIyq | 1310 |
| WP_045635197 | 1247 | KNVH----KLDE-PIGHLE--YIQKHRNEFKDLLVSEFSQKVVLAD--ANLEKIK-S | LYA-DN---EQADIEI | 1306 |
| WP_002263549 | 1222 | KNIH----KVDE-PKHLD--YVDKHKDEFKELLDVVSNFSKKYTLAE--GNLEKIK-E | LYA-QN---NGEDLKE | 1281 |
| WP_002263887 | 1222 | KNIH----KVDE-PKHLD--YVDKHKDEFKELLDVVSNFSKKYTLAE--GNLEKIK-E | LYA-QN---NGEDLKE | 1281 |
| WP_002264920 | 1222 | KNIH----KVDE-PKHLD--YVDKHKDEFKELLDVVSNFSKKYTLAE--GNLEKIK-E | LYA-QN---NGEDLKE | 1281 |
| WP_002269043 | 1222 | KNIH----KVDE-PKHLD--YVDKHKDEFKELLDVVSNFSKKYTLAE--GNLEKIK-E | LYA-QN---NGEDLKE | 1281 |
| WP_002269448 | 1222 | KNIH----KVDE-PKHLD--YVDKHKDEFKELLDVVSNFSKKYTLAE--GNLEKIK-E | LYA-QN---NGEDLKE | 1281 |
| WP_002271977 | 1222 | KNIH----KVDE-PKHLD--YVDKHKDEFKELLDVVSNFSKKYTLAE--GNLEKIK-E | LYA-QN---NGEDLKE | 1281 |
| WP_002272766 | 1222 | KNIH----KVDE-PKHLD--YVDKHKDEFKELLDVVSNFSKKYTLAE--GNLEKIK-E | LYA-QN---NGEDLKE | 1281 |
| WP_002273241 | 1222 | KNIH----KVDE-PKHLD--YVDKHKDEFKELLDVVSNFSKKYTLAE--GNLEKIK-E | LYA-QN---NGEDLKE | 1281 |
| WP_002275430 | 1222 | KNIH----KVDE-PKHLD--YVDKHKDEFKELLDVVSNFSKKYTLAE--GNLEKIK-E | LYA-QN---NGEDLKE | 1281 |
| WP_002276448 | 1222 | KNIH----KVDE-PKHLD--YVDKHKDEFKELLDVVSNFSKKYTLAE--GNLEKIK-E | LYA-QN---NGEDLKE | 1281 |
| WP_002277050 | 1230 | HHL-----DN-DYSNE----YVKNHYQQFDILFNEITSFSKKKCKLGK--EHIQKIE-E | DSA-SIEE--------- | 1287 |
| WP_002277364 | 1222 | KNIH----KVDE-PKHLD--YVDKHKDEFKELLDVVSNFSKKYTLAE--GNLEKIK-E | LYA-QN---NGEDLKE | 1281 |
| WP_002279025 | 1222 | KNIH----KVDE-PKHLD--YVDKHKDEFKELLDVVSNFSKKYTLAE--GNLEKIK-E | LYA-QN---NGEDLKE | 1281 |
| WP_002279859 | 1222 | KNIH----KVDE-PKHLD--YVDKHKDEFKELLDVVSNFSKKYTLAE--GNLEKIK-E | LYA-QN---NGEDLKE | 1281 |
| WP_002280230 | 1222 | KNIH----KVDE-PKHLD--YVDKHKDEFKELLDVVSNFSKKYTLAE--GNLEKIK-E | LYA-QN---NGEDLKE | 1281 |
| WP_002281696 | 1222 | KNIH----KVDE-PKHLD--YVDKHKDEFKELLDVVSNFSKKYTLAE--GNLEKIK-E | LYA-QN---NGEDLKE | 1281 |
| WP_002282247 | 1230 | HHL-----DN-DYSNE----YVKNHYQQFDILFNEITSFSKKKCKLGK--EHIQKIE-E | AYSkER---DFASIEE | 1287 |
| WP_002282906 | 1222 | KNIH----KVDE-PKHLD--YVDKHKDEFKELLDVVSNFSKKYTLAE--GNLEKIK-E | LYA-QN---NGEDLKE | 1281 |
| WP_002283846 | 1222 | KNIH----KVDE-PKHLD--YVDKHKDEFKELLDVVSNFSKKYTLAE--GNLEKIK-E | LYA-QN---NGEDLKE | 1281 |
| WP_002287255 | 1222 | KNIH----KVDE-PKHLD--YVDKHKDEFKELLDVVSNFSKKYTLAE--GNLEKIK-E | LYA-QN---NGEDLKE | 1281 |
| WP_002288990 | 1222 | KNIH----KVDE-PKHLD--YVDKHKDEFKELLDVVSNFSKKYTLAE--GNLEKIK-E | LYA-QN---NGEDLKE | 1281 |
| WP_002289641 | 1222 | KNIH----KVDE-PKHLD--YVDKHKDEFKELLDVVSNFSKKYTLAE--GNLEKIK-E | LYA-QN---NGEDLKE | 1281 |
| WP_002290427 | 1222 | KNIH----KVDE-PKHLD--YVDKHKDEFKELLDVVSNFSKKYTLAE--GNLEKIK-E | LYA-QN---NGEDLKE | 1281 |
| WP_002295753 | 1222 | KNIH----KVDE-PKHLD--YVDKHKDEFKELLDVVSNFSKKYTLAE--GNLEKIK-E | LYA-QN---NGEDLKE | 1281 |
| WP_002296423 | 1222 | KNIH----KVDE-PKHLD--YVDKHKDEFKELLDVVSNFSKKYTLAE--GNLEKIK-E | LYA-QN---NGEDLKE | 1281 |
| WP_002304487 | 1236 | KNIH----KVDE-PKHLD--YVDKHKDEFKELLDVVSNFSKKYTLAE--GNLEKIK-E | LYA-QN---NGEDLKE | 1295 |
| WP_002305844 | 1222 | KNIH----KVDE-PKHLD--YVDKHKDEFKELLDVVSNFSKKYTLAE--GNLEKIK-E | LYA-QN---NGEDLKE | 1281 |
| WP_002307203 | 1222 | KNIH----KVDE-PKHLD--YVDKHKDEFKELLDVVSNFSKKYTLAE--GNLEKIK-E | LYA-QN---NGEDLKE | 1281 |
| WP_002310390 | 1222 | KNIH----KVDE-PKHLD--YVDKHKDEFKELLDVVSNFSKKYTLAE--GNLEKIK-E | LYA-QN---NGEDLKE | 1281 |
| WP_002352408 | 1222 | KNIH----KVDE-PKHLD--YVDKHKDEFKELLDVVSNFSKKYTLAE--GNLEKIK-E | LYA-QN---NGEDLKE | 1281 |
| WP_012997688 | 1222 | KNIH----KVDE-PKHLD--YVDKHKDEFKELLDVVSNFSKKYTLAE--GNLEKIK-E | LYA-QN---NGEDLKE | 1281 |
| WP_014677909 | 1222 | KNIH----KVDE-PKHLD--YVDKHKDEFKELLDVVSNFSKKYTLAE--GNLEKIK-E | LYA-QN---NGEDLKE | 1281 |
| WP_019312892 | 1222 | KNIH----KVDE-PKHLD--YVDKHKDEFKELLDVVSNFSKKYTLAE--GNLEKIK-E | LYA-QN---NGEDLKE | 1281 |

```
                                                                    -continued WP_019313659  1222  KNIH----KVDE-PKHLD--YVDKHKDEFKELLDVVSNFSKKYTLAE--GNLEKIK-E  LYA-QN---NGEDLKE--  1281
WP_019314093  1222  KNIH----KVDE-PKHLD--YVDKHKDEFKELLDVVSNFSKKYTLAE--GNLEKIK-E  LYA-QN---NGEDLKE--  1281
WP_019315370  1222  KNIH----KVDE-PKHLD--YVDKHKDEFKELLDVVSNFSKKYTLAE--GNLEKIK-E  LYA-QN---NGEDLKE--  1281
WP_019803776  1222  KNIH----KVDE-PKHLD--YVDKHKDEFKELLDVVSNFSKKYTLAE--GNLEKIK-E  LYA-QN---NGEDLKE--  1281
WP_019805234  1222  KNIH----KVDE-PKHLD--YVDKHKDEFKELLDVVSNFSKKYTLAE--GNLEKIK-E  LYA-QN---NGEDLKE--  1281
WP_024783594  1222  KNIH----KVDE-PKHLD--YVDKHKDEFKELLDVVSNFSKKYTLAE--GNLEKIK-E  LYA-QN---NGEDLKE--  1281
WP_024784288  1230  HHL-----DN-DYSNE----YVKNHYQQFDILFNEITSFSKKKCKLGK--EHIQKIE-E  AYSkER---DFASIEE--  1287
WP_024784666  1222  KNIH----KVDE-PKHLD--YVDKHKDEFKELLDVVSNFSKKYTLAE--GNLEKIK-E  AYSkER---DFASIEE--  1281
WP_024784894  1222  KNIH----KVDE-PKHLD--YVDKHKDEFKELLDVVSNFSKKYTLAE--GNLEKIK-E  LYA-QN---NGEDLKE--  1281
WP_024786433  1230  HHL-----DN-DYSNE----YVKNHYQQFDILFNEITSFSKKCKLGK--EHIQKIE-E  AYSkER---DSASIEE--  1287
WP_024786442  1222  KNIH----KVDE-PKHLD--YVDKHKDEFKELLDVVSNFSKKYTLAE--GNLEKIK-E  LYA-QN---NGEDLKE--  1281
WP_049473442  1222  KNIH----KVDE-PKHLD--YVDKHKDEFKELLDVVSNFSKKYTLAE--GNLEKIK-E  LYA-QN---NGEDLKE--  1281
WP_049474547  1215  KNIH----KVDE-PKHLD--YVDKHKDEFKELLDVVSNFSKKYTLAE--GNLEKIK-E  LYA-QN---NGEDLKE--  1274
EMC03581      1250  KNIH----RLDE-PEHLE--YIQKHRNEFKGLLNLVSEFSQKYVLAD--ANLEKIK-N  LYA-DN---EQADIEI--  1309
WP_000428612  1248  KNVH----KLDE-PEHLE--YIQKHRNEFKDLLNLVSEFSQKYVLAD--ANLEKIQ-N  LYA-DN---EQADIEI--  1307
WP_000428613  1243  KRIQ----KKDE-PEHLE--YIKQHHSEFNDLLNVSEFSQKYVLAE--SNLEKIK-N  LYI-DN---EQTNMEE--  1302
WP_049523028  1209  SRYTSFSgKEEDrEKRRH--FVESHLHYFDEIKDIIADFSRRYILAD--ANLEKIL-T  LYN-EKn---QFSIEEg--  1274
WP_003107102  1242  SKRDK---gTQSEnME------YISNHKEKFIEIFHYIIRYAEKNVIKP--KVIERLN-D  TFNqKF---NDSDLTE1--  1303
WP_054279288  1252  QRIN----KISE-PIHKQ--YVETHQSEFFELLTTIISLSKKYI-QK--PIVESL---  LQQ-AP---EQADKDIyg  1310
WP_049531101  1252  QRIN----KISE-PIHKQ--YVEAHQNEFKELLTTIISLSKKYI-QK--PNVESL---  LQQ-AP---EQADKDIyg  1310
WP_049538452  1254  QRIN----KFSE-PIHKQ--YVEAHQNEFKELLTTIISLSKKYI-QK--PNVESL---  LHQ-AP---EQADNDIyg  1312
WP_049549711  1246  SRYDKLSsKIESeQQKKL--FVEQLHYFDEILDIVKHATCYIKAE--NNLKKII-S  LYK-KK---EAYSINEg--  1311
WP_007896501  1198  SRYDKLSsKIESeQQKKL--FVEQLHYFDEILDIVKHATCYIKAE--ANLEKIK-D  LYK-KK---EAYSINEg--  1263
EFR44625      1247  KNLH----KLDE-PEHLE--YIQKHRNEFKDLLNLVSEFSQKYLAE--ANLEKIK-D  LYA-DN---EQADIEI--  1306
WP_002897477  1253  QRIN----KISE-PIHKQ--YVEAHQNEFKELLTTIISLSKKYI-QK--PNVELL---  LQQ-AP---EQADKDIyg  1311
WP_002906454  1248  QRIN----KLDE-PGHLE--YIQKHRNEFKDLLNLVSEFSQKYVLAD--ANLEKIK-N  LYA-DN---EQADIEI--  1305
WP_009729476  1238  QHAN----KEDS---VI---YLEKRHELSELFHHIGVSEKTLIKP--KVEMTLN-N  AFE-KHf---EFDEVSE--  1295
CQR24647      1252  KNVH----KLDE-PEHLE--YIQKHRYEFKDLLNLVSEFSQKYVLAE--ANLEKIK-N  LYV-DN---EQADIEI--  1311
WP_000066813  1248  KNVH----KITE-PIHLN--YVNNKNHEFKELLRHISDFSTRYILAQ--DRLSKIE-E  LYD-KN---DGDDISD--  1307
WP_009754323  1241  SNIH----KITE-PIHLN--YVNNKNHEFKELLRHISDFSTRYILAQ--DRLSKIE-E  LYD-KN---DGDDISD--  1300
WP_044674937  1243  SNIH----KITE-PIHLN--YVNNKNHEFKELLRHISDFSTRYILAQ--DRLSKIE-E  LYD-KN---DGDDISD--  1302
WP_044676715  1241  SNIH----KITE-PIHLN--YVNNKNHEFKELLRHISDFSTRYILAQ--DRLSKIE-E  LYD-KN---DGDDISD--  1300
WP_044680361  1254  KRIN----NPIN-KDHIE--YVKKHRDDFKELLNVVLEFNEKYVGAT--KNGERLK-E  AVA-DF---DSKSNEE--  1313
WP_049533112  1182  STKQA---DE-AMFLKYyRLEHLEAVFEL---IRKQAADYQIFE--KLIKKIEvN  FYS----c---TYNEk--  1240
WP_029090905  1212  YNAIYKQ-DYDNIDDILM1---QLYIELTNKMKVLYPAY-rGIAEKPE-S  YVV----i---SKEEk--  1268
WP_006506696  1240  SHYEKLKgSPEDnEQKQL--FVEQHKHYLDEIIEQISEFSKRVILAD--ANLDKVL-S  LFE-AN---RDKPIREg--  1305
AIT42264      1218  KHYNE---DE--TSHK----FIVEHKAYFDELLNYIVEFANKYLELE--NSIEKIK-D  LYH-----gKGPDVEEke  1276
WP_034440723  1240  SHYEKLKgSPEDnEQKQL--FVEQHKHYLDEIIEQISEFSKRVILAD--ANLDKVL-S  AYN-KH---RDKPIREg--  1305
AKQ21048      1212  NRYDKVK----fPDSIE--YVHDNLAKFDDLLEYVIDFSNKYINAD--KNVQKIQ-K  IYK-EH---GTEDVEL--  1271
WP_004636532  1212  NRYDKVK----fPDSIE--YVHDNLAKFDDLLEYVIDFSNKYINAD--KNVQKIQ-K  IYK-EH---GTEDVEL--  1271
WP_002364836  1169  KQCLL---PNQ-SESLA---YVEQHQPEFQEILERVVDFAEVHTLAK--SKVQQIV-K  LFE-AN---QTADVKE--  1228
WP_016631044  954   KQCLL---PNQ-SESLA---YVEQHQPEFQEILERVVDFAEVHTLAK--SKVQQIV-K  LFE-AN---QTADVKE--  1013
EMS75795      1218  QHYDEIAhKESF----D---YVNDHLSEPREILDQVIDFSNRYTIAA--KNTEKIA-E  LFE-QN---QESTVQS--  1277
WP_002373311  1218  KQCLL---PNQ-SESLA---YVEQHQPEFQEILERVVDFAEVHTLAK--SKVQQIV-K  LFE-AN---QTADVKE--  1277
WP_002378009  1218  KQCLL---PNQ-SESLA---YVEQHQPEFQEILERVVDFAEVHTLAK--SKVQQIV-K  LFE-AN---QTADVKE--  1277
WP_002407324  1220  KQCLL---PNQ-SESLA---YVEQHQPEFQEILERVVDFAEVHTLAK--SKVQQIV-K  LFE-AN---QTADVKE--  1279
WP_002413717  1218  KQCLL---PNQ-SESLA---YVEQHQPEFQEILERVVDFAEVHTLAK--SKVQQIV-K  LFE-AN---QTADVKE--  1277
WP_010775580  1218  KQCLL---PNQ-SESLA---YVEQHQPEFQEILERVVDFAEVHTLAK--SKVQQIV-K  LFE-AN---QTADVKE--  1277
WP_010818269  1218  KQCLL---PNQ-SESLA---YVEQHQPEFQEILERVVDFAEVHTLAK--SKVQQIV-K  LFE-AN---QTADVKE--  1277
WP_010824395  1218  KQCLL---PNQ-SESLA---YVEQHQPEFQEILERVVDFAEVHTLAK--SKVQQIV-K  LFE-AN---QTADVKE--  1277
WP_016622645  1218  KQCLL---PNQ-SESLA---YVEQHQPEFQEILERVVDFAEVHTLAK--SKVQQIV-K  LFE-AN---QTADVKE--  1277
WP_033624816  1218  KQCLL---PNQ-SESLA---YVEQHQPEFQEILERVVDFAEVHTLAK--SKVQQIV-K  LFE-AN---QTADVKE--  1277
WP_033625576  1218  KQCLL---PNQ-SESLA---YVEQHQPEFQEILERVVDFAEVHTLAK--SKVQQIV-K  LFE-TN---QTADVKE--  1277
```

-continued

| | | |
|---|---|---|
| WP_033789179 | 1218 | KQCLL----PNQ-SESLA--YVEQHQPEFQEILERVVDFAEVHTLAK--SKVQQIV-K LFE-AN----QTADVKE-- 1277 |
| WP_002310644 | 1220 | KQYDEIShKESF------D--YVNEHHKEFSEVFARVLEFAGKYTLAE--KNIEKLE-K IYK-EN----QTDDLAK-- 1279 |
| WP_002312694 | 1221 | KQYDEIShKESF------D--YVNEHHKEFSEVFARVLEFAGKYTLAE--KNIEKLE-K IYK-EN----QTDDLAK-- 1280 |
| WP_002314015 | 1221 | KQYDEIShKESF------D--YVNEHHKEFSEVFARVLEFAGKYTLAE--KNIEKLE-K IYK-EN----QTDDLAK-- 1280 |
| WP_002320716 | 1221 | KQYDEIShKESF------D--YVNEHHKEFSEVFARVLEFAGKYTLAE--KNIEKLE-K IYK-EN----QTDDLAK-- 1280 |
| WP_002330729 | 1220 | KQYDEIShKESF------D--YVNEHHKEFSEVFARVLEFAGKYTLAE--KNIEKLE-K IYK-EN----QTDDLAK-- 1279 |
| WP_002335161 | 1221 | KQYDEIShKESF------D--YVNEHHKEFSEVFARVLEFAGKYTLAE--KNIEKLE-K IYK-EN----QTDDLAK-- 1280 |
| WP_002345439 | 1221 | KQYDEIShKESF------D--YVNEHHKEFSEVFARVLEFAGKYTLAE--KNIEKLE-K IYK-EN----QTDDLAK-- 1280 |
| WP_034867970 | 1211 | QHYDKITyQESF------D--YVNTHLSDFSAILTEVLAFAEKYTLAD--KNIERIQ-E LYE-EN----KYGETSM-- 1270 |
| WP_047937432 | 1221 | KQYDEIShKESF------D--YVNEHHKEFSEVFARVLEFAGKYTLAE--KNIEKLE-K IYK-EN----QTDDLAK-- 1280 |
| WP_010720994 | 1211 | QHYDKITyQESF------D--YVNTHLSDFSAILTEVLAFAEKYTLAD--KNIERIQ-E LYE-EN----KYGEISM-- 1270 |
| WP_010737004 | 1211 | QHYDKITyQESF------D--YVNTHLSDFSAILTEVLAFAEKYTLAD--KNIERIQ-E LYE-EN----KYGETSM-- 1270 |
| WP_034700478 | 1211 | QHYDKITyQESF------D--YVNTHLSDFSAILTEVLAFAEKYTLAD--KNIERIQ-E LYE-EN----KYGEISM-- 1270 |
| WP_007209003 | 1209 | KKIIN--gKNSD---SVS--YIQNNKEKPREIFEYIVDFSSKYISAD--ANLNKIE-K IFE-NNfh---KASEge 1269 |
| WP_023519017 | 1205 | RHYDEINhKVSF------D--YVNAHKEGNDIFDFISDFGVRYILAP--QHLEKIK-V AYE-KN----KEVDLKE-- 1264 |
| WP_010770040 | 1213 | KQVDE------DS-GKSEE--YVREHRAEFAEILNVQAFSETKILAN--KNLQTIL-L LYE-KN----KEADIKE-- 1274 |
| WP_048604708 | 1214 | KHCNE------KP-D-SLK--YVTEHQSGFSEIMAHVKDFAEKYTIVD--KNLEKIL-S LYA-KN----MDSEVKE-- 1270 |
| WP_010750235 | 1214 | NHYDEIAyKDSY------D--YVNEHFSNFQDILDKVIIFAEKYTSAP--QKLNQII-A TYE-KN----QEADRKI-- 1273 |
| AII16583 | 1279 | SHYEKLKgSPEDnEQKQL--FVEQHKHYLDEIIEQISEFSKRVILAD--ANLDKVL-S AYN-KH----RDKPIREg-- 1344 |
| WP_029073316 | 1226 | YKAMKYK-NYSEISQEEIm---------NVYDIFVEKLKLYYPTY-kNIAINPE-D FEN----i----SDEEk-- 1282 |
| WP_031589969 | 1226 | YKAMKYK-NVDNIDSEKIi---------DLYRLLINKMELYYPEYrkQLVKKFE-D LKV----i----SIEEk-- 1283 |
| KDA45870 | 1200 | NAKDG------EQKLE-----DHKAEFKELFDKIMEFADKVVAP--KNSEKIR-R LYE-ENg-----DATPme 1253 |
| WP_039099354 | 1242 | LPLTQ------SEeLAEQV---------YDEILDQVMHYFPLYDINQfrAKLSAGKaA DGN-KMv-----QVQggv 1306 |
| AKP02966 | 1238 | QIPDE------DpDQILAf---YDKNILVEILQELITKMKKFYPFY--KNEQEFLaS FNQ--------ATTSEk-- 1296 |
| WP_010991369 | 1216 | ANCEV-----SD-GKSLD--YIESNREMFAELLAHVSEFAKRYTLAE--ANLNKIN-Q LFE-QN----KEGDIKA-- 1274 |
| WP_033838504 | 1216 | ANCEV-----SD-GKSLD--YIESNREMFAELLAHVSEFAKRYTLAE--ANLNKIN-Q LFE-QN----KEGDIKA-- 1274 |
| EHN60060 | 1219 | ANCEV-----SD-GKSLD--YIESNREMFAELLAHVSEFAKRYTLAE--ANLNKIN-Q LFE-QN----KEGDIKA-- 1277 |
| EFR89594 | 985 | ANCEV-----ND-GESLA--YIEMHREMFAELLAYISEFAKRYTLAN--DRLEKIN-M FFE-QN----KKGDIKV-- 1043 |
| WP_038409211 | 835 | KNCEA-----ND-GESLA--YIEMHREMFAELLAYISEFAKRYTLAN--DRLEKIN-M FFE-QN----KKGDIKV-- 893 |
| EFR95520 | 1216 | KNCEA-----SD-GKSLK--YIEAHRETFSELLAQVSEFATRYTLAD--ANLSKIN-N LFE-QN----KEGDIKA-- 1274 |
| WP_003723650 | 1216 | KNCEA-----SD-GKSLK--YIEAHRETFSELLAQVSEFATKYTLAD--ANLSKIN-N LFE-QN----KEGDIKA-- 1274 |
| WP_003727705 | 1216 | KNCEA-----SD-GKSLK--YIEAHRETFSELLAQVSEFATKYTLAD--ANLSKIN-N LFE-QN----KEGDIKA-- 1274 |
| WP_003730785 | 1216 | EKYEA-----ID-GESLA--YIEVHRALFDELLAYISEFARKYTLSN--DRLDEIN-M LYE-RN----KDGDVKS-- 1274 |
| WP_003733029 | 1219 | EKYEA-----ID-GESLA--YIEVHRALFDELLAYISEFARKYTLSN--DRLDEIN-M LYE-RN----KDGDVKS-- 1277 |
| WP_003739838 | 1216 | KNCEA-----SD-GKSLD--YIESNREMFGELLAHVSEFATRYTLAD--ANLSKIN-Q LFE-QN----KDNDIKV-- 1274 |
| WP_014601172 | 1216 | KNCEA-----ID-GESLA--YIEAHRETFSELLAQVSEFATRYTLAD--ANLSKIN-N LFE-QN----KEGDIQA-- 1274 |
| WP_023548323 | 1216 | EKREA-----ID-GESLA--YIEAHKAVFGELLAHISEFARKYTLAN--DKLDEIN-M LYE-QN----KDGDVKS-- 1274 |
| WP_031665337 | 1216 | KNCEA-----ID-GESLA--YIEAHRETFSELLAQVSEFATRYTLAD--ANLSKIN-N LFE-QN----KEGDIKA-- 1274 |
| WP_031669209 | 1216 | EKYEA-----ID-GESLA--YIEVHRALFDELLAYISEFARKYTLSN--DRLDEIN-M LYE-RN----KDGDVKS-- 1274 |
| WP_033920898 | 1219 | EKREA-----ID-GESLA--YIEAHKAVFGELLAHISEFARKYTLAN--DKLDEIN-M LYE-RN----KDGDVKS-- 1277 |
| AKI42028 | 1219 | KNCEA-----ID-GESLA--YIEAHRETFSELLAQVSEFATRYTLAD--ANLSKIN-N LFE-QN----KEGDIQA-- 1277 |
| AKI50529 | 664 | KNCEA-----SD-GKSLK--YTEAHRETFSELLAQVSEFATRYTLAD--ANLSKIN-T IFE-QN----KSGDVKV-- 722 |
| EFR83390 | 1216 | KNCEA-----SD-GKSLA--YIESHREMFAELLDSISEFASRYTLAD--ANLDKIN-S AYN-KH----RDKPIREq-- 1274 |
| WP_046323366 | 1256 | SHYEKLKgSPEDnEQKQL--FVEQHKHYLDEIIEQISEFSKRVILAD--ANLDKVL-S AYN-KH----RDKPIREq-- 1321 |
| AKE81011 | 1216 | YNAIYKQ-DEDGIDNMLMi---------QLYLQLIDKLKTLYPIY-mGIVEKFE-K FVS--------SKEEk-- 1272 |
| CUO82355 | 1218 | YAAMLKK-RYEYIDEEEIf---------DLYLQLLQKMDTLYPAY-kGIAKRFF-D FKN----i----DVVEk-- 1274 |
| WP_033162887 | 1273 | SHYEKLKgSPEDnEQKQL--FVEQHKHYLDEIIEQISEFSKRVILAD--ANLDKVL-S AYN-KH----RDKPIREq-- 1338 |
| AGZ01981 | 1240 | SHYEKLKgSPEDnEQKQL--FVEQHKHYLDEIIEQISEFSKRVILAD--ANLDKVL-S AYN-KH----RDKPIREq-- 1305 |
| AKA60242 | 1240 | SHYEKLKgSPEDnEQKQL--FVEQHKHYLDEIIEQISEFSKRVILAD--ANLDKVL-S AYN-KH----RDKPIREq-- 1305 |
| AKS40380 | 1244 | SHYEKLKgSPEDnEQKQL--FVEQHKHYLDEIIEQISEFSKRVILAD--ANLDKVL-S AYN-KH----RDKPIREq-- 1309 |
| 4UN5_B | 1306 | -AE---NII HLFTLTNLGAP-AAFKYFD-[T]I--DRK--R-YTSTKEVL DATLIHQSITGLYETRIDLSQL-- 1365 |

-continued

```
WP_039695303  1309  ISN---SFI  NLLLTLALGAP-ADFNFLG--EKI--PRK--R-YTSTKECL  NATLIHQSITGLYETRIDLSKL--  1369
WP_045635197  1307  LAN---SFI  NLLIFTALGAP-AAFKFFG--KDI--DRK--R-YTTVSEIL  NATLIHQSITGLYETWIDLSKL--  1367
5AXW_A        ----  ---------  -------------------------------------  ------------------------  ----
WP_009880683   990  -AE---NII  HLFTLTNLGAP-AAFKCFD--TTI--GRN--R-YKSIKEVL  DATLIHQSITGLYEIRIDLSQL--  1049
WP_010922251  1306  -AE---NII  HLFTLTNLGAP-AAFKYFD--TTI--DRK--R-YTSTKEVL  DATLIHQSITGLYETRIDLSQL--  1365
WP_011054416  1306  -AE---NII  HLFTLTNLGAP-AAFKYFD--TTI--DRK--R-YTSTKEVL  DATLIHQSITGLYETRIDLSQL--  1365
WP_011284745  1306  -AE---NII  HLFTLTNLGAP-AAFKYFD--TTI--DRK--R-YTSTKEVL  DATFIHQSITGLYETRIDLSQL--  1365
WP_011285506  1306  -AE---NII  HLFTLTNLGAP-TAFKYFD--TTI--DRK--R-YTSTKEVL  DATFIHQSITGLYETRIDLSQL--  1365
WP_011527619  1306  -AE---NII  HLFTLTNLGAP-AAFKCFD--TTI--DRK--R-YKSIKEVL  DATLIHQSITGLYETRIDLSQL--  1365
WP_012560673  1306  -AE---NII  HLFTLTNLGAP-AAFKYFD--TTI--GRN--R-YKSIKEVL  DATLIHQSITGLYETRIDLSQL--  1365
WP_014407541  1305  -AE---NII  HLFTLTNLGAP-AAFKYFD--TTI--DRK--R-YKSIKEVL  DATLIHQSITGLYETRIDLSQL--  1364
WP_020905136  1305  -AK---NII  HLFTLTNLGAP-AAFKYFD--TTI--DRK--R-YTSTKEVL  DATLIHQSITGLYETRIDLSQL--  1364
WP_023080005  1306  -AK---NII  HLFTLTNLGAP-AAFKYFD--TTI--ERN--R-YKSIKEVL  DATLIHQSITGLYEIRIDLSQL--  1365
WP_023610282  1305  -AE---NII  HLFTLTNLGAP-TAFKYFD--TTI--ERN--R-YKSIKEVL  DATLIHQSITGLYETRIDLSQL--  1364
WP_030125963  1306  -AE---NII  HLFTLTNLGAP-AAFKYFD--TTI--GRN--R-YKSIKEVL  DATLIHQSITGLYETRIDLSQL--  1365
WP_030126706  1306  -AE---NII  HLFTLTNLGAP-AAFKYFD--TTI--DRK--R-YTSTKEVL  DATLIHQSITGLYETRIDLSQL--  1365
WP_031488318  1306  -AE---NII  HLFTLTNFGAP-AAFIYFD--TTI--GRN--R-YKSIKEVL  DATLIHQSITGLYETRIDLSQL--  1365
WP_032460140  1306  -AE---NII  HLFTLTNLGAP-AAFKYFD--TTI--DRK--R-YKSIKEVL  DATLIHQSITGLYETRIDLSQL--  1365
WP_032461047  1306  -AE---NII  HLFTLTNLGAP-AAFKYFD--TTI--GRN--R-YKSIKEVL  DATLIHQSITGLYETRIDLSQL--  1365
WP_032462016  1306  -AE---NII  HLFTLTNLGAP-AAFKYFD--TTI--DRK--R-YTSTKEVL  DATLIHQSITGLYETRIDLSQL--  1365
WP_032462936  1306  -AE---NII  HLFTLTNLGAP-AAFKYFD--TTI--DRK--R-YTSTKEVL  DATLIHQSITGLYETRIDLSQL--  1365
WP_032464890  1306  -AE---NII  HLFTLTNLGAP-TAFKYFD--TTI--DRK--R-YTSTKEVL  DATFIHQSITGLYETRIDLSQL--  1365
WP_033889930  1131  -AE---NII  HLFTLTNLGAP-AAFKYFD--TTI--DRK--R-YTSTKEVL  DATLIHQSITGLYETRIDLSQL--  1190
WP_038431314  1306  -AE---NII  HLFTLTNLGAP-AAFKYFD--TTI--ERN--R-YKSIKEVL  DATLIHQSITGLYETRIDLSQL--  1365
WP_038432938  1305  -AK---NII  HLFTLTNLGAP-AAFKYFD--TTI--DRK--R-YKSIKEVL  DATLIHQSITGLYETRIDLSQL--  1364
WP_038434062  1306  -AE---NII  HLFTLTNLGAP-AAFKYFD--TTI--GRN--R-YKSIKEVL  DATLIHQSITGLYETRIDLSQL--  1365
BAQ51233      1217  -AE---NII  HLFTLTNLGAP-AAFKYFD--TTI--DRK--R-YTSTKEVL  DATLIHQSITGLYETRIDLSQL--  1276
KGE60162       481  -AE---NII  HLFTLTNLGAP-AAFKYFD--TTI--DRK--R-YTSTKEVL  DATFIHQSITGLYETRIDLSQL--   540
KGE60856       244  -AE---NII  HLFTLTNLGAP-AAFKYFD--TTI--DRK--R-YTSTKEVL  DATLIHQSITGLYETRIDLSQL--   303
WP_002989955  1306  LAK---SFI  SLLTPTAFGAP-AANFFG---ENI--DRK--R-YTSVTECL  NATLIHQSITGLYETRIDLSKL--  1365
WP_003030002  1282  ISN---SFI  SLLTPTALGAP-ADFNFLG--ENI--PRK--R-YTSTKECL  NATLIHQSITGLYETRIDLSKI--  1342
WP_003065552  1310  LAN---NII  NLFTFTSLGAP-AAFKFFD--KIV--DRK--R-YTSTKEVL  NSTLIHQSITGLYETRIDLSKI--  1370
WP_001040076  1307  LAN---NII  NLFTFTSLGAP-AAFKFFD--KIV--DRK--R-YTSTKEVL  NSTLIHQSITGLYETRIDLGKL--  1367
WP_001040078  1315  LAN---NII  NLFTFTSLGAP-AAFKFFD--KIV--DRK--R-YTSTKEVL  NSTLIHQSITGLYETRIDLSKL--  1375
WP_001040080  1307  LAN---NII  NLFTFTSLGAP-AAFKFFD--KIV--DRK--R-YTSTKEVL  NSTLIHQSITGLYETRIDLGKL--  1367
WP_001040081  1307  LAN---NII  NLFTFTSLGAP-AAFKFFD--KIV--DRK--R-YTSTKEVL  NSTLIHQSITGLYETRIDLGKL--  1367
WP_001040083  1307  LAN---NII  NLFTFTSLGAP-AAFKFFD--KIV--DRK--R-YTSTKEVL  NSTLIHQSITGLYETRIDLGKL--  1367
WP_001040085  1307  LAN---NII  NLFTFTSLGAP-AAFKFFD--KIV--DRK--R-YTSTKEVL  NSTLIHQSITGLYETRIDLGKL--  1367
WP_001040087  1307  LAN---NII  NLFTFTSLGAP-AAFKFFD--KIV--DRK--R-YTSTKEVL  NSTLIHQSITGLYETRIDLGKL--  1367
WP_001040088  1307  LAN---NII  NLFTFTSLGAP-AAFKFFD--KIV--DRK--R-YTSTKEVL  NSTLIHQSITGLYETRIDLGKL--  1367
WP_001040089  1307  LAN---NII  NLFTFTSLGAP-AAFKFFD--KIV--DRK--R-YTSTKEVL  NSTLIHQSITGLYETRIDLGKL--  1367
WP_001040090  1307  LAN---NII  NLFTFTSLGAP-AAFKFFD--KIV--DRK--R-YTSTKEVL  NSTLIHQSITGLYETRIDLGKL--  1367
WP_001040091  1307  LAN---NII  NLFTFTSLGAP-AAFKFFD--KSV--DRK--R-YTSTKEVL  DSTLIHQSITGLYETRIDLGKL--  1367
WP_001040092  1307  LAK---NII  NLFTFTSLGAP-AAFKFFD--KIV--DRK--R-YTSTKEVL  NSTLIHQSITGLYETRIDLGKL--  1367
WP_001040094  1307  LAN---NII  NLFTFTSLGAP-AAFKFFD--KIV--DRK--R-YTSTKEVL  NSTLIHQSITGLYETRIDLGKL--  1367
WP_001040095  1307  LAN---NII  NLFTFTSLGAP-AAFKFFD--KIV--DRK--R-YTSTKEVL  NSTLIHQSITGLYETRIDLGKL--  1367
WP_001040096  1307  LAN---NII  NLFTFTSLGAP-AAFKFFD--KIV--DRK--R-YTSTKEVL  NSTLIHQSITGLYETRIDLGKL--  1367
WP_001040097  1307  LAN---NII  NLFTFTSLGAP-AAFKFFD--KIV--DRK--R-YTSTKEVL  NSTLIHQSITGLYETRIDLGKL--  1367
WP_001040098  1307  LAN---NII  NLFTFTSLGAP-AAFKFFD--KIV--DRK--R-YTSTKEVL  NSTLIHKSITGLYETRIDLGKL--  1367
WP_001040099  1307  LAN---NII  NLFTFTSLGAP-AAFKFFD--KIV--DRK--R-YTSTKEVL  NSTLIHQSITGLYETRIDLGKL--  1367
WP_001040100  1307  LAN---NII  NLFTFTSLGAP-AAFKFFD--KIV--DRK--R-YTSTKEVL  NSTLIHQSITGLYETRIDLGKL--  1367
WP_001040104  1307  LAN---NII  NLFTFTSLGAP-AAFKFFD--KIV--DRK--R-YTSTKEVL  NSTLIHQSITGLYETRIDLGKL--  1367
WP_001040105  1307  LAN---NII  NLFTFTSLGAP-AAFKFFD--KIV--DRK--R-YTSTKEVL  NSTLIHQSITGLYETRIDLGKL--  1367
```

-continued

| | | | | | |
|---|---|---|---|---|---|
| WP_001040106 | 1307 | LAN---NII NLFTFTSLGAP-AAFKFFD--KIV--DRK--R-YTSTKEVL NSTLIHQSITGLYETRIDLGKL-- | 1367 |
| WP_001040107 | 1307 | LAN---NII NLFTFTSLGAP-AAFKFFD--KIV--DRK--R-YTSTKEVL NSTLIHQSITGLYETRIDLGKL-- | 1367 |
| WP_001040108 | 1307 | LAN---NII NLFTFTSLGAP-AAFKFFD--KIV--DRK--R-YTSTKEVL NSTLIHQSITGLYETRIDLGKL-- | 1367 |
| WP_001040109 | 1307 | LAN---NII NLFTFTSLGAP-AAFKFFD--KIV--DRK--R-YTSTKEVL NSTLIHQSITGLYETRIDLGKL-- | 1367 |
| WP_001040110 | 1307 | LAN---NII NLFTFTSLGAP-AAFKFFD--KIV--DRK--R-YTSTKEVL NSTLIHQSITGLYETRIDLGKL-- | 1367 |
| WP_015058523 | 1307 | LAK---NII NLFTFTSLGAP-AAFKFFD--KSV--DRK--R-YTSTKEVL DSTLIHQSITGLYETRIDLGKL-- | 1367 |
| WP_017643650 | 1307 | LAN---NII NLFTFTSLGAP-AAFKFFD--KIV--DRK--R-YTSTKEVL NSTLIHQSITGLYETRIDLGKL-- | 1367 |
| WP_017647151 | 1307 | LAN---NII NLFTFTSLGAP-AAFKFFD--KIV--DRK--R-YTSTKEVL NSTLIHQSITGLYETRIDLGKL-- | 1367 |
| WP_017648376 | 1307 | LAN---NII NLFTFTSLGAP-AAFKFFD--KIV--DRK--R-YTSTKEVL NSTLIHQSITGLYETRIDLGKL-- | 1367 |
| WP_017649527 | 1307 | LAN---NII NLFTFTSLGAP-AAFKFFD--KIV--DRK--R-YTSTKEVL NSTLIHQSITGLYETRIDLGKL-- | 1367 |
| WP_017771611 | 1307 | LAN---NII NLFTFTSLGAP-AAFKFFD--KIV--DRK--R-YTSTKEVL NSTLIHQSITGLYETRIDLGKL-- | 1367 |
| WP_017771984 | 1321 | LAN---NII NLFTFTSLGAP-AAFKFFD--KIV--DRK--R-YTSTKEVL NSTLIHQFITGLYETRIDLGKL-- | 1381 |
| CFQ25032 | 1307 | LAN---NII NLFTFTSLGAP-AAFKFFD--KIV--DRK--R-YTSTKEVL NSTLIHQSITGLYETRIDLGKL-- | 1367 |
| CFV16040 | 1307 | LAN---NII NLFTFTSLGAP-AAFKFFD--KIV--DRK--R-YTSTKEVL NSTLIHQSITGLYETRIDLGKL-- | 1367 |
| KLJ37842 | 1307 | LAN---NII NLFTFTSLGAP-AAFKFFD--KIV--DRK--R-YTSTKEVL NSTLIHQSITGLYETRIDLGKL-- | 1367 |
| KLJ72361 | 1307 | LAN---NII NLFTFTSLGAP-AAFKFFD--KIV--DRK--R-YTSTKEVL NSTLIHQSITGLYETRIDLGKL-- | 1367 |
| KLL20707 | 1307 | LAN---NII NLFTFTSLGAP-AAFKFFD--KIV--DRK--R-YTSTKEVL NSTLIHKSITGLYETRIDLGKL-- | 1367 |
| KLL42645 | 1307 | LAN---NII NLFTFTSLGAP-AAFKFFD--KIV--DRK--R-YTSTKEVL NSTLIHQSITGLYETRIDLGKL-- | 1367 |
| WP_047207273 | 1307 | LAN---NII NLFTFTSLGAP-AAFKFFD--KIV--DRK--R-YTSTKEVL NSTLIHQSITGLYETRIDLGKL-- | 1367 |
| WP_047209694 | 1307 | LAN---NII NLFTFTSLGAP-AAFKFFD--KIV--DRK--R-YTSTKEVL NSTLIHQSITGLYETRIDLGKL-- | 1367 |
| WP_050198062 | 1307 | LAN---NII NLFTFTSLGAP-AAFKFFD--KIV--DRK--R-YTSTKEVL NSTLIHQSITGLYETRIDLGKL-- | 1367 |
| WP_050201642 | 1307 | LAN---NII NLFTFTSLGAP-AAFKFFD--KII--DRK--R-YTSTKEVL NSTLIHQSITGLYETRIDLGKL-- | 1367 |
| WP_050204027 | 1307 | LAN---NII NLFTFTSLGAP-AAFKFFD--KIV--DRK--R-YTSTKEVL NSTLIHQSITGLYETRIDLGKL-- | 1367 |
| WP_050881965 | 1307 | LAN---NII NLFTFTSLGAP-AAFKFFD--KSV--DRK--R-YTSTKEVL DSTLIHQSITGLYETRIDLGKL-- | 1367 |
| WP_050886065 | 1307 | LAN---NII NLFTFTSLGAP-AAFKFFD--KIV--DRK--R-YTSTKEVL NSTLIHQSITGLYETRIDLGKL-- | 1367 |
| AHN30376 | 1307 | LAN---NII NLFTFTSLGAP-AAFKFFD--KIV--DRK--R-YTSTKEVL NSTLIHQSITGLYETRIDLGKL-- | 1367 |
| EAO78426 | 1307 | LAK---NII NLFTFTSLGAP-AAFKFFD--KIV--DRK--R-YTSTKEVL NSTLIHQSITGLYETRIDLGKL-- | 1367 |
| CCW42055 | 1307 | LAN---NII NLFTFTSLGAP-AAFKFFD--KIV--DRK--R-YTSTKEVL NSTLIHQSITGLYETRIDLGKL-- | 1367 |
| WP_003041502 | 1314 | ICT---SFL GLFELTSLGSA-SDPEFLG--VKI--PRY--RdYTPSSLLK DSTLIHQGITGLYETRIDLSKL-- | 1383 |
| WP_037593752 | 1283 | LAK---SFI SLLTFTAFGAP-AAFNFFG--ENI--DRK--R-YTSVTECL NATLIHQSITGLYETRIDLSKL-- | 1343 |
| WP_049516684 | 1283 | LAK---SFI SLLTFTAFGAP-AAFNFFG--ENI--DRK--R-YTSVTECL NATLIHQSITGLYETQTDLSKL-- | 1343 |
| GAD46167 | 1282 | LAK---SFI SLLTFTAFGAP-AAFNFFG--EKI--PRK--R-YNSTKECL NATLIHQSITGLYETRIDLSKL-- | 1342 |
| WP_018363470 | 1314 | ISD---SFI NLLTLTALGAP-ADFNFLG--EKI--PRK--R-YNSTKECL NATLIHQSITGLYETRIDLSKL-- | 1374 |
| WP_003043819 | 1311 | -SN---SFV SLLKYTSFGAS-GGFTFLD--LDVkgGRL--R-YQTVTEVL DATLIYQSITGLYETRTDLSQL-- | 1372 |
| WP_006269658 | 1282 | LAK---SFI SLLTFTAFGAP-AAFNFFG--ENI--DRK--R-YTSVTECL NATLIHQSITGLYETRIDLSKL-- | 1342 |
| WP_048800889 | 1302 | ISN---SFI HLLTLTALGAP-ADFNFLG--EKI--PRK--R-YTSTKECL NATLIHQSITGLYETQTDLSKL-- | 1362 |
| WP_012767106 | 1309 | -CS---SVI NLLTLTASGAP-ADFKFLG--TTI--PRK--R-YGSPQSLL SSTLIHQSITGLYETRIDLSQL-- | 1368 |
| WP_014612333 | 1309 | -CS---SVI NLLTLTASGAP-ADFKFLG--TTI--PRK--R-YGSPQSLL SSTLIHQSITGLYETRIDLSQL-- | 1368 |
| WP_015017095 | 1309 | -CS---SVI NLLTLTASGAP-ADFKFLG--TTI--PRK--R-YGSPQSLL SSTLIHQSITGLYETRIDLSQL-- | 1368 |
| WP_015057649 | 1309 | -CS---SVI NLLTLTASGAP-ADFKFLG--TTI--PRK--R-YGSPQSLL SSTLIHQSITGLYETRIDLSQL-- | 1368 |
| WP_048327215 | 1309 | -CS---SVI NLLTLTASGAP-ADFKFLG--TTI--PRK--R-YGSPQSLL SSTLIHQSITGLYETRIDLSQL-- | 1368 |
| WP_049519324 | 1309 | -CS---SVI NLLTLTASGAP-ADFKFLG--TTI--PRK--R-YGSPQSLL SSTLIHQSITGLYETRIDLSQL-- | 1368 |
| WP_012515931 | 1286 | -AE---NII NVFTFVALGAP-AAFKFFD--ATI--DRK--R-YTSTKEVL NATLIHQSVTGLYETRIDLSQL-- | 1345 |
| WP_021320964 | 1286 | -AE---NII NVFTFVALGAP-AAFKFFD--ATI--DRK--R-YTSTKEVL NATLIHQSVTGLYETRIDLSQL-- | 1345 |
| WP_037581760 | 1286 | -AE---NII NVFTFVALGAP-AAFKFFD--ATI--DRK--R-YTSTKEVL NATLIHQSVTGLYETRIDLSQL-- | 1345 |
| WP_004232481 | 1309 | ISSlseSFI NLLKFISFGAP-GAFKFLK--LDV--KQSnlR-YKSTTEAL SATLIHQSITGLYETRIDLSKL-- | 1374 |
| WP_009854540 | 1307 | ISN---SFI NLLTLTALGAP-ADFNFLG--EKI--PRK--R-YTSTKECL TATLIHQSITGLYETRIDLSKL-- | 1367 |

```
                              -continued

WP_012962174    1308 ISI---SFV NLLLTLTALGAP-ADFNFLG--EKI--PRK--R-YTSTKECL NATLIHQSITGLYETRIDLSKCL        1368
WP_039695303    1309 ISN---SFI NLLLTLTALGAP-ADFNFLG--EKI--PRK--R-YTSTKECL NATLIHQSITGLYETRIDLSKCL        1369
WP_014334983    1312 ISA---SFI NLLLTLTALGAP-ADFNFLG--EKI--PRK--R-YTSTKECL SATLIHQSVTGLYETRIDLSKL         1372
WP_045618028    1311 LSE---SFI SLLKLISFGAP-GTFKFFG--VEI--SQSnvR-YQSVSSCF NATLIHQSITGLYETWIDLSKL         1373
WP_045635197    1307 LAN---SFI NLFTFTDLGAP-SAFKFFN--GDI--DRK--R-YSSTNEIL NSTLIYQSPTGLYETRIDLSKL         1367
WP_002263549    1282 LAS---SFI NLLTFTAIGAP-ATFKFFD--KNI--DRK--R-YTSTTEIL NATLIHQSITGLYETRIDLNKL         1342
AHY15608         138 ---       ---------------------------------------                                  197
AHY17476             ---       ---------------------------------------
ESR09100        -AI---NML NLFTFTDLGAP-SAFKFFNg--DI--DRK--R-YSSTNEII NSTLIYQSPTGLYETRIDLSKL
AGM98575             ---       ---------------------------------------
ALF27331        1282 LAS---SFI NLLTFTAIGAP-AAFKFFD--NNI--DRK--R-YTSTTEIL NATLIHQSITGLYETRIDLSRL         1342
WP_018372492    1290 VAR---SFV -LLNFTMMGAA-TDFKFFG--QII--PRK--R-YPSTTECL KSTLIHQSVTGLYETRIDLSKL         1350
WP_002263887    1282 LAS---SFI NLLTFTAIGAP-ATFKFFD--KNI--DRK--R-YTSTTEIL NATLIHQSITGLYETRIDLNKL         1342
WP_002264920    1282 LAS---SFI NLLTFTAIGAP-ATFKFFD--KNI--DRK--R-YTSTTEIL NATLIHQSITGLYETRIDLNKL         1342
WP_002269043    1282 LAS---SFI NLLTFTAIGAP-ATFKFFD--KNI--DRK--R-YTSTTEIL NATLIHQSITGLYETRIDLNKL         1342
WP_002269448    1282 LAS---SFI NLLTFTAIGAP-ATFKFFD--KNI--DRK--R-YTSTTEIL NATLIHQSITGLYETRIDLSKL         1342
WP_002271977    1282 LAS---SFI NLLTFTAIGAP-ATFKFFD--KNI--DRK--R-YTSTTEIL NATLIHQSITGLYETRIDLSKL         1342
WP_002272766    1282 LAS---SFI NLLTFTAIGAP-ATFKFFD--KNI--DRK--R-YTSTTEIL NATLIHQSITGLYETRIDLSKL         1342
WP_002273241    1282 LAS---SFI NLLTFTAIGAP-ATFKFFD--KNI--DRK--R-YTSTTEIL NATLIHQSITGLYETRIDLSKL         1342
WP_002275430    1282 LSS---SFI NLLTFTAIGAP-ATFKFFD--KNI--DRK--R-YTSTTEIL NATLIHQSITGLYETRIDLSKL         1342
WP_002276448    1288 LAD---GFI KLLGFTQLGAT-SPPSFLG--IKL--NQK--Q-YTGKDYL  EATLIHQSITGLYETRIDLNKL         1352
WP_002277050    1282 LAS---SFI NLLTFTAIGAP-ATFKFFD--KNI--DRK--R-YTSTTEIL NATLIHQSITGLYETRIDLSKL         1342
WP_002773364    1282 LAS---SFI NLLTFTAIGAP-ATFKFFD--KNI--DRK--R-YTSTTEIL NATLIHQSITGLYETRIDLSKL         1342
WP_002279025    1282 LAS---SFI NLLTFTAIGAP-ATFKFFD--KNI--DRK--R-YTSTTEIL NATLIHQSITGLYETRIDLSKL         1342
WP_002279859    1282 LSS---SFI NLLTFTAIGAP-AAFKFFD--KNI--DRK--R-YTSTTEIL NATLIHQSITGLYETRIDLSKL         1342
WP_002280230    1282 LAS---SFI NLLTFTAIGAP-ATFKFFD--KNI--DRK--R-YTSTTEIL NATLIHQSITGLYETRIDLSKL         1342
WP_002281696    1282 LSS---SFI NLLTFTAIGAP-AAFKFFD--KNI--DRK--R-YTSTTEIL NATLIHQSITGLYETRIDLSKL         1342
WP_002282247    1288 LAD---GFI KLLGFTQLGAT-SPPSFLG--IKL--NQK--Q-YTGKDYL  EATLIHQSITGLYETRIDLSKL         1352
WP_002282906    1282 LAS---SFI NLLTFTAIGAP-ATFKFFD--KNI--DRK--R-YTSTTEIL NATLIHQSITGLYETRIDLSKL         1342
WP_002283846    1282 LAS---SFI NLLTFTAIGAP-ATFKFFD--KNI--DRK--R-YTSTTEIL NATLIHQSITGLYETRIDLSKL         1342
WP_002287255    1282 LAS---SFI NLLTFTAIGAP-ATFKFFD--KNI--DRK--R-YTSTTEIL NATLIHQSITGLYETRIDLSKL         1342
WP_002288990    1282 LAS---SFI NLLTFTAIGAP-AAFKFFD--KNI--DRK--R-YTSTTEIL NATLIHQSITGLYETRIDLSKL         1342
WP_002289641    1282 LAS---SFI NLLTFTAIGAP-ATFKFFD--KNI--DRK--R-YTSTTEIL NATLIHQSITGLYETRIDLSKL         1342
WP_002290427    1282 LAS---SFI NLLTFTAIGAP-ATFKFFD--KNI--DRK--R-YTSTTEIL NATLIHQSITGLYETRIDLSKL         1342
WP_002295753    1282 LAS---SFI NLLTFTAIGAP-AAFKFFD--KNI--DRK--R-YTSTTEIL NATLIHQSITGLYETRIDLSKL         1342
WP_002296423    1282 LAS---SFI NLLTFTAIGAP-ATFKFFD--KNI--DRK--R-YTSTTEIL NATLIHQSITGLYETRIDLSKL         1342
WP_002304487    1296 LAS---SFI NLLTFTAIGAP-AAFKFFD--KNI--DRK--R-YTSTTEIL NATLIHQSITGLYETRIDLNKL         1356
WP_002305844    1282 LAS---SFI NLLTFTAIGAP-ATFKFFD--KNI--DRK--R-YTSTTEIL NATLIHQSITGLYETRIDLSKL         1342
WP_002307203    1282 LAS---SFI NLLTFTAIGAP-AAFKFFD--KNI--DRK--R-YTSTTEIL NATLIHQSITGLYETRIDLSKL         1342
WP_002310390    1282 LAS---SFI NLLTFTAIGAP-ATFKFFD--KNI--DRK--R-YTSTTEIL NATLIHQSITGLYETRIDLSKL         1342
WP_002352408    1282 LAS---SFI NLLTFTAIGAP-ATFKFFD--KNI--DRK--R-YTSTTEIL NATLIHQSITGLYETRIDLSKL         1342
WP_012997688    1282 LAS---SFI NLLTFTAIGAP-ATFKFFD--KNI--DRK--R-YTSTTEIL NATLIHQSITGLYETRIDLSKL         1342
WP_014677909    1282 LAS---SFI NLLTFTAIGAP-ATFKFFD--KNI--DRK--R-YTSTTEIL NATLIHQSITGLYETRIDLSKL         1342
WP_019312892    1282 LAS---SFI NLLTFTAIGAP-ATFKFFD--KNI--DRK--R-YTSTTEIL NATLIHQSITGLYETRIDLSKL         1342
WP_019313659    1282 LAS---SFI NLLTFTAIGAP-ATFKFFD--KNI--DRK--R-YTSTTEIL NATLIHQSITGLYETRIDLSKL         1342
WP_019314093    1282 LAS---SFI NLLTFTAIGAP-AAFKFFD--KNI--DRK--R-YTSTTEIL NATLIHQSITGLYETRIDLNKL         1342
WP_019315370    1282 LSS---SFI NLLTFTAIGAP-ATFKFFD--KNI--DRK--R-YTSTTEIL NATLIHQSITGLYETRIDLSKL         1342
WP_019803776    1282 LAS---SFI NLLTFTAIGAP-ATFKFFD--KNI--DRK--R-YTSTTEIL NATLIHQSITGLYETRIDLNKL         1342
WP_019805234    1282 LAS---SFI NLLTFTAIGAP-ATFKFFD--KNI--DRK--R-YTSTTEIL NATLIHQSITGLYETRIDLSKL         1342
WP_024783594    1282 LAS---SFI NLLTFTAIGAP-ATFKFFD--KNI--DRK--R-YTSTTEIL NATLIHQSITGLYETRIDLNKL         1342
WP_024784288    1288 LAD---GFI KLLGFTQLGAT-SPPSFLG--IKL--NQK--Q-YTGKDYL  EATLIHQSITGLYETRIDLSKL         1352
WP_024784666    1282 LAS---SFI NLLTFTAIGAP-ATFKFFD--KNI--DRK--R-YTSTTEIL NATLIHQSITGLYETRIDLSKL         1342
```

| | | | | |
|---|---|---|---|---|
| WP_024784894 | 1282 | LAS---SFI NLLTFTAIGAP-ATFKFFD--KNI--DRK--R-YTSTTEIL | NATLIHQSITGLYETRIDLSKL- | 1342 |
| WP_024786433 | 1288 | LAD---GFI KLLGFTQLGAT-SPFSFLG--IKL--NQK--Q-YTGKKDYL | EATLIHQSITGLYETRIDLSKL- | 1352 |
| WP_049473442 | 1282 | LAS---SFI NLLTFTAIGAP-AAFKFFD--KNI--DRK--R-YTSTTEIL | NATLIHQSITGLYETRIDLSKL- | 1342 |
| WP_049474547 | 1282 | LAS---SFI NLLTFTAIGAP-ATFKFFD--KNI--DRK--R-YTSTTEIL | KATLIHQSITGLYETRIDLSKL- | 1342 |
| EMC03581 | 1275 | LAN---SFI NLLTFTALGAP-AAFKFFG--KDV--DRK--R-YTTVSEIL | NATLIHQSITGLYETRIDLSKL- | 1335 |
| WP_000428612 | 1310 | LAN---SFI NLLTFTALGAP-AAFKFFG--KDV--DRK--R-YTTVSEIL | NATLIHQSITGLYETRIDLSKL- | 1370 |
| WP_000428613 | 1308 | LAN---SFI NLLTFTALGAP-AAFKFFG--KDV--DRK--R-YTTVSEIL | NATLIHQSITGLYETRIDLSKL- | 1368 |
| WP_049523028 | 1303 | IAN---SFI NLLTFTAFGAP-AVFKFFG--KDI--ERK--R-YSTVTEIL | KATLIHQSLTGLYETRIDLSKL- | 1363 |
| WP_003107102 | 1275 | -AT---NML NLFTFTGLGAP-ATLKFFN--VDI--DRK--R-YTSSTEIL | NSTLIRQSITGLYETRIDLSKI- | 1334 |
| WP_054279288 | 1304 | -SI---SFL NLFKFTSFGAP-EKFTFLN--SEIkgDDV--R-YRSTKECL | NSTLIHQSVTGLYETRIDLSQF- | 1365 |
| WP_049531101 | 1311 | LSE---SFI NLLTFTSFGAP-GAFRFLG--VEI--SQSnvR-YQSVSSCF | NATLIHQSITGLYETRIDLSKL- | 1373 |
| WP_049538452 | 1311 | LSE---SFI SLLKLTSFGAP-GAFKFLG--VEI--SQSsvR-YKPNSQFL | DATLIHQSITGLYETRIDLSKL- | 1373 |
| WP_049549711 | 1313 | LSE---SFI SLLKLTSFGAP-GAFKFLG--AEI--SQSsvR-YKPNSQFL | DTTLIHQSITGLYETRIDLSKL- | 1375 |
| WP_007896501 | 1312 | -AL---NML NLFIFTSLGAP-STFVFFD--ETI--DRK--R-YTTSSDVL | NGILIQQSITGLYETRIDLSRF- | 1371 |
| EFR44625 | 1264 | -AL---NML NLFIFTSLGAP-STFVFFD--ETI--DRK--R-YTTSSDVL | NGILIQQSITGLYETRIDLSRF- | 1323 |
| WP_028897477 | 1307 | LAN---SFI NLLTFTALGAP-AAFKFFG--KDV--DRK--R-YTTVSEIL | NATLIHQSITGLYETRIDLSKL- | 1367 |
| WP_002906454 | 1312 | LSE---SFI SLLKLTSFGAP-GARFFLG--VEI--SQSsvR-YKPNSQFL | DTTLIHQSITGLYETRIDLSKL- | 1372 |
| WP_009729476 | 1308 | LAN---SFI NLLTFTALGAP-AAFKFLG--KDV--DRK--R-YTTVSEIL | NATLIHQSITGLYETRIDLSKL- | 1368 |
| CQR24647 | 1296 | LAQ---SFI SLLKPTAFGAP-GGFKFLD--ADI--KQSnlR-YQTVTEVL | SSTLIHQSVTGLYETRIDLSKL- | 1358 |
| WP_000066813 | 1312 | LAN---SFI NLLTFTALGAP-AAFKFLG--SVI--DRK--R-YTSIAEIL | NATLIHQSITGLYETRIDLSKL- | 1368 |
| WP_009754323 | 1308 | LAN---SFI NLLTFTAIGAP-AAFKFLG--SVI--DRK--R-YTSIAEIL | EATLIHQSVTGLYETRIDLSKL- | 1361 |
| WP_044674937 | 1301 | LTS---SFV NLLTFTAIGAP-AAFKFLG--SVI--DRK--R-YTSIAEIL | EATLIHQSVTGLYETRIDLSKL- | 1361 |
| WP_044676715 | 1303 | LTS---SFV NLLTFTAIGAP-AAFKFLG--SVI--DRK--R-YTSIAEIL | EATLIHQSVTGLYETRIDLSKL- | 1363 |
| WP_044680361 | 1301 | LTS---SFV NLLTFTAIGAP-SDFEFLG--VKI--PRY--RGYTPSSLLK | DSTLIHQSITGLYETRIDLSKL- | 1361 |
| WP_044681799 | 1314 | ICT---SFL GLFELTSLGSA-SDFEFLG--VKI--PRY--RGYTPSSLLK | DSTLIHQSITGLYETRIDLSKL- | 1383 |
| WP_049533112 | 1241 | -VK---II ELLKITQANATnGDLKLLK---M-sNREg-R-LGSVSVAL | DFKIINQSVTGLYQSIEDYNN-- | 1300 |
| WP_029090905 | 1269 | -AN---II QMLIVMHRGPQnGNIVYDDf--KI-sDRIg-R-LKTKNHNL | NIVFISQSPTGLYTKKYKL--- | 1329 |
| AIT42264 | 1306 | -AE---NII HLFLTNLGAP-AAFKYFD--TTI--DRK--R-YTSTKEVL | DATLIHQSITGLYETRIDLSQL- | 1365 |
| WP_034440723 | 1277 | -AE---SFI NLLAITKCGPA-ADITFLG--EKI--SRK--R-YRSTNCLW | GSEVIFQSPTGLYETRLRLE-- | 1335 |
| AKQ21048 | 1306 | LVE---SFI HLFLTNLGAP-AAFKFYG--ESI--TRS--R-YTSTKEVL | DATLIHQSITGLYETRYKL--- | 1365 |
| WP_004636532 | 1272 | TVE---SFV NLMFTTAMGAP-ATFKFYG--ESI--TRS--R-YTSITEPR | GSTLIFQSITGLYETRYKL--- | 1329 |
| WP_002364836 | 1278 | IAA---SFI QLMQFNAMGAP-STFKFFQ--KDI--ERA--R-YTSIKEIF | DATIIYQSTTGLYETRRKV--- | 1335 |
| WP_016631044 | 1229 | IAA---SFI QLMQFNAMGAP-STFKFFQ--KDI--ERA--R-YTSIKEIF | DATIIYQSPTGLYETRRKV--- | 1286 |
| EMS75795 | 1014 | LSQ---SFI NLMQLNAMGAP-ADFKFFD--VII--PRK--R-YPSLTEIW | ESTITYQSITGLRETRTRMAILwd | 1076 |
| WP_002373311 | 1278 | IAA---SFI QLMQFNAMGAP-STFKFFQ--KDI--ERA--R-YTSIKEIF | DATIIYQSTTGLYETRRKV--- | 1335 |
| WP_002378009 | 1278 | IAA---SFI QLMQFNAMGAP-STFKFFQ--KDI--ERA--R-YTSIKEIF | DATIIYQSTTGLYETRRKV--- | 1335 |
| WP_002407324 | 1278 | IAA---SFI QLMQFNAMGAP-STFKFFQ--KDI--ERA--R-YTSIKEIF | DATIIYQSTTGLYETRRKV--- | 1335 |
| WP_002413717 | 1278 | IAA---SFI QLMQFNAMGAP-STFKFFQ--KDI--ERA--R-YTSIKEIF | DATIIYQSTTGLYETRRKV--- | 1335 |
| WP_010775580 | 1280 | IAA---SFI QLMQFNAMGAP-STFKFFQ--KDI--ERA--R-YTSIKEIF | DATIIYQSTTGLYETRRKV--- | 1337 |
| WP_010818269 | 1278 | IAA---SFI QLMQFNAMGAP-STFKFFQ--KDI--ERA--R-YTSIKEIF | DATIIYQSTTGLYETRRKV--- | 1335 |
| WP_010824395 | 1278 | IAA---SFI QLMQFNAMGAP-STFKFFQ--KDI--ERA--R-YTSIKEIF | DATIIYQSTTGLYETRRKV--- | 1335 |
| WP_016622645 | 1278 | IAA---SFI QLMQFNAMGAP-STFKFFQ--KDI--ERA--R-YTSIKEIF | DATIIYQSTTGLYETRRKV--- | 1335 |
| WP_033624816 | 1278 | IAA---SFI QLMQFNAMGAP-STFKFFQ--KDI--ERA--R-YTSIKEIF | DATIIYQSTTGLYETRRKV--- | 1335 |
| WP_033625576 | 1278 | IAA---SFI QLMQFNAMGAP-STFKFFQ--KDI--ERA--R-YTSIKEIF | DATIIYQSTTGLYETRRKV--- | 1335 |
| WP_033789179 | 1278 | IAA---SFI QLMQFNAMGAP-STFKFFQ--KDI--ERA--R-YTSIKEIF | DATIIYQSTTGLYETRRKV--- | 1335 |
| WP_002310644 | 1280 | LAS---SFV NLMQFNAMGAP-ADFKFFD--VTI--PRK--R-YTSLTEIW | QSTIIHQSITGLYETRIRMGK- | 1339 |
| WP_002312694 | 1281 | LAS---SFV NLMQFNAMGAP-ADFKFFD--VTI--PRK--R-YTSLTEIW | QSTIIHQSITGLYETRIRMGK- | 1340 |
| WP_002314015 | 1281 | LAS---SFV NLMQFNAMGAP-ADFKFFD--VTI--PRK--R-YTSLTEIW | QSTIIHQSITGLYETRIRMGK- | 1340 |
| WP_002320716 | 1280 | LAS---SFV NLMQFNAMGAP-ADFKFFD--VTI--PRK--R-YTSLTEIW | QSTIIHQSITGLYETRIRMGK- | 1339 |
| WP_002330729 | 1281 | LAS---SFV NLMQFNAMGAP-ADFKFFD--VTI--PRK--R-YTSLTEIW | QSTIIHQSITGLYETRIRMGK- | 1340 |
| WP_002335161 | 1281 | LAS---SFV NLMQFNAMGAP-ADFKFFD--VTI--PRK--R-YTSLTEIW | QSTIIHQSITGLYETRIRMGK- | 1340 |
| WP_002345439 | 1281 | LAS---SFV NLMQFNAMGAP-ADFKFFD--VTI--PRK--R-YTSLTEIW | QSTIIHQSITGLYETRIRMGK- | 1340 |

```
-continued

WP_034867970    1271  IAQ---SFL QLLQFNAIGAP-ADFKFFG--VTI--PRK--R-YTSLTEIW DATIIYQSVTGLYETRIRMGDLwa  1333
WP_047937432    1281  LAS---SFV NLMQPNAMGAP-ADFKFFD--VTI--PRK--R-YTSLTEIW QSTIIHQSITGLYETRIRMGK---  1340
WP_010720994    1271  IAQ---SFL QLLQFNAIGAP-ADFKFFG--VTI--PRK--R-YTSLTEIW DATIIYQSVTGLYETRIRMGDLwa  1333
WP_010737004    1271  IAQ---SFL QLLQFNAIGAP-ADFKFFG--VTI--PRK--R-YTSLTEIW DATIIYQSVTGLYETRIRMGDLwa  1333
WP_034700478    1271  IAQ---SFL QLLQFNAIGAP-ADFKFFG--VTI--PRK--R-YTSLTEIW DATIIYQSVTGLYETRIRMGDLwa  1333
WP_007209003    1270  IAK---SFI NLLIPTAMGAP-ADFEFFG--EKI--PRK--R-YVSISEI  DAVFIHQSITGLYETRVRLTEV-   1330
WP_023519017    1265  MID---AIL SLLKFTLFGAS-VEFKFFD--IKI--LK--R-YKSLTDIW EATIIYQSVTGLYERRVEVRKLwd  1326
WP_010770040    1275  IAE---SFV NLMKFSAYGAP-MDFKFFG--KTI--PRS--R-YTSVGELL SATIINQSITGLYETRRKL----   1332
WP_048604708    1271  IAQ---SFV DLMQLNAFGAP-ADFKFFD--ETI--PRK--R-YTSVNELL EATIINQSITGLYETRRRL----   1328
WP_010750235    1274  MAH---SFV NLMQPNALGAP-ADFKFFD--TTI--TRK--R-YISLTEIW QSTIIYQSVTGLYETRRRMADLwd  1336
AII16583        1345  -AE---NII HLFTLINLGAP-AAFKYFD--TTI--DRK--R-YISTKEVL DATLIHQSPIGMYSKKYKL---   1404
WP_029073316    1283  -CE---VI  QMLVVMHAGPQnGNITFDDE--KL-sNRIg-R-LNCKTISL TIVFIADSPIGMYSKKYKL---   1343
WP_031589969    1284  -CN---II  QILATLHCNSSiGKIMYSDf--KI-sTTIg-R-LNGRTISL DISFIAESPTGMYSKKYKL---   1344
KDA45870        1254  LGK---NFV ELLRYTADGAA-SDFKFFG--ENI--PRK--R-YNSAGSLL NGTLIYQSKTGLYETRIDLGKL-   1314
WP_039099354    1307  ILDr--V   -LIGLHANAAV-SDLGVLKisTPL-GKM--Q---QPSGIS  DTQIIYQSPTGLFERRVALRDL-   1368
AKP02966        1297  INS1-eELi ILLHANSTSAH-LIFNNIE-kKAF-GRK-----THGLT    DTDFIYQSVTGLYETRIHIE--   1356
WP_010991369    1275  IAQ---SFV DLMAFNAMGAP-ASFKFFE--TTI--ERK--R-YNNLKELL NSTIIYQSITGLYESRKRL---   1332
WP_033838504    1275  IAQ---SFV DLMAFNAMGAP-ASFKFFE--TTI--ERK--R-YNNLKELL NSTIIYQSITGLYESRKRL---   1332
EHN60060        1278  IAQ---SFV DLMAFNAMGAP-ASFKFFE--TTI--ERK--R-YNNLKELL NSTIIYQSITGLYESRKRL---   1335
EFR89594        1044  IAK---SFD KLKVFNAFGAP-RDFEFFE--TTI--KRK--R-YYNIKELL NATIIYQSITGLYEARKRL---   1101
WP_038409211    894   IAK---SFD KLKVFNAFGAP-RDFKFFE--TTI--KRK--R-YYNIKELL NATIIYQSITGLYEARKRL---   951
EFR95520        1275  IAQ---SFV DLMAFNAMGAP-ASFKFFE--ATI--DRK--R-YTNLKELL SSTIIYQSITGLYESRKRL---   1332
WP_003723650    1275  IAQ---SFV DLMAFNAMGAP-ASFKFFE--ATI--DRK--R-YTNLKELL SSTIIYQSITGLYESRKRL---   1332
WP_003727705    1275  IAQ---SFV DLMAFNAMGAP-ASFKFFE--ATI--DRK--R-YTNLKELL SSTIIYQSITGLYESRKRL---   1332
WP_003730785    1275  IAE---SFV SLKKFNAFGVH-QDFSFFG--TKI--ERK--R-YTNLKELL NSTIIYQSITGLYESRKRL---   1332
WP_003733029    1275  IAE---SFV SLKKFNAFGVH-QDFSFFG--TKI--ERK--R-YTNLKELL SATIIYQSITGLYEARKRL---   1332
WP_003739838    1275  IAQ---SFV NLMAFNAMGAP-ASFKFFE--ATI--ERK--R-YTNLKELL SSTIIYQSITGLYESRKRL---   1332
WP_014601172    1275  IAQ---SFV DLMAFNAMGAP-ASFKFFE--TTI--KRK--R-YTNLKELL NSTIIYQSITGLYESRKRL---   1332
WP_023548323    1275  IAE---SFV SLKKFNAFGVH-KDFNFFG--TTI--KRK--R-DRKLKELL NSTIIYQSITGLYESRKRL---   1332
WP_031665337    1275  IAE---SFV DLMAFNAMGAP-ASFKFFE--ATI--DRK--R-YTNLKELL SSTIIYQSITGLYESRKRL---   1332
WP_031669209    1275  IAE---SFV SLKKFNAFGVH-QDFSFFG--TKI--ERK--R-DRKLKELL NSTIIYQSITGLYESRKRL---   1332
WP_033920898    1275  IAE---SFV SLKKFNAFGVH-KDFNFFG--TTI--DRK--R-YTNLKELL NSTIIYQSITGLYESRKRL---   1332
AKI42028        1278  IAE---SFV DLMAFNAMGAP-ASFKFFE--ATI--DRK--R-DRKLKELL SSTIIYQSITGLYESRKRL---   1335
AKI50529        1278  IAQ---SFV DLMVFNAMGAP-ASFKFFE--ATI--DRK--R-YTNLKELL NSTIIYQSITGLYESRKRL---   1335
EFR83390        723   IAQ---SFV NLLEFNAMGAP-ASFKYFE--TNI--ERK--R-YNNLKELL NATIIYQSITGLYEARKRL---   780
WP_046322366    1275  -AE---NII HLFTLTNLGAP-AAFKYFD--TTI--ERK--R-YTSTKEVL DATLIHQSITGLYETRIDLSQL-   1332
AKE81011        1322  -AN---VI  QMLIIMHKGPQnGNIIYDDE--NV-gKRIg-R-LNGRTFYL NIEFISQSPIGIYIKKYKL---   1381
CUO82355        1273  -CD---VI  QILIIMHAGPMnGNIMYDDE--KF-tNRIg-R-FTHKNIDL KTTFISTSVTGLFSKKYKL---   1333
WP_033162887    1275  -AE---NII HLFTLTNLGAP-AAFKYFD--TTI--DRK--R-YTSTKEVL DATLIHQSITGLYETRIDLSQL-   1335
AGZ01981        1339  -AE---NII HLFTLTNLGAP-AAFKYFD--TTI--DRK--R-YTSTKEVL DATLIHQSITGLYETRIDLSQL-   1398
AKA60242        1306  -AE---NII HLFTLTNLGAP-AAFKYFD--TTI--DRK--R-YTSTKEVL DATLIHQSITGLYETRIDLSQL-   1365
AKS40380        1306  -AE---NII HLFTLTNLGAP-AAFKYFD--TTI--DRK--R-YTSTKEVL DATLIHQSITGLYETRIDLSQL-   1365
4UN5_B          1310  -AE---NII HLFTLTNLGAP-AAFKYFD--TTI--DRK--R-YTSTKEVL DATLIHQSITGLYETRIDLSQL-   1369
WP_010922251    1366  GGD                                                                          1368
WP_039695303    1370  GEE                                                                          1372
WP_045635197    1368  GED                                                                          1370
5AXW_A                ---                                                                            
WP_099880683    1050  GGD                                                                          1052
WP_010922251    1366  GGD                                                                          1368
WP_011054416    1366  GGD                                                                          1368
WP_011284745    1366  GGD                                                                          1368
WP_011285506    1366  GGD                                                                          1368
WP_011527619    1366  GGD                                                                          1368
```

-continued

| | | |
|---|---|---|
| WP_012560673 | 1366 GGD | 1368 |
| WP_014407541 | 1365 GGD | 1367 |
| WP_020905136 | 1366 GGD | 1368 |
| WP_023080005 | 1365 GGD | 1367 |
| WP_023610282 | 1365 GGD | 1367 |
| WP_030125963 | 1366 GGD | 1368 |
| WP_030126706 | 1366 GGD | 1368 |
| WP_031468318 | 1366 GGD | 1368 |
| WP_032460140 | 1366 GGD | 1368 |
| WP_032461047 | 1366 GGD | 1368 |
| WP_032462016 | 1366 GGD | 1368 |
| WP_032462936 | 1366 GGD | 1368 |
| WP_032464890 | 1366 GGD | 1368 |
| WP_033888930 | 1191 GGD | 1193 |
| WP_038431314 | 1366 GGD | 1368 |
| WP_038432938 | 1365 GGD | 1367 |
| WP_038434062 | 1366 GGD | 1368 |
| BAQ51233 | 1277 GGD | 1279 |
| KGE60162 | 541 GGD | 543 |
| KGE60856 | 304 GGD | 306 |
| WP_002989955 | 1366 GED | 1368 |
| WP_003030002 | 1343 GEE | 1345 |
| WP_003065552 | 1371 GED | 1373 |
| WP_001040076 | 1376 GED | 1378 |
| WP_001040078 | 1368 GED | 1370 |
| WP_001040080 | 1368 GED | 1370 |
| WP_001040081 | 1368 GED | 1370 |
| WP_001040083 | 1368 GED | 1370 |
| WP_001040085 | 1368 GED | 1370 |
| WP_001040087 | 1368 GGD | 1370 |
| WP_001040088 | 1368 GED | 1370 |
| WP_001040089 | 1368 GED | 1370 |
| WP_001040090 | 1368 GED | 1370 |
| WP_001040091 | 1368 GED | 1370 |
| WP_001040092 | 1368 GED | 1370 |
| WP_001040094 | 1368 GED | 1370 |
| WP_001040095 | 1368 GEG | 1370 |
| WP_001040096 | 1368 GEG | 1370 |
| WP_001040097 | 1368 GED | 1370 |
| WP_001040098 | 1368 GED | 1370 |
| WP_001040099 | 1368 GED | 1370 |
| WP_001040100 | 1368 GED | 1370 |
| WP_001040104 | 1368 GED | 1370 |
| WP_001040105 | 1368 GED | 1370 |
| WP_001040106 | 1368 GED | 1370 |
| WP_001040107 | 1368 GED | 1370 |
| WP_001040108 | 1368 GED | 1370 |
| WP_001040109 | 1368 GED | 1370 |
| WP_001040110 | 1368 GED | 1370 |
| WP_015058523 | 1368 GED | 1370 |
| WP_017643650 | 1368 GED | 1370 |
| WP_017647151 | 1368 GED | 1370 |
| WP_017648376 | 1368 GED | 1370 |

| | | |
|---|---|---|
| WP_017649527 | 1368 | GED | 1370 |
| WP_017771611 | 1368 | GED | 1370 |
| WP_017771984 | 1368 | GED | 1370 |
| CFQ25032 | 1368 | GED | 1370 |
| CFV16040 | 1368 | GED | 1370 |
| KLJ37842 | 1368 | GGD | 1370 |
| KLJ72361 | 1368 | GED | 1370 |
| KLL20707 | 1382 | GED | 1384 |
| KLL42645 | 1368 | GED | 1370 |
| WP_047207273 | 1368 | GED | 1370 |
| WP_047209694 | 1368 | GED | 1370 |
| WP_050198062 | 1368 | GED | 1370 |
| WP_050201642 | 1368 | GED | 1370 |
| WP_050204027 | 1368 | GED | 1370 |
| WP_050881965 | 1368 | GED | 1370 |
| WP_050886065 | 1368 | GED | 1370 |
| AHN30376 | 1368 | GED | 1370 |
| EAO78426 | 1368 | GED | 1370 |
| CCW42055 | 1384 | GED | 1386 |
| WP_003041502 | 1344 | GED | 1346 |
| WP_037593752 | 1344 | GED | 1346 |
| WP_049516684 | 1343 | GED | 1345 |
| GAD46167 | 1375 | GEE | 1377 |
| WP_018363470 | 1373 | GGD | 1375 |
| WP_003043819 | 1343 | GED | 1345 |
| WP_006269658 | 1363 | GED | 1365 |
| WP_048800889 | 1369 | GED | 1371 |
| WP_012767106 | 1369 | GGD | 1371 |
| WP_014612333 | 1369 | GGD | 1371 |
| WP_015017095 | 1369 | GGD | 1371 |
| WP_015057649 | 1369 | GGD | 1371 |
| WP_048327215 | 1346 | GEN | 1348 |
| WP_049519324 | 1346 | GEN | 1348 |
| WP_012515931 | 1346 | GEN | 1348 |
| WP_021320964 | 1375 | GEE | 1377 |
| WP_037581760 | 1368 | GED | 1370 |
| WP_004232481 | 1369 | GEE | 1371 |
| WP_009854540 | 1370 | GEE | 1372 |
| WP_012962174 | 1373 | GEE | 1375 |
| WP_039695303 | 1366 | GGK | 1368 |
| WP_014334983 | | --- | |
| WP_003099269 | 198 | GGK | 200 |
| AHY15608 | | --- | |
| AHY17476 | | | |
| ESR09100 | 1343 | GGD | 1345 |
| AGM98575 | 1351 | GEN | 1353 |
| ALF27331 | 1374 | GED | 1376 |
| WP_018372492 | 1368 | GED | 1370 |
| WP_045618028 | 1343 | GGD | 1345 |
| WP_045635197 | 1343 | GGD | 1345 |
| WP_002263549 | 1343 | GGD | 1345 |
| WP_002263887 | | | |
| WP_002264920 | | | |

-continued

| | | | |
|---|---|---|---|
| WP_002269043 | 1343 | GGD | 1345 |
| WP_002269448 | 1343 | GGD | 1345 |
| WP_002271977 | 1343 | GGD | 1345 |
| WP_002272766 | 1343 | GGD | 1345 |
| WP_002273241 | 1343 | GGD | 1345 |
| WP_002275430 | 1343 | GGD | 1345 |
| WP_002276448 | 1343 | GGD | 1345 |
| WP_002277050 | 1353 | GGD | 1355 |
| WP_002277364 | 1343 | GGD | 1345 |
| WP_002279025 | 1343 | GGD | 1345 |
| WP_002279859 | 1343 | GGD | 1345 |
| WP_002280230 | 1343 | GGD | 1345 |
| WP_002281696 | 1343 | GGD | 1345 |
| WP_002282247 | 1353 | GGD | 1355 |
| WP_002282906 | 1343 | GGD | 1345 |
| WP_002283846 | 1343 | GGD | 1345 |
| WP_002287255 | 1343 | GGD | 1345 |
| WP_002288990 | 1343 | GGD | 1345 |
| WP_002289641 | 1343 | GGD | 1345 |
| WP_002290427 | 1343 | GGD | 1345 |
| WP_002295753 | 1343 | GGD | 1345 |
| WP_002296423 | 1343 | GGD | 1345 |
| WP_002304487 | 1357 | GGD | 1359 |
| WP_002305844 | 1343 | GGD | 1345 |
| WP_002307203 | 1343 | GGD | 1345 |
| WP_002310390 | 1343 | GGD | 1345 |
| WP_003152408 | 1343 | GGD | 1345 |
| WP_012997688 | 1343 | GGD | 1345 |
| WP_014677909 | 1343 | GGD | 1345 |
| WP_019312892 | 1343 | GGD | 1345 |
| WP_019313659 | 1343 | GGD | 1345 |
| WP_019314093 | 1343 | GGD | 1345 |
| WP_019315370 | 1343 | GGD | 1345 |
| WP_019803776 | 1343 | GGD | 1345 |
| WP_019805234 | 1343 | GGD | 1345 |
| WP_024783594 | 1343 | GGD | 1345 |
| WP_024784288 | 1353 | GGD | 1355 |
| WP_024784666 | 1343 | GGD | 1345 |
| WP_024784894 | 1343 | GGD | 1345 |
| WP_024786433 | 1353 | GGD | 1355 |
| WP_049473442 | 1343 | GGD | 1345 |
| WP_049474547 | 1343 | GGD | 1345 |
| EMC03581 | 1336 | GED | 1338 |
| WP_000428612 | 1371 | GED | 1373 |
| WP_000428613 | 1369 | GED | 1371 |
| WP_049523028 | 1364 | GEE | 1366 |
| WP_003107102 | 1335 | GGD | 1337 |
| WP_054279288 | 1366 | GGD | 1368 |
| WP_049531101 | 1374 | GED | 1376 |
| WP_049538452 | 1374 | GED | 1376 |
| WP_049549711 | 1376 | GED | 1378 |
| WP_007896501 | 1372 | GGD | 1374 |
| EFR44625 | 1324 | GGD | 1326 |

-continued

| | | |
|---|---|---|
| WP_002897477 | 1368 | GEE | 1370 |
| WP_002906454 | 1375 | GED | 1377 |
| WP_009729476 | 1369 | GED | 1371 |
| CQR24647 | 1359 | GGE | 1361 |
| WP_000066813 | 1373 | GED | 1375 |
| WP_009754323 | 1369 | GED | 1371 |
| WP_044674937 | 1362 | GED | 1364 |
| WP_044676715 | 1364 | GGD | 1366 |
| WP_044680361 | 1364 | GGD | 1366 |
| WP_044681799 | 1362 | GGD | 1364 |
| WP_049533112 | 1384 | GED | 1386 |
| WP_029090905 | | --- | |
| WP_006506696 | | --- | |
| AIT42264 | 1366 | GGD | 1389 |
| WP_034440723 | | --- | |
| AKQ21048 | 1366 | GGD | 1384 |
| WP_004636532 | 1330 | -ED | 1332 |
| WP_002364836 | 1336 | -VD | 1337 |
| WP_016631044 | 1287 | -VD | 1288 |
| EMS75795 | 1077 | GEQ | 1079 |
| WP_002373311 | 1336 | -VD | 1337 |
| WP_002378009 | 1336 | -VD | 1337 |
| WP_002407324 | 1336 | -VD | 1337 |
| WP_002413717 | 1338 | -VD | 1339 |
| WP_010775580 | 1336 | -VD | 1337 |
| WP_010818269 | 1336 | -VD | 1337 |
| WP_010824395 | 1336 | -VD | 1337 |
| WP_016622645 | 1336 | -VD | 1337 |
| WP_033624816 | 1336 | -VD | 1337 |
| WP_033625576 | 1336 | -VD | 1337 |
| WP_033789179 | 1336 | -VD | 1337 |
| WP_002310644 | | --- | |
| WP_002312694 | | --- | |
| WP_002314015 | | --- | |
| WP_002320716 | | --- | |
| WP_002330729 | | --- | |
| WP_002335161 | | --- | |
| WP_002345439 | | --- | |
| WP_034867970 | 1334 | GEQ | 1336 |
| WP_047937432 | | --- | |
| WP_010720994 | 1334 | GEQ | 1336 |
| WP_010737004 | 1334 | GEQ | 1336 |
| WP_034700478 | 1334 | GEQ | 1336 |
| WP_007209003 | | --- | |
| WP_023519017 | 1327 | GER | 1330 |
| WP_010770040 | 1333 | -VD | 1334 |
| WP_048604708 | 1329 | -GD | 1330 |
| WP_010750235 | 1337 | GVQ | 1339 |
| AII16583 | 1405 | GGD | 1424 |
| WP_029073316 | | --- | |
| WP_031589969 | | --- | |
| KDA45870 | | --- | |
| WP_039099354 | | --- | |

-continued

| | | |
|---|---|---|
| AKP02966 | --- | --- |
| WP_010991369 | 1333 | -DD | 1334 |
| WP_033838504 | 1333 | -DD | 1334 |
| EHN60060 | 1336 | -DD | 1337 |
| EFR89594 | 1102 | -DD | 1103 |
| WP_038409211 | 1333 | -ED | 1334 |
| EFR95520 | 952 | -ED | 953 |
| WP_003723650 | 1333 | -DD | 1334 |
| WP_003727705 | 1333 | -DD | 1334 |
| WP_003730785 | 1333 | -DD | 1334 |
| WP_003733029 | 1333 | -DN | 1334 |
| WP_003739838 | 1333 | -DG | 1334 |
| WP_014601172 | 1333 | -DD | 1334 |
| WP_023548323 | 1333 | -DS | 1334 |
| WP_031665337 | 1333 | -DD | 1334 |
| WP_031669209 | 1333 | -DN | 1334 |
| WP_033920898 | 1333 | -DS | 1334 |
| AKI42028 | 1336 | -DD | 1337 |
| AKI50529 | 1336 | -DS | 1337 |
| EFR83390 | 781 | -DD | 782 |
| WP_046323366 | 1333 | -DD | 1334 |
| AKE81011 | 1382 | GGD | 1400 |
| CUO82355 | --- | --- |
| WP_033162887 | | |
| AGZ01981 | 1399 | GGD | 1417 |
| AKA60242 | 1366 | GGD | 1368 |
| AKS40380 | 1366 | GGD | 1376 |
| 4UN5_B | 1370 | GGD | 1372 |

Additional suitable Cas9 sequences in which amino acid residues homologous to residues 10, 122, 137, 182, 262, 294, 409, 480, 543, 660, 694, 840, 1219, and/or 1329 of SEQ ID NO: 9 can be identified are known to those of skill in the art. See, e.g., Supplementary Table S2 and Supplementary Figure S2 of Fonfara et al., Phylogeny of Cas9 determines functional exchangeability of dual-RNA and Cas9 among orthologous type II CRISPR-Cas systems, *Nucl. Acids Res.* 2013, doi: 10.1093/nar/gkt1074, which are incorporated herein by reference in their entirety. Cas9 variants of the sequences provided herein or known in the art comprising one or more mutations, e.g., at least one, at least two, at least three, at least four, at least five, at least six, or at least seven mutations as provided herein, e.g., of one or more amino acid residue that is homologous to amino acid residue 10, 122, 137, 182, 262, 294, 409, 480, 543, 660, 694, 840, 1219, and/or 1329 in SEQ ID NO: 9 are provided by this disclosure, for example, Cas9 variants comprising a A262T, K294R, S409I, E480K, E543D, M694I, and/or E1219V mutation.

Example 4: Evolution of Cas9 with Broadened PAM Specificities

By evolving *S. pyogenes* Cas9 on a NNN PAM library using PACE, Cas9s with broadened PAM specificities have been evolved with higher activities for many non-canonical PAMs. Such a Cas9 still retains its native DNA binding and cutting activity and can be utilized with all of the current tools available. It has been hypothesized that by modulating Cas9's interactions with the DNA, the PAM specificity of Cas9 can be modified and expanded. Other Cas9s such as *Staphylococcus aureus* could also be engineered to change and expand their PAM specificity by such a method. Methods to modulate DNA binding such as targeted mutagenesis of the Cas9 protein, fusions to DNA-binding proteins, and the use of multiple Cas9 proteins tethered to each other could also expand the PAMs that can be targeted.

Cas9 Evolution. After evolution using overnight propagation of the phage with the mutagenesis plasmid (MP), the resultant phages containing mutations, discussed above, in PACE were used. Twenty-four individual phages were sequenced from the PACE run. Mutations found in the Cas9 gene are documented in Table 3 below. The Cas9 gene containing these mutations was cloned out of the phage and into plasmids to test both DNA binding and cutting activity.

TABLE 3

| | Cas9 mutations | | | | | | | | | | | |
|---|---|---|---|---|---|---|---|---|---|---|---|---|
| pJH306 (WT dCas9- VPR) | | | | | | | | | | | | |
| pJH407 (WT Cas9) | | | | | | | | | | | | |
| pJH562 (dCas9-VPR) | | | | | | E480K | E543D | | E1219V | | | |
| pJH599 (dCas9-VPR) | A262T | | | | S409I | E480K | E543D | M694I | E1219V | | | |
| pJH600 (dCas9-VPR) | | | K294R | | | E480K | E543D | | E1219V | | Q1256K | L1362P |
| pJH601 (dCas9-VPR) | A262T | | | | S409I | E480K | E543D | M694I | E1219V | | | |
| pJH602 (dCas9-VPR) | | | K294R | | | E480K | E543D | | E1219V | | Q1256K | |
| pJH603 (dCas9-VPR) | A262T | | | | S409I | E480K | E543D | M694I | E1219V | | | |
| pJH604 (dCas9-VPR) | | S267G | K294R | | | E480K | E543D | | E1219V | N1224K | Q1256K | |
| pJH605 (dCas9-VPR) | A262T | | | F405I | S409I | E480K | E543D | M694I | E1219V | | | |
| pJH760 (pJH599 Minus VPR, Nuclease Positive) | A262T | | | | S409I | E480K | E543D | M694I | E1219V | | | |

Figure 5A:
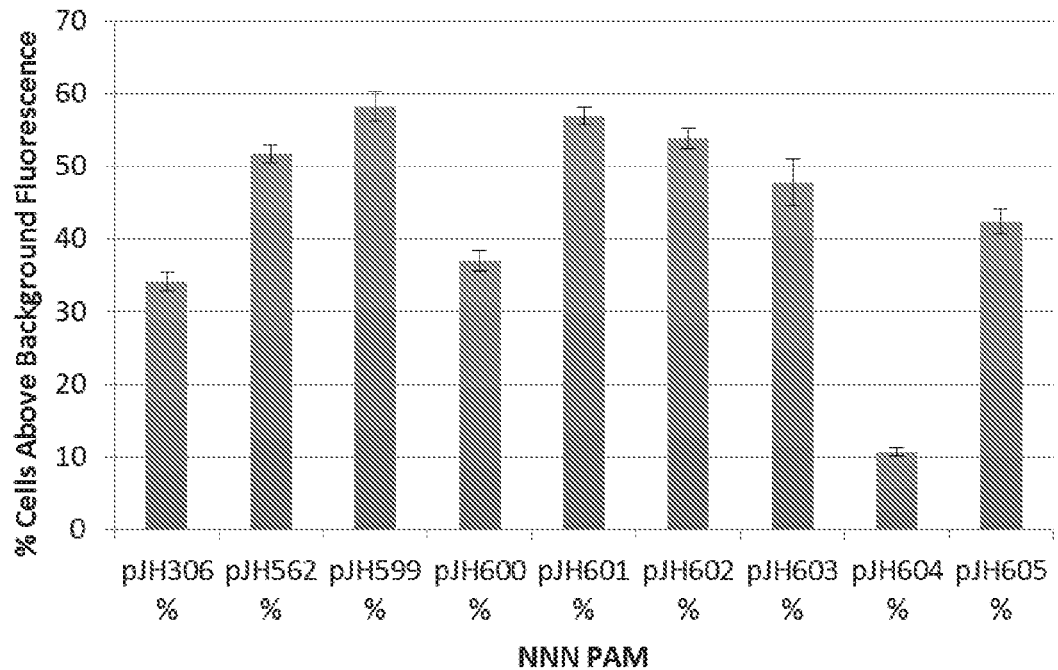
FIGS. 5A to 5B show the binding activity of wild type dCas9-VPR (pJH306) and evolved dCas9-VPR proteins with an NNN PAM sequence using GFP as a readout. On a library of NNN PAMs, many of the evolved Cas9 proteins showed increased Cas9 binding activity relative to wild-type Cas9 based on an increase in GFP fluorescence signal.
Figure 5B:
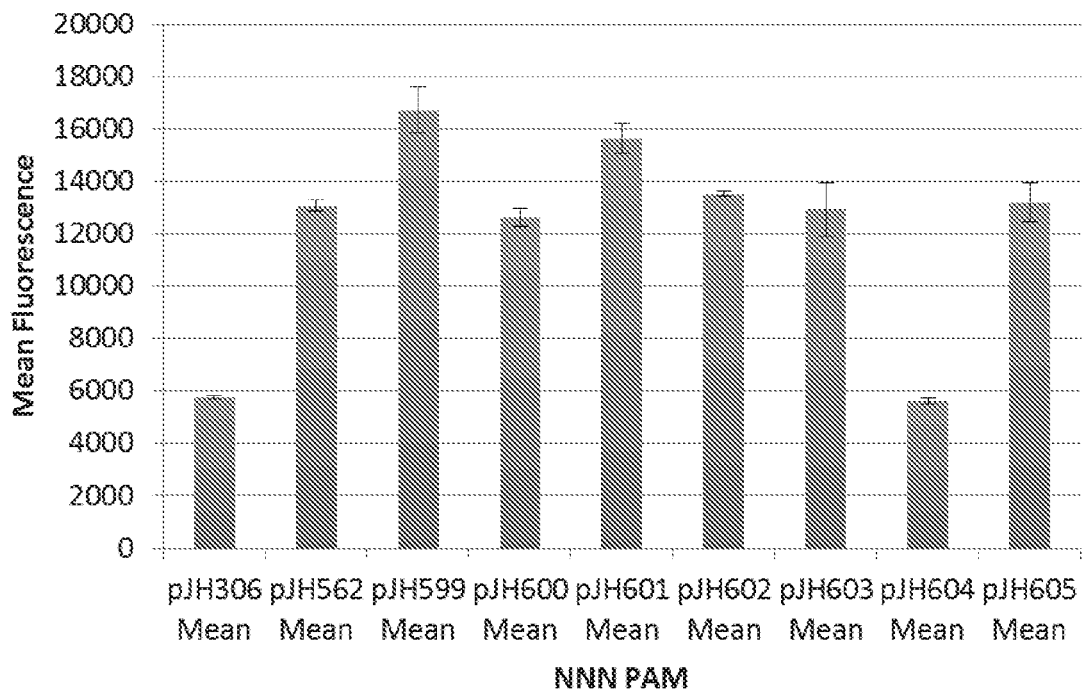
Figure 6:
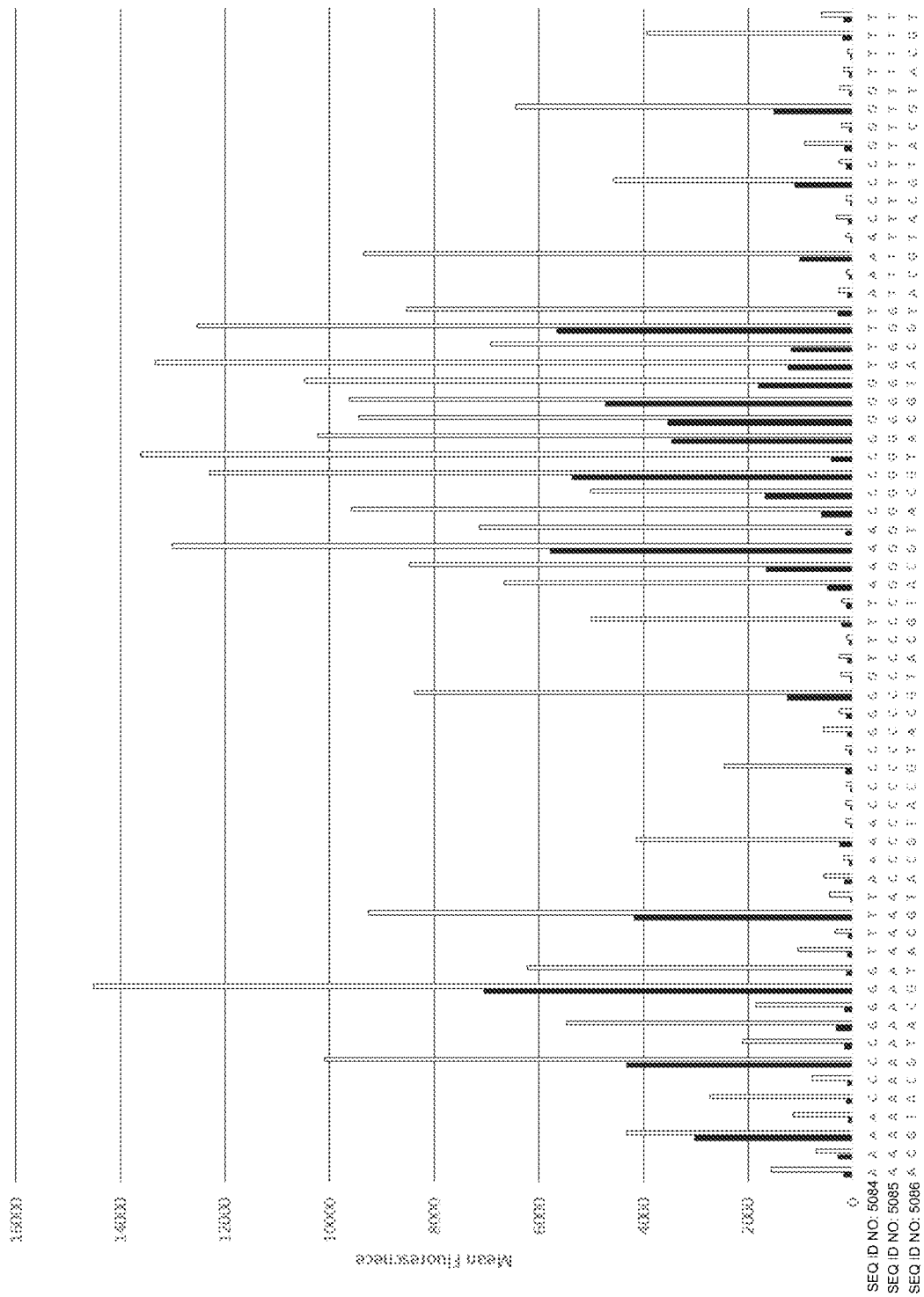
FIG. 6 shows dCas9-VPR on all 64 PAM sequences as demonstrated by mean fluorescence on transfected cells gated by iRFP fluorescence. WT dCas9-VPR is pJH306.

GFP Activation in Human Cell Culture. Testing was performed on a reporter with a GFP reporter activated by dCas9-VPR. Testing was performed on 5'-NGG-3' PAM first (FIGS. 4A and 4B) and then with a library of GFP reporters all containing the same Cas9 target site, but with NNN at the PAM position (FIGS. 5A and 5B). In this testing, dCas9-VPR was found to activate the GFP signal. Wild-type Cas9 with no mutations (pJH306), Cas9 evolved from overnight propagation (pJH562), and Cas9 evolved from PACE (pJH599-pJH605) were all tested. Mutations for each Cas9 are documented in Table 3 above.

dCas9-VPR on all 64 PAM Sequences. pJH306 (WT dCas9-VPR) and pJH599 (WT dCas9-VPR with mutations A262T, S409I, E480K, E543D, M694I, and E1219V) were tested on all 64 PAM sequences (FIG. 6). dCas9-VPR was used to activate GFP as before and a different reporter plasmid was used for each well to ascertain the activation efficiency for all 64 different PAM sequences. The mean GFP fluorescence was measured for all transfected cells, as gated by iRFP signal. pJH599 showed either improved or similar levels of activation as compared to pJH306 for all PAM sequences.

Figure 7:
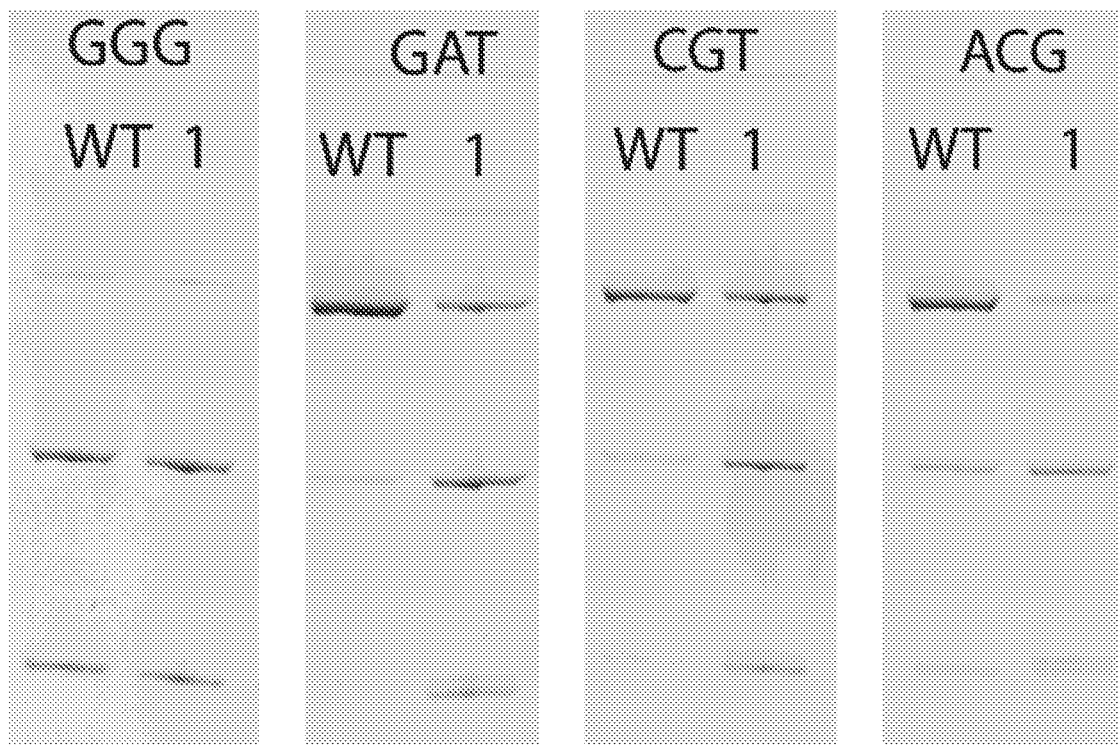
FIG. 7 shows in vitro cutting assay. On the gel, WT is wild-type Cas9 (SEQ ID NO: 9), and 1 is Cas9 (SEQ ID NO: 9) with the E1219V mutation.

In Vitro Cutting Assay. The ability of expressed and purified WT Cas9 (WT) and Cas 9 with an E1219V mutation (1) to cut DNA with different PAMs was tested (FIG. 7). Cas9 was incubated with dsDNA containing the target site. Cutting was measured by running the DNA on a gel to compare the amount of uncut product to the amount of cut products, which run faster due to their smaller size. The E1219V mutation was found to increase Cas9 cutting activity on non-canonical PAMs while maintaining activity on 5'-NGG-3' PAMs.

Evolving Different Systems. In addition to *S. pyogenes* Cas9 evolution, other Cas9 systems such as *S. aureus, S. thermophilus, N. meningitidis*, and *T. denticola*, etc. can be evolved to modify and expand their PAM specificities. The data indicates that, by using a similar system to the *S. pyogenes* Cas9 evolution, a phage containing the *S. aureus* Cas9 can also be evolved to expand its PAM specificity.

Modulating PAM Specificity. By mutating neutral and negatively charged amino acids to positively charged amino acids, Cas9 could be modified to expand the PAMs that can be targeted. Generally, incorporating mutations into Cas9 proteins that generate a net increase in positive charge may increase the affinity of Cas9 to bind DNA. In combination with the Cas9 mutations provided herein, additional residues that could be mutated for increased PAM targeting in *S. pyogenes* Cas9 further include ones that have been identified to change the PAM specificity (D1135, G1218, R1333, R1335, T1337)[38] and residues that can increase Cas9 activity (S845 and L847) 37. Residues that increase Cas9 specificity such as the mutations of arginine, histidine, and lysine to alanine previously identified[37] and the mutations of asparagine, arginine, and glutamine to alanine as previously identified[39] could lead to lower tolerability for non-canonical PAMs as these mutations presumably decrease the interactions between the Cas9 and DNA.

Fusions to Modulate PAM Specificity. Programmable DNA-binding proteins such as zinc-finger domains, TALEs, and other Cas9 proteins could be fused to Cas9 to improve the ability to target nucleotide sequences having canonical or non-canonical PAMs, for example to increase activity, specificity or efficiency. A nuclease-null dCas9 could be fused to a nuclease active Cas9 to increase the ability of the nuclease active Cas9 to target different PAM sequences. One example of a nuclease-null dCas9 fused to a nuclease active Cas9 is shown in FIG. 8. Such fusions can be useful for improving the ability to target nucleotide sequences having canonical or non-canonical PAMs. The Cas9s could either be from the same species or from different species. Furthermore, both Cas9s could be nuclease-null dCas9, and could be further fused to effector proteins such as VP64, VP64-p65-Rta, FokI, GFP and other fluorescent proteins, deaminases, or any of the effector proteins provided herein.

Figure 9A:
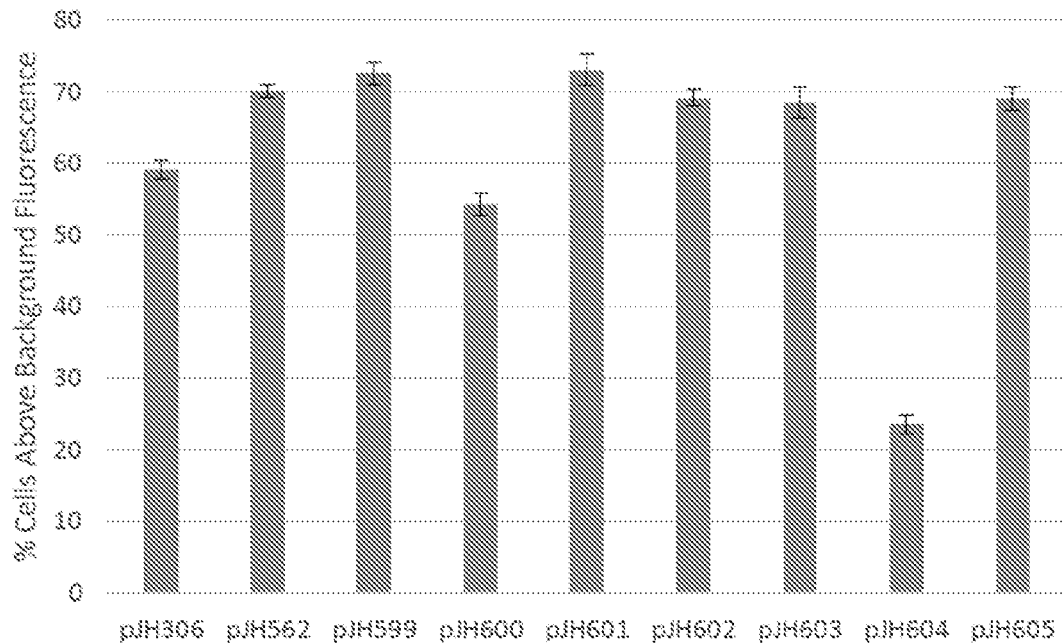
FIGS. 9A to 9B show dCas9-VPR binding activity on the NNNNN PAM Library.
Figure 9B:
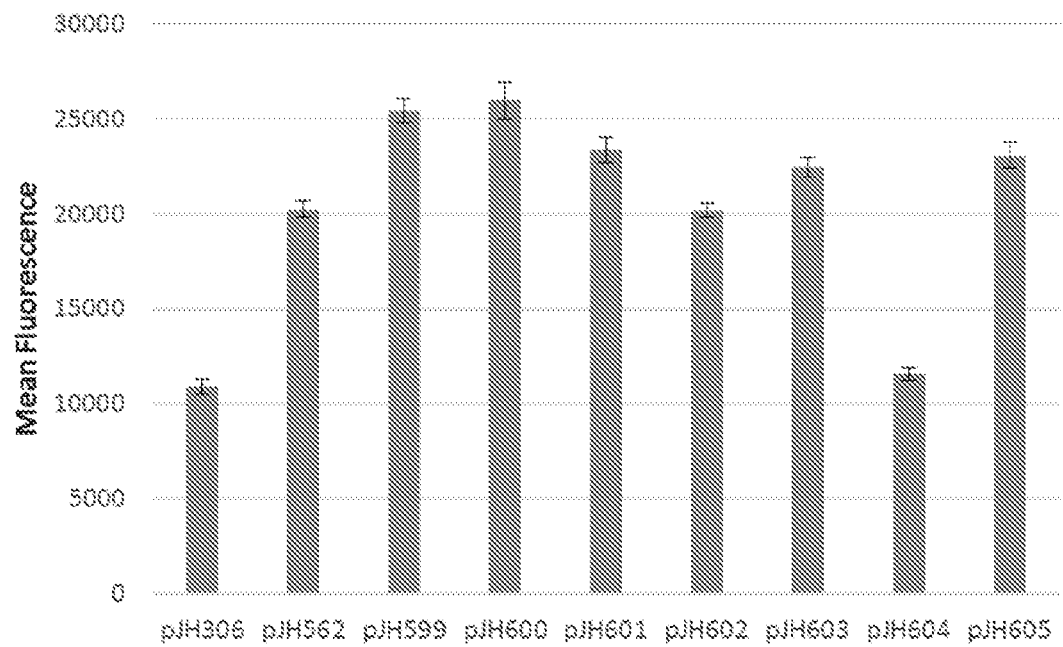

Using Cas9 to Localize Other Nucleases and Other DNA-Binding Proteins. Cas9 can also be used to overcome the native binding specificity of other proteins by localizing them to their DNA targets. DNA nucleases, recombinases, deaminases, and other effectors often have a native DNA specificity. Cas9 can be fused to these proteins to overcome and expand their native DNA specificities. gRNAs will target the Cas9 adjacent to the DNA effector's target site and will help to localize them to their target site.

dCas9-VPR on NNNNN PAM Library. To test that the evolved Cas9s had not picked up specificity in the 4th and 5th PAM positions, dCas9-VPR on a NNNNN PAM library was tested. As seen with the NNN library, most of the constructs (e.g., pJH562, pJ559, pJH600, pJH601, pJH602, pJH603, and pJH605) showed improved activity. pJH599 consistently showed improvement in both the percentage of cells that showed GFP activation (FIG. 9A) and the mean fluorescence of those cells that showed GFP activation (FIG. 9B).

Figure 10:
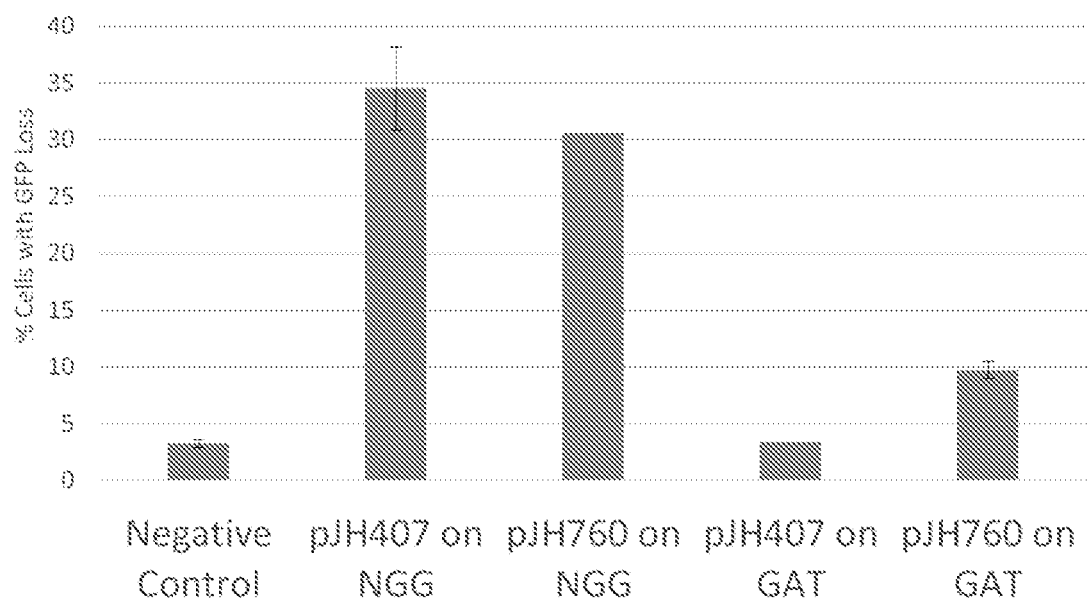
FIG. 10 shows Cas9 cutting activity using % of cells with GFP loss as a readout. Cas9 proteins were tested with two sgRNAs, which either targeted the canonical 5'-NGG-3' PAM or a GAT PAM within a GFP gene.

Cas9 GFP Cutting. The WT Cas9, pJH407, was compared with a nuclease-positive evolved Cas9, pJH760 (FIG. 10). pJH760 contained the same mutations as pJH599 but without the D10A and H480A nuclease-inactivating mutations, and without the VPR fusion. A genomically integrated GFP gene was cut by Cas9 and the activity was measured by the loss of GFP signal in cells. On a site with 5'-NGG-3' PAM, pJH407 and pJH760 showed comparable activity. On a site with GAT PAM, pJH760 showed a significant increase in activity as compared to pJH407.

Example 5 Cas9:DNA Editing Enzyme Fusion Proteins

This disclosure further provides Cas9 fused with a DNA editing enzyme for the targeted editing of DNA sequences. FIG. 11 illustrates double stranded DNA substrate binding by DNA editing enzyme-dCas9:sgRNA complexes. The DNA editing enzyme shown is a deaminase. The structures according to FIG. 11 are identified in these sequences (36 bp: underlined, sgRNA target sequence: bold; PAM: boxed; 21 bp: italicized).

Example 6 PAM Depletion Assay

Figure 12:
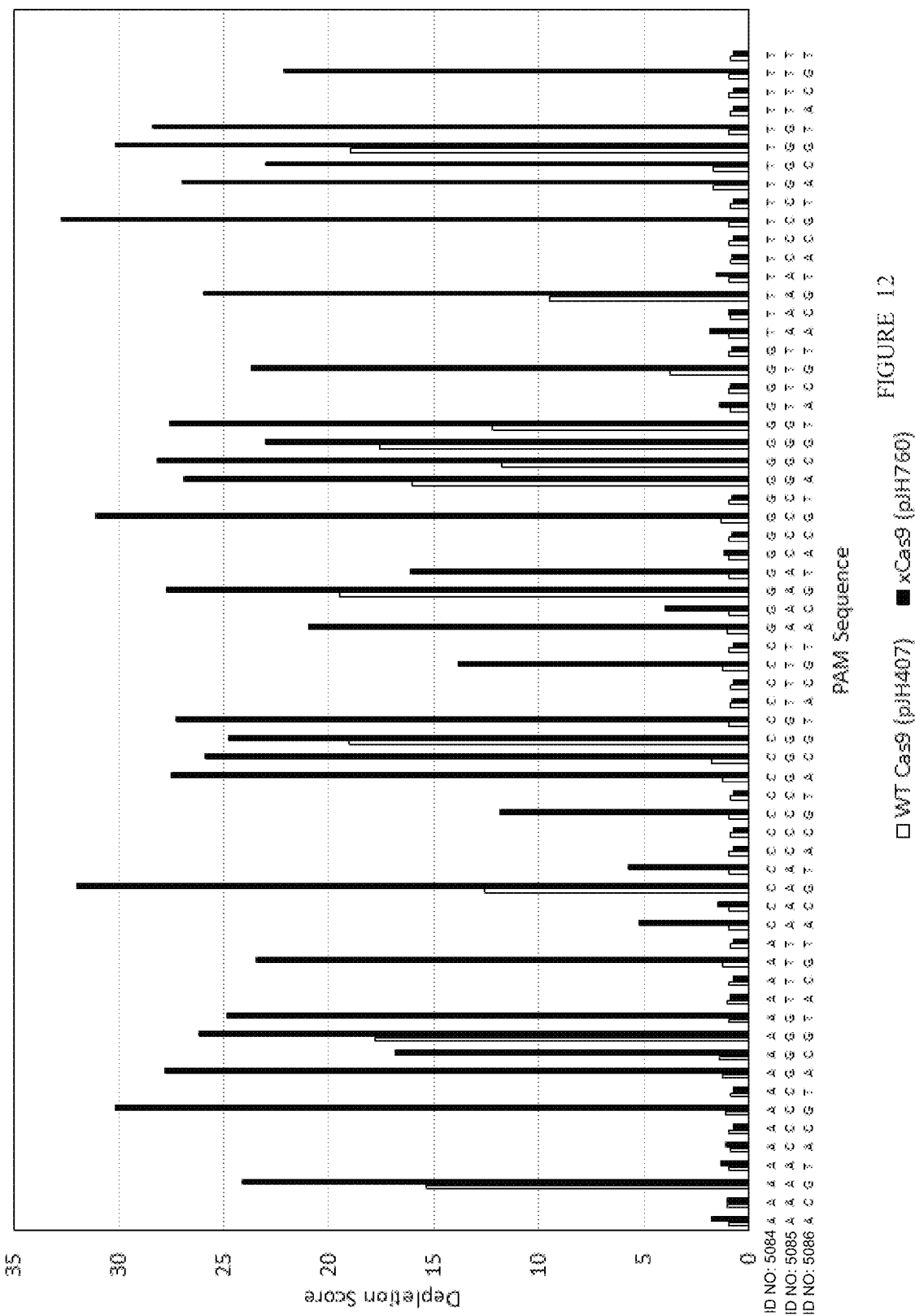
FIG. 12 shows the results of the PAM depletion assay. pJH760 was tested in the PAM depletion assay on four new targets: re2, VEGF, CLTA, and CCR5D.

In *E. coli*, a library of PAM sequences are encoded in a plasmid that also contains an antibiotic gene. If the Cas9 can cut the PAM sequences on the plasmid, the plasmid is not replicated and is lost; only plasmids that are uncut remain the population. The plasmids that were cut by the Cas9 can be determined by sequencing the initial plasmid population and the final plasmid population through high throughput sequencing. The proportion of the library consisting of each PAM sequence was obtained by dividing the number of reads containing the PAM sequence by the total number of reads. The depletion score was then calculated by dividing the proportion of the library containing the PAM section before the selection by the proportion of the library containing the PAM sequence after selection. Higher depletion scores signify higher cutting activity by the Cas9 of that particular PAM sequence. The results of the PAM depletion assay are shown in FIG. 12.

A number of PAM sequences that were not cut with the wild-type Cas9 were cut with the evolved Cas9 (xCas9 v1.0, pJH760). Notably, all PAM sequences of the form NGN and NNG, as well as GAA and GAT showed a depletion greater than 10-fold with the xCas9. A single G in either the second or third PAM position could be sufficient for cutting with the newly evolved Cas9, opening up the sequence space significantly for the target sites that can be targeted using Cas9. The PAM depletion scores are given in Table 4.

TABLE 4

| PAM Depletion Scores | | |
| --- | --- | --- |
| PAM Sequence | WT Cas9 | xCas9 v1.0 |
| TCG | 0.96 | 32.75 |
| CAG | 12.63 | 32.01 |
| GCG | 1.38 | 31.14 |
| ACG | 1.12 | 30.15 |
| TGG | 18.99 | 30.13 |
| TGT | 1.01 | 28.37 |
| GGC | 11.78 | 28.17 |
| AGA | 1.25 | 27.80 |
| GAG | 19.47 | 27.71 |
| GGT | 12.22 | 27.59 |
| CGA | 1.27 | 27.53 |
| CGT | 0.97 | 27.30 |
| TGA | 1.72 | 27.02 |
| GGA | 16.03 | 26.90 |
| AGG | 17.80 | 26.19 |
| TAG | 9.54 | 25.98 |
| CGC | 1.76 | 25.88 |
| AGT | 0.97 | 24.88 |
| CGG | 19.03 | 24.77 |
| AAG | 15.40 | 24.16 |

TABLE 4-continued

PAM Depletion Scores

| PAM Sequence | WT Cas9 | xCas9 v1.0 |
|---|---|---|
| GTG | 3.76 | 23.71 |
| ATG | 1.26 | 23.48 |
| GGG | 17.59 | 23.01 |
| TGC | 1.71 | 23.00 |
| TTG | 0.98 | 22.15 |
| GAA | 1.04 | 20.96 |
| AGC | 1.43 | 16.85 |
| GAT | 1.02 | 16.09 |
| CTG | 1.29 | 13.88 |
| CCG | 1.02 | 11.86 |
| CAT | 0.99 | 5.75 |
| CAA | 1.00 | 5.28 |
| GAC | 0.98 | 3.96 |
| TAA | 0.97 | 1.90 |
| AAA | 1.02 | 1.81 |
| TAT | 0.95 | 1.56 |
| CAC | 1.01 | 1.48 |
| GTA | 0.94 | 1.42 |
| AAT | 0.98 | 1.39 |
| GCA | 0.98 | 1.22 |
| ACA | 0.95 | 1.13 |
| AAC | 1.08 | 1.09 |
| TAC | 0.92 | 0.95 |
| ATA | 1.04 | 0.94 |
| GTC | 0.99 | 0.92 |
| GCT | 0.99 | 0.87 |
| TCA | 0.94 | 0.84 |
| CTA | 0.95 | 0.83 |
| GCC | 0.99 | 0.82 |
| GTT | 0.97 | 0.81 |
| TCC | 0.98 | 0.80 |
| ACC | 0.96 | 0.80 |
| CTC | 0.92 | 0.80 |
| CCA | 0.97 | 0.79 |
| CCC | 0.95 | 0.79 |
| CTT | 0.96 | 0.79 |
| ATC | 0.96 | 0.78 |
| CCT | 0.94 | 0.78 |
| ATT | 0.93 | 0.77 |
| ACT | 0.89 | 0.77 |
| TTT | 0.94 | 0.77 |
| TCT | 0.95 | 0.77 |
| TTC | 0.96 | 0.76 |
| TTA | 0.94 | 0.76 |

Example 7: GFP Cutting Mammalian Cells

Figure 13:
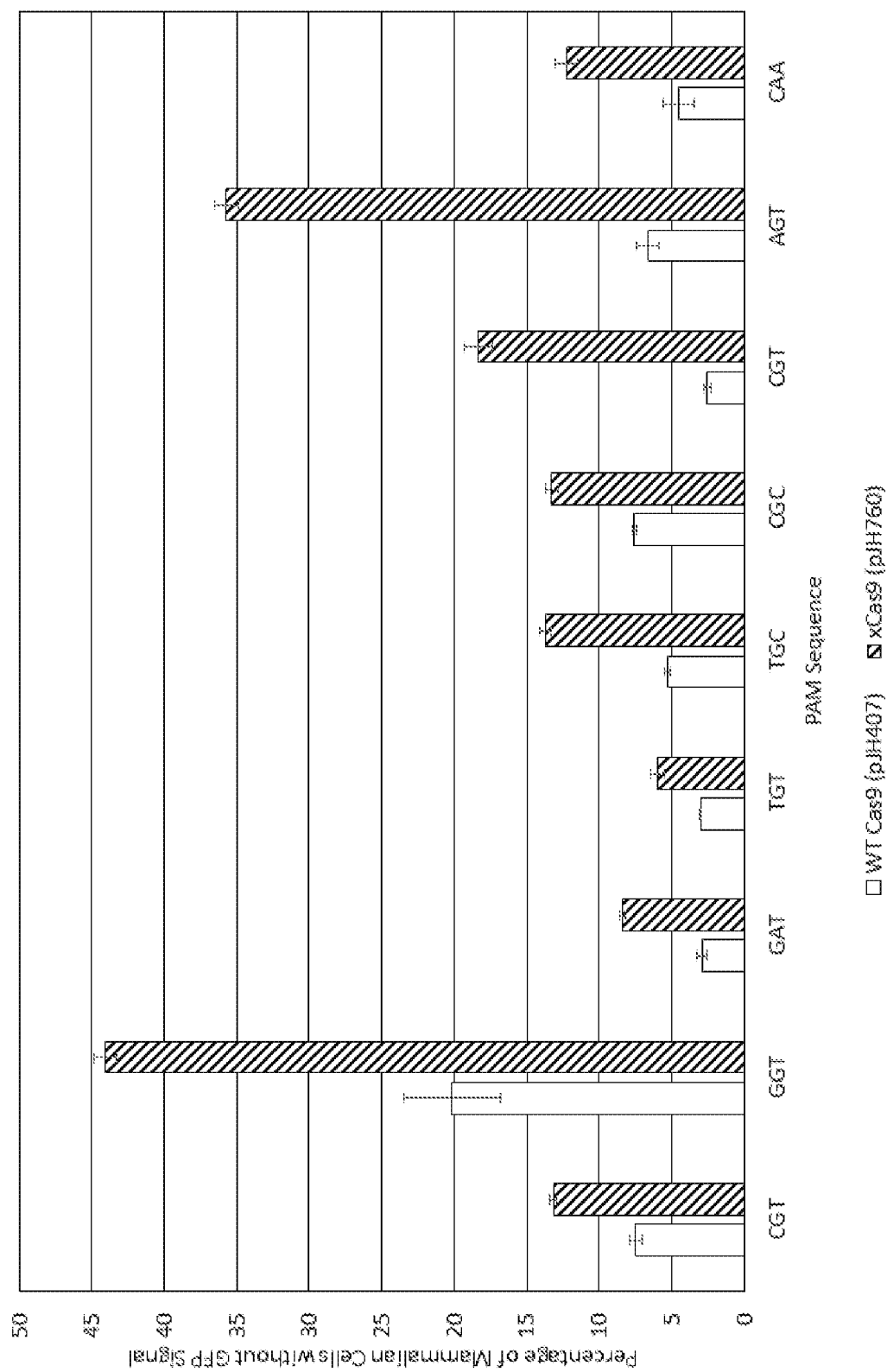
FIG. 13 shows GFP cutting in mammalian cells.
Figure 14:
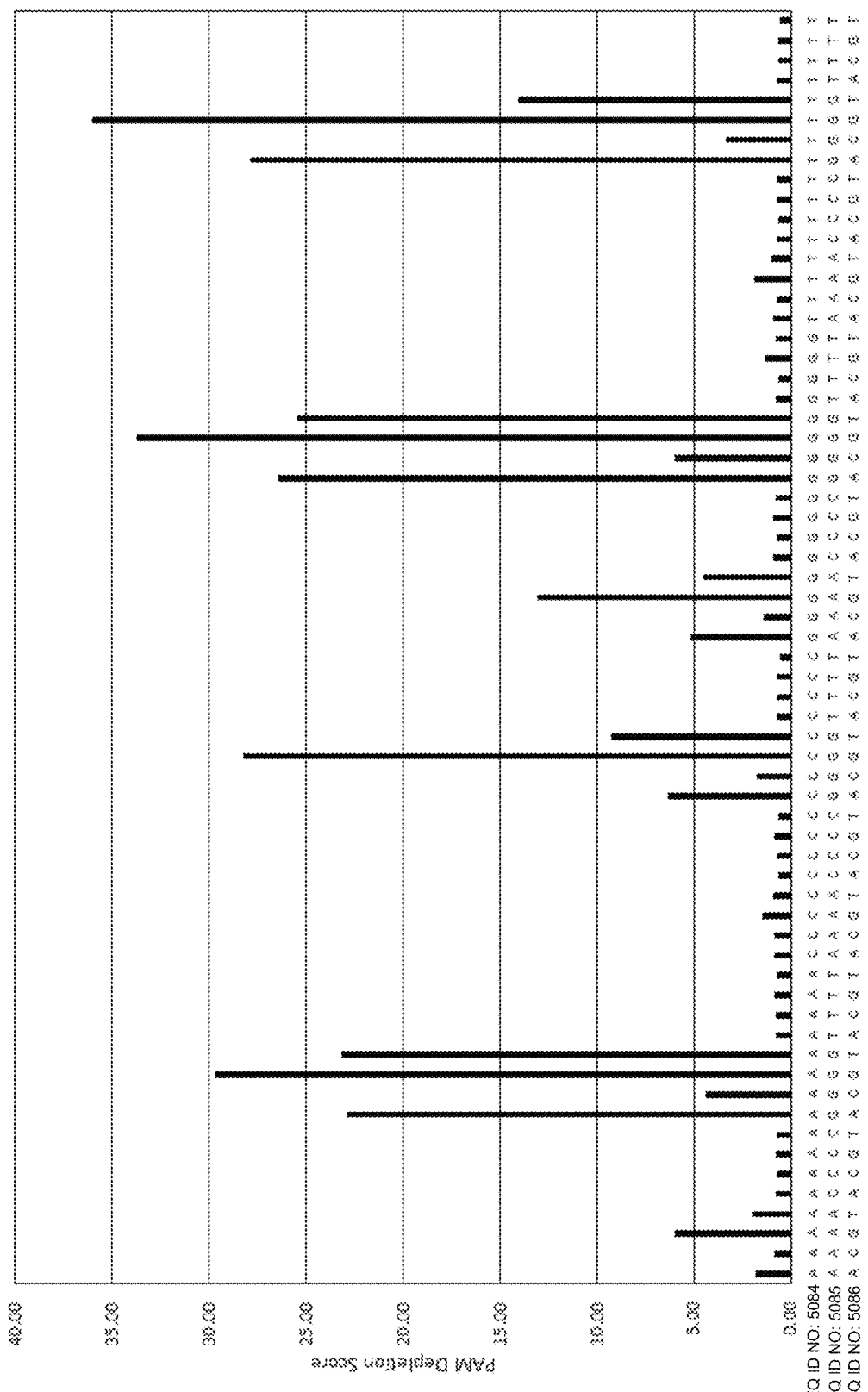
FIG. 14 shows the results of a PAM depletion assay to test pJH760 (xCas9 v1.0) on the re2 target.
Figure 15:
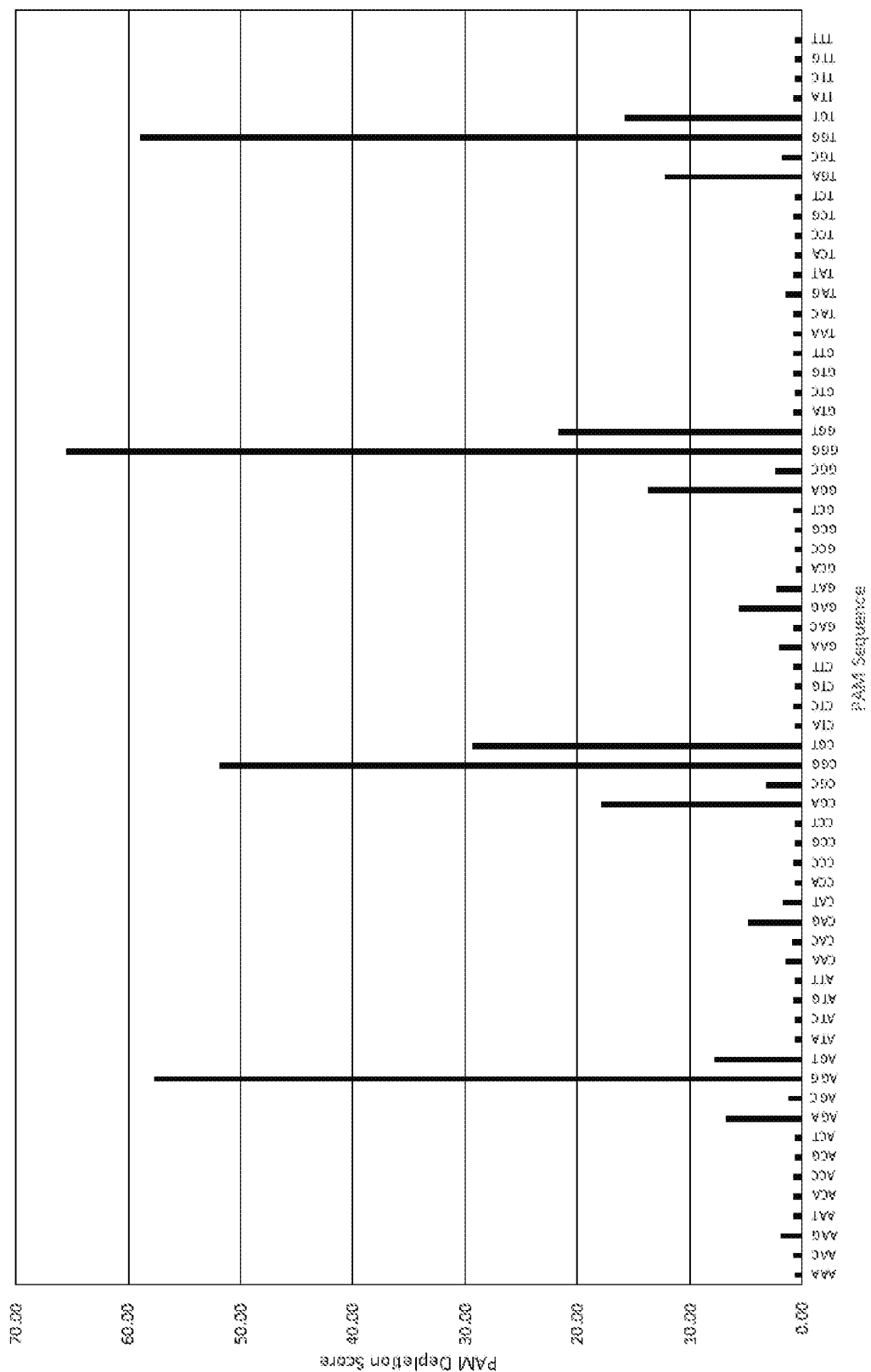
FIG. 15 shows the results of a PAM depletion assay to test pJH760 (xCas9 v1.0) on the VEGF target.
Figure 16:
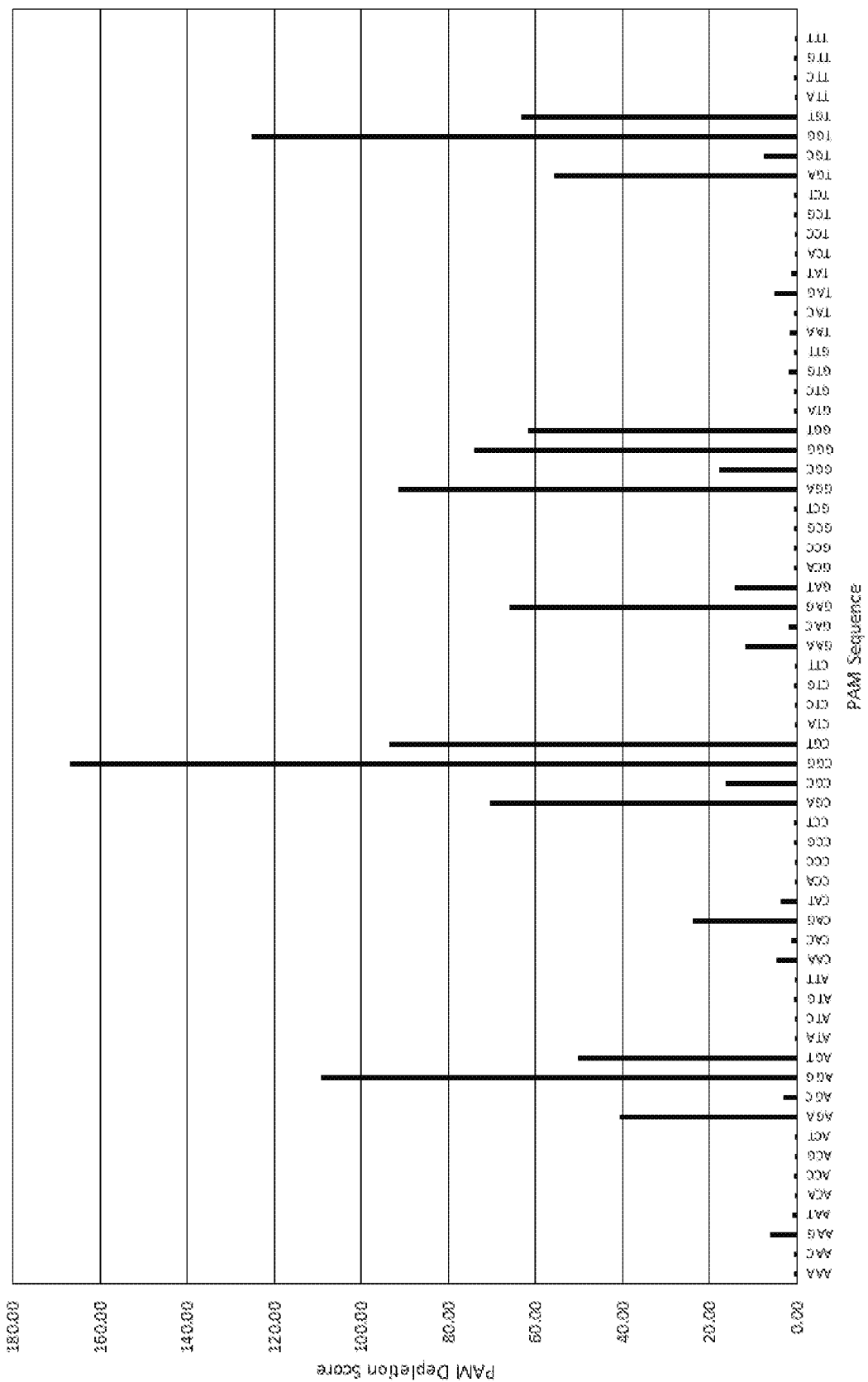
FIG. 16 shows the results of a PAM depletion assay to test pJH760 (xCas9 v1.0) on the CLTA target.
Figure 17:
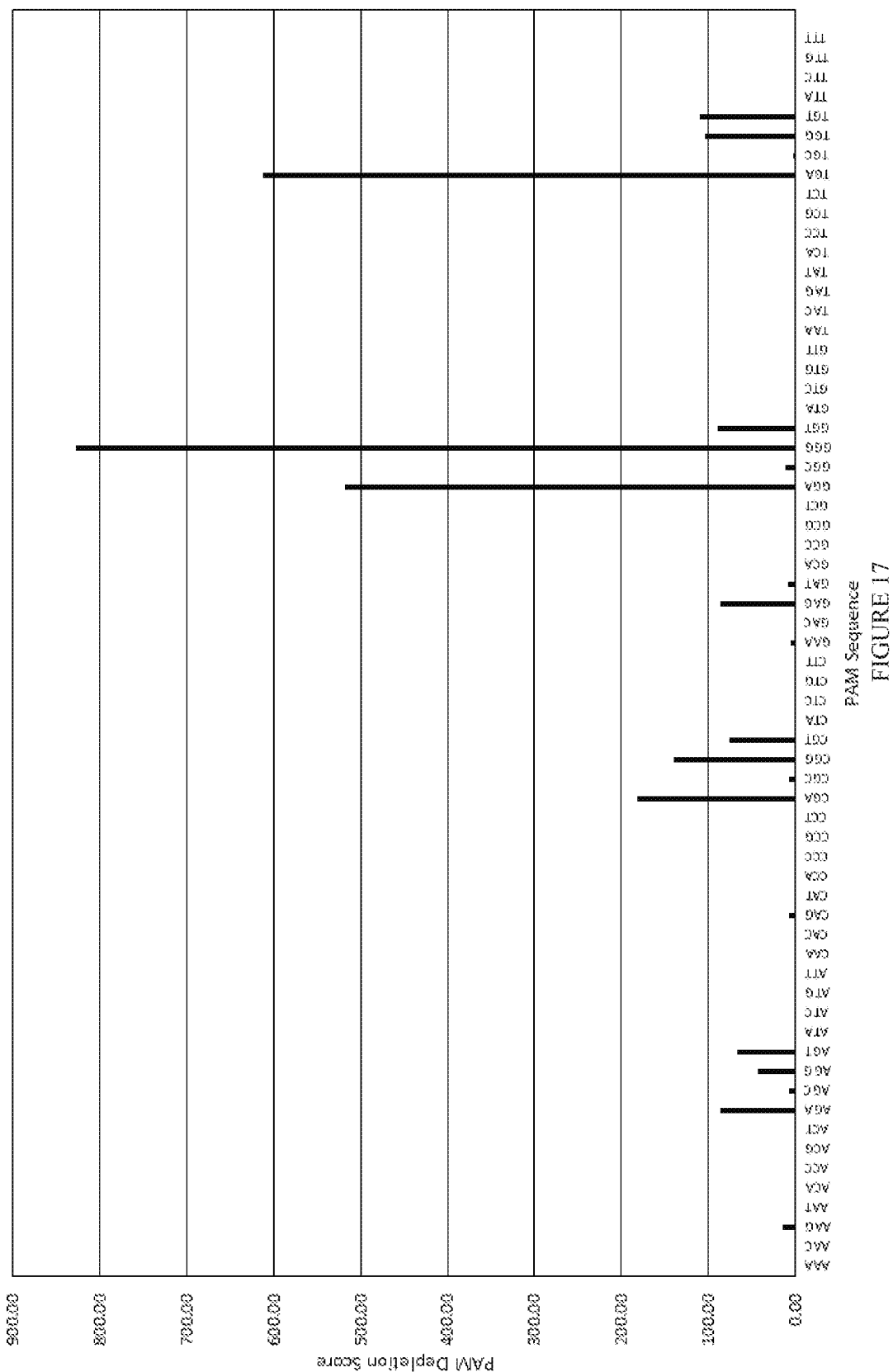
FIG. 17 shows the results of a PAM depletion assay to test pJH760 (xCas9 v1.0) on the CCR5D target.

Wild-type or evolved Cas9 and gRNAs were transfected into mammalian cells containing a genomically integrated GFP gene. Different gRNAs targeted different sites with different PAM sequences, such that cutting of the GFP by Cas9 would lead to a loss of the GFP signal. The GFP signal was quantified after five days with flow cytometry. As shown in FIG. 13, evolved Cas9 cut GFP in mammalian, in line with the results in the GFP activation assay and in the PAM depletion assay. High throughput sequencing around the cut site verified the results seen with the flow cytometer; the indels were proportional to the cutting percentage seen with the flow cytometer.

Example 8: Further Evolution of the HHH Library

As SpCas9 has a preference for the G residues at the second and third base, evolution was continued using the end point from the last evolution on a HHH (H=A, C, or T) PAM library. After evolution, 13 colonies were sequenced and a number of new mutations were identified. Three mutations, the E1219V, E480K, and E543D mutations were found in all the clones. A number of the clones either had the S267G/K294R/Q1256K mutations or the A262T/S409I mutations but those mutations were never seen together, suggesting that the clones had taken two divergent paths along the evolutionary landscape. The new mutations are given in Table 5.

TABLE 5

New Mutations

| HHH #1 (xCas9 2.0) | HHH #2 (xCas9 2.1) | HHH #3 (xCas9 2.2) | HHH #4 (xCas9 2.3) | HHH #5 (xCas9 2.4) | HHH #6 (xCas9 2.5) | HHH #7 (xCas9 2.6) | HHH #8 (xCas9 2.7) | HHH #9 (xCas9 2.8) | HHH #10 (xCas9 2.9) | HHH #11 (xCas9 2.10) | HHH #12 (xCas9 2.11) | HHH #13 (xCas9 2.12) |
|---|---|---|---|---|---|---|---|---|---|---|---|---|
| | | D23N | | | | | | | | | | |
| | | E108G | | | | | | | | | | |
| R115H | | | | | | | | | | | | |
| K141Q | | | | | | | | | D180N | | | |
| | | | | | | | | | P230S | | | P230S |
| | | | D257N | | | | | | | | | |
| | | A262T | | | | A262T | | | | A262T | | |
| S267G | S267G | | S267G | | S267G | | | S267G | | | S267G | S267G |
| | | | | | | | | | D284N | | | |
| K294R | K294R | | K294R | | K294R | | K294R | K294R | | | K294R | K294R |
| Q394H | | | | | | R324L | | | | | | |
| | | S409I | | S409I | | S409I | | | | S409I | | |
| | | | | L455F | | | | | | | | |
| | | | T466A | | | | | | | | | |
| | | | | | | | | | T474I | | | |
| E480K | E480K | E480K | E480K | E480K | E480K | E480K | E480K | E480K | E480K | E480K | E480K | E480K |
| E543D | E543D | E543D | E543D | E543D | E543D | E543D | E543D | E543D | E543D | E543D | E543D | E543D |
| | | | | | | | | | K554R | | | |
| | | | | R654L | | | | | | | | |
| | | M694I | | | | M694I | | | | | M694I | |
| | | | | | | | A711E | | | | | |

TABLE 5-continued

New Mutations

| HHH #1 (xCas9 2.0) | HHH #2 (xCas9 2.1) | HHH #3 (xCas9 2.2) | HHH #4 (xCas9 2.3) | HHH #5 (xCas9 2.4) | HHH #6 (xCas9 2.5) | HHH #7 (xCas9 2.6) | HHH #8 (xCas9 2.7) | HHH #9 (xCas9 2.8) | HHH #10 (xCas9 2.9) | HHH #11 (xCas9 2.10) | HHH #12 (xCas9 2.11) | HHH #13 (xCas9 2.12) |
|---|---|---|---|---|---|---|---|---|---|---|---|---|
|  | L727P |  |  |  |  |  |  |  |  |  |  |  |
|  |  |  | I1063V |  |  |  |  |  | M763I |  |  |  |
|  |  |  |  | V1100I |  |  |  |  |  |  |  |  |
| E1219V | E1219V | E1219V | E1219V | E1219V | E1219V | E1219V | E1219V | E1219V | E1219V | E1219V | E1219V | E1219V |
|  |  |  |  |  |  |  |  |  | K1244N |  |  |  |
| Q1256K | Q1256K |  | Q1256K |  | Q1256K |  | Q1256K | Q1256K |  |  | Q1256K | Q1256K |
|  |  | K1289Q |  |  |  |  |  |  |  |  |  |  |
|  |  |  |  | A1323S |  |  |  |  |  |  |  |  |

Example 9: Further Evolved Cas9 Proteins for Gene Editing pJH760, described in Example 6, was tested in the PAM depletion assay on a number of new targets. Four new targets were selected: re2 (GGGGCCACTAGGGACAGGAT (SEQ ID NO: 314)), a synthetic target previously used for GFP activation in mammalian cells; VEGF (GGGTGGGGG-GAGTTTGCTCC (SEQ ID NO: 315)), a target within the VEGF gene, CLTA (GCAGATGTAGTGTTTCCACA (SEQ ID NO: 316)), a target within the CLTA gene; and CCR5D (TCACTATGCTGCCGCCCAGT (SEQ ID NO: 317)), a target within the CCR5D gene. The results of the PAM depletion assay are given in FIGS. 14 to 17. It was found that, in addition to the canonical NGG sequence, PAM depletion demonstrates cutting for most NGN and some NNG sequences as well.

The HHH PAM library was further evolved using the end point from the last evolution on a HHH (H=A, C, or T) PAM library. After evolution, 13 colonies were sequenced and a number of new mutations were identified. Three mutations, the E1219V, E480K, and E543D mutations were found in all the clones. A number of the clones either had the K294R/Q1256K mutations or the A262T/S409I mutations but those mutations were never seen together, suggesting that the clones had taken two divergent paths along the evolutionary landscape. The new mutations are given in Tables 8 and 9 below.

Figure 18:
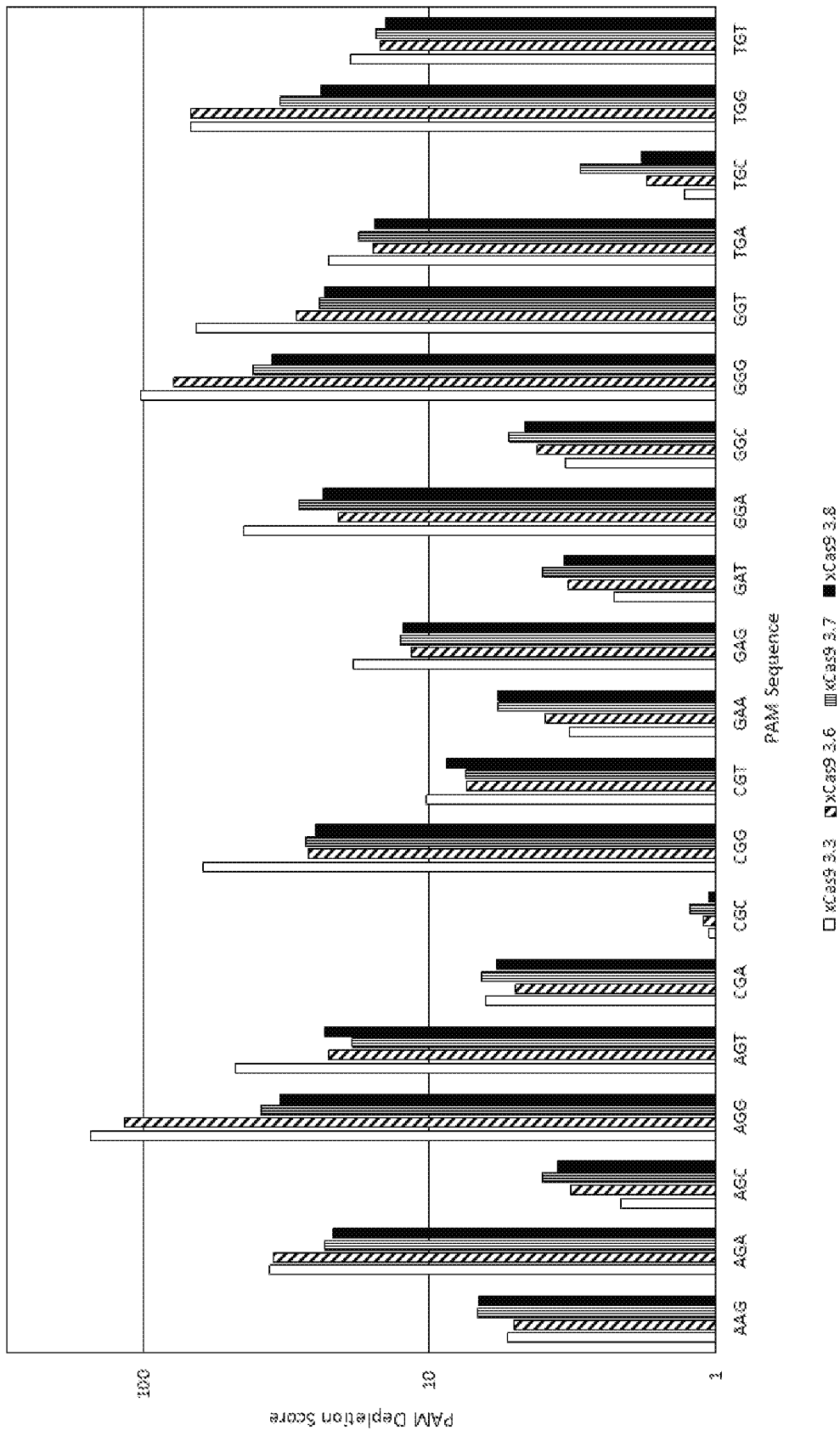
FIG. 18 shows the results of a PAM depletion assay to test four xCas9v3 mutants on the re2 target.
Figure 19:
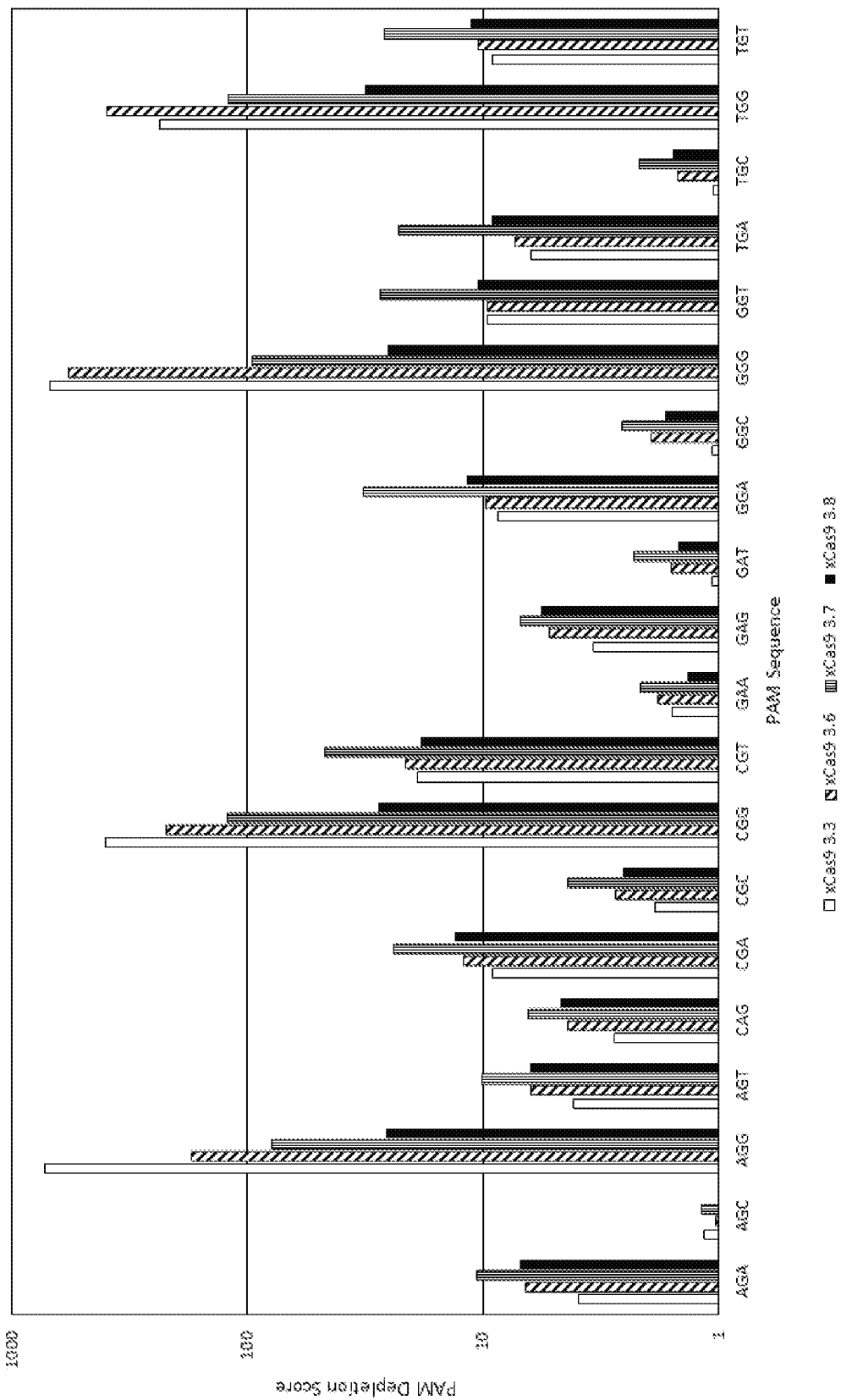
FIG. 19 shows the results of a PAM depletion assay to test four xCas9v3 mutants on the VEGF target.
Figure 20:
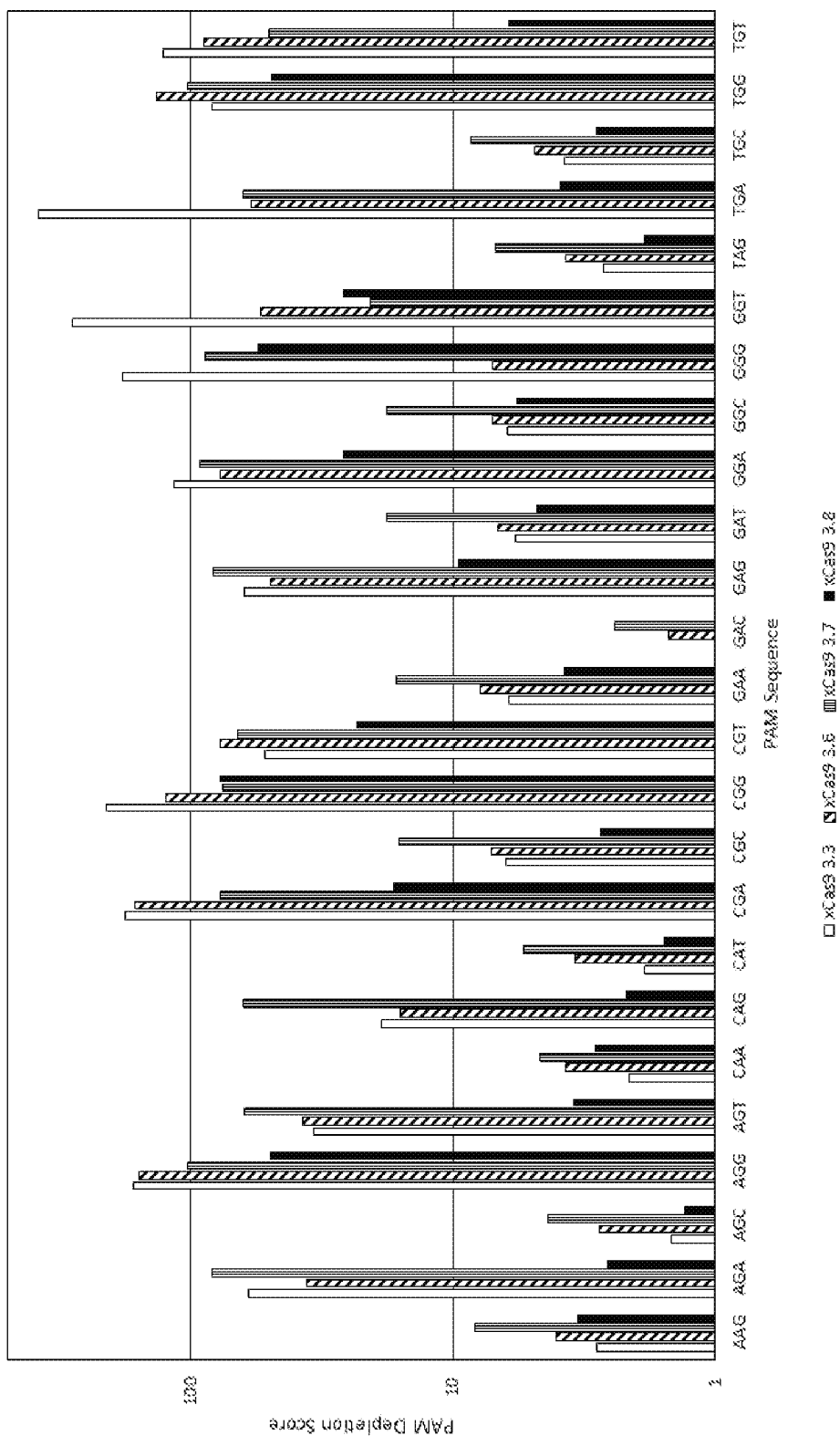
FIG. 20 shows the results of a PAM depletion assay to test four xCas9v3 mutants on the CLTA target.

As expected, variation in activity was seen with different targets. The PAM depletion assay scores are given in Table 10. NGN consistently showed cutting activity with some targets. Variation was seen amongst the xCas9 3.x mutants in terms of which mutant had the best activity. Of note, xCas9 3.3 contained the K294R/Q1256K series of mutations, while the other three mutants (3.6, 3.7, and 3.8) contained the A262T/S409I series of mutations. xCas9 3.6 and 3.7 outperformed 3.8. While 3.3 seemed to have the highest activity for most cases, 3.6 and 3.7 performed better on certain PAM sequences. The results of the PAM depletion assays for three of the new targets described above are given in FIGS. 18 to 20.

A NNNNN PAM depletion library was constructed. It was assayed to examine any fourth or fifth base specificity. Initial results of the PAM depletion assay show that there is no preference at the fourth and fifth base as expected.

In summary, E1219V was found to be one of the earliest mutations that fixed in the evaluation. It is close to the PAM sequence in the crystal structure. E480K and E543D were also seen in all of the clones from the early stages of the evolution, and may be important. K294R/Q1256K and A262T/S409I seem to be two divergent paths, and may be important. Their PAM sequence profiles seem to be slightly different, which implies their importance relative to PAM activity determination.

TABLE 6

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 674 | NM_000410.3(HFE): c.314T > C (p.Ile105Thr) | 3077 | HFE | ['ATGTTCACTGTTGACTTCTGGACTAYTATGG AAAATCACAACCACAGCAAG'] |
| 675 | NM_144631.5(ZNF513): c.1015T > C (p.Cys339Arg) | 130557 | ZNF513 | ['GCTGGGAGCTGCCATGTGTGGGCGCYGCAT GCGAGGAGAGGCTGGAGGGGG'] |
| 676 | NM_001199107.1(TBC1D24): c.751T > C (p.Phe251Leu) | 57465 | TBC1D24 | ['CGTGGCGCTGGCCATCCTCAAGTTCYTCCAC AAGGTGAGGGCCGGGCAGCC'] |
| 677 | NM_001708.2(OPN1SW): c.640T > C (p.Ser214Pro) | 611 | OPN1SW | ['CATCTTCTGCTTCATTGTGCCTCTCBCCCTCA TCTGCTTCTCCTACACTCA'] |
| 678 | NM_000235.3(LIPA): c.599T > C (p.Leu200Pro) | 3988 | LIPA | ['AAAAGGATTAAAATGTTTTTTGCCCYGGGTC CTGTGGCTTCCGTCGCCTTC'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 679 | NM_000071.2(CBS): c.833T > C (p.Ile278Thr) | 875 | CBS | ['CTGAAGCCGCGCCCTCTGCAGATCAYTGGG GTGGATCCCGAAGGGTCCATC'] |
| 680 | NM_000071.2(CBS): c.1616T > C (p.Leu539Ser) | 875 | CBS | ['TTCGGGGTGGTCACCGCCATTGACTYGCTGA ACTTCGTGGCCGCCCAGGAG'] |
| 681 | NM_033409.3(SLC52A3): c.670T > C (p.Phe224Leu) | 113278 | SLC52A3 | ['CGCCCACTTCTCACCCCTGGTCTTCYTCCTCC TCCTATCCATCATGATGGC'] |
| 682 | NM_033409.3(SLC52A3): c.1238T > C (p.Val413Ala) | 113278 | SLC52A3 | ['CTTTTCAGCGGCTGCCTCAGTTACGYCAAGG TGATGCTGGGCGTGGTCCTG'] |
| 683 | NM_000274.3 (OAT): c.163T > C (p.Tyr55His) | 4942 | OAT | ['GGAATATAAGTATGGTGCACACAACYACCA TCCTTTACCTGTAGCCCTGGA'] |
| 684 | NM_000274.3(OAT): c.1205T > C (p.Leu402Pro) | 4942 | OAT | ['TGTCTACGACTTCGAGATAATGGACYTCTGG CCAAGCCAACCCATGGCGAC'] |
| 685 | NM_000274.3(OAT): c.1180T > C (p.Cys394Arg) | 4942 | OAT | ['TTTAGATTGGGATGCTTGGAAGGTGYGTCTA CGACTTCGAGATAATGGACT'] |
| 686 | NM_001385.2(DPYS): c.1078T > C (p.Trp360Arg) | 1807 | DPYS | ['TGTTGAAGATCGGATGTCCGTAATAYGGGA AAAAGGCGTGGTGGGTTTCAC'] |
| 687 | NM_000027.3(AGA): c.916T > C (p.Cys306Arg) | 175 | AGA | ['TCCAGAATTCTTTGGGGCTGTTATAYGTGCC AATGTGACTGGAAGTTACGG'] |
| 688 | NM_000027.3(AGA): c.214T > C (p.Ser72Pro) | 175 | AGA | ['GTGTGAGAGAGCAGTGTGACGGCYCTGT AGGCTTTGGAGGAAGTCCTGA'] |
| 689 | NM_000398.6(CYB5R3): c.382T > C (p.Ser128Pro) | 1727 | CYB5R3 | ['CAAGTTTCCCGCTGGAGGGAAGATGYCTCA GTACCTGGAGAGCATGCAGAT'] |
| 690 | NM_000398.6(CYB5R3): c.446T > C (p.Leu149Pro) | 1727 | CYB5R3 | ['GAGTTCCGGGGCCCAGTGGGCTGCYGGTC TACCAGGGCAAAGGTGATTCG'] |
| 691 | NM_000398.6(CYB5R3): c.610T > C (p.Cys204Arg) | 1727 | CYB5R3 | ['GAAGGACCCTGATGACCACACTGTGYGCCA CCTGCTCTTTGCCAACCAGGT'] |
| 692 | NM_000398.6(CYB5R3): c.218T > C (p.Leu73Pro) | 1727 | CYB5R3 | ['CCGTCACCCCAGCACATCCTGGGCCYCCCTG TCGGTGAGTCACGCCCCTGC'] |
| 693 | NM_000552.3(VWF): c.4883T > C (p.Ile1628Thr) | 7450 | VWF | ['CCTGGAGACATCCAGGTGGTGCCCAYTGGA GTGGGCCCTAATGCCAACGTG'] |
| 694 | NM_000552.3(VWF): c.4837T > C (p.Ser1613Pro) | 7450 | VWF | ['CTACATGGTCACCGGAAATCCTGCCYCTGAT GAGATCAAGAGGCTGCCTGG'] |
| 695 | NM_000552.3(VWF): c.3814T > C (p.Cys1272Arg) | 7450 | VWF | ['GGAACCGCCGTTGCACGATTTCTACBGCAGC AGGCTACTGGACCTGGTCTT'] |
| 696 | NM_000552.3(VWF): c.8317T > C (p.Cys2773Arg) | 7450 | VWF | ['CAACGATGTGCAGGACCAGTGCTCCYGCTG CTCTCCGACACGGACGGAGCC'] |
| 697 | NM_000552.3(VWF): c.3445T > C (p.Cys1149Arg) | 7450 | VWF | ['TGAGTGTGAGTGGCGCTATAACAGCYGTGC ACCTGCCTGTCAAGTCACGTG'] |
| 698 | NM_000552.3(VWF): c.3178T > C (p.Cys1060Arg) | 7450 | VWF | ['GAAGCAGACGATGGTGGATTCCTCCYGTAG AATCCTTACCAGTGACGTCTT'] |
| 699 | NM_001042492.2(NF1): c.5858T > C (p.Leu1953Pro) | 4763 | NF1 | ['TGTTTGGAATACATGACTCCATGGCYGTCAA ATCTAGTTCGTTTTTGCAAG'] |
| 700 | NM_000267.3(NF1): c.1523T > C (p.Leu508Pro) | 4763 | NF1 | ['ATTCATGCAGATCCAAAGCTCTTGCYTTGTG TAAGTATTTTTTATGAAAT'] |
| 701 | NM_000267.3(NF1): c.6200T > C (p.Leu2067Pro) | 4763 | NF1 | ['ATTTTAGCACGCTACATGCTGATGCYGTCCT TCAACAATTCCCTTGATGTG'] |
| 702 | NM_000267.3(NF1): c.1070T > C (p.Leu357Pro) | 4763 | NF1 | ['CTGTTGGGGTTTTTATAGAACCTGCYTTTTA ATCCAAGTAAGCCATTCTCA'] |

TABLE 6-continued

Diseases/disorders containging T to C Changes.The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
| --- | --- | --- | --- | --- |
| 703 | NM_000267.3(NF1): c.3728T > C (p.Leu1243Pro) | 4763 | NF1 | ['TCTCAGGATGAACTAGCTCGAGTTCYGGTTA CTCTGTTTGATTCTCGGCAT'] |
| 704 | NM_000308.2(CTSA): c.247T > C (p.Trp83Arg) | 5476 | CTSA | ['CTCCGGCTCCAAGCACCTCCACTACYGGTCT GCCGCCCTGCCTTCTGGGCG'] |
| 705 | NM_001127695.1(CTSA): c.707T > C (p.Leu236Pro) | 5476 | CTSA | ['ATCTCCTACAGGCTTTGGTCTTCTCYCCAGA CCCACTGCTGCTCTCAAAAC'] |
| 706 | NM_000308.2(CTSA): c.1271T > C (p.Met424Thr) | 5476 | CTSA | ['GATGTAGACATGGCCTGCAATTTCAYGGGG GATGAGTGGTTTGTGGATTCC'] |
| 707 | NM_000405.4(GM2A): c.412T > C (p.Cys138Arg) | 2760 | GM2A | ['GCGTACCTATGGGCTTCCTTGCCACYGTCCC TTCAAAGAAGTAAGTACTTA'] |
| 708 | NM_001165974.1(UROC1): c.209T > C (p.Leu70Pro) | 131669 | UROC1 | ['CCAGAGTTTGCCCAGGAGCTGCAACYGTAC GGACACATCTACATGTACCGG'] |
| 709 | NM_003730.4(RNASET2): c.550T > C (p.Cys184Arg) | 8635 | RNASET2 | ['ATATGGAGTGATACCCAAAATCCAGYGCCT TCCACCAAGCCAGGTTAGACA'] |
| 710 | NM_199069.1(NDUFAF3): c.2T > C (p.Met1Thr) | 25915 | NDUFAF3 | ['GACTTCGCCGCGCGTTGGTCAGCCAYGGCC ACCGCTCTCGCGCTACGTAGC'] |
| 711 | NM_178012.4(TUBB2B): c.514T > C (p.Ser172Pro) | 347733 | TUBB2B | ['CATGAACACCTTCAGCGTCATGCCCYCACCC AAGGTGTCAGACACGGTGGT'] |
| 712 | NM_178012.4(TUBB2B): c.683T > C (p.Leu228Pro) | 347733 | TUBB2B | ['CCCACCTACGGGGACCTCAACCACYGGTG TCGGCCACCATGAGCGGGGTC'] |
| 713 | NM_178012.4(TUBB2B): c.793T > C (p.Phe265Leu) | 347733 | TUBB2B | ['CATGGTGCCCTTCCCTCGCCTGCACYTCTTC ATGCCCGGCTTCGCGCCCCT'] |
| 714 | NM_000110.3(DPYD): c.85T > C (p.Cys29Arg) | 1806 | DPYD | ['TCGAACACAAACTCATGCAACTCTGYGTTCC ACTTCGGCCAAGAAATTAGA'] |
| 715 | NM_133459.3(CCBE1): c.520T > C (p.Cys174Arg) | 147372 | CCBE1 | ['CATCCGGGAAGATGATGGGAAGACAYGTAC CAGGGGAGACAAATATCCCAA'] |
| 716 | NM_000035.3(ALDOB): c.442T > C (p.Trp148Arg) | 229 | ALDOB | ['GAAAGATGGTGTTGACTTTGGGAAGYGGCG TGCTGTGCTGAGGATTGCCGA'] |
| 717 | NM_000320.2(QDPR): c.106T > C (p.Trp36Arg) | 5860 | QDPR | ['AACCAAAGCTGTTTTCTCCTTCCAGYGGGTT GCCAGCGTTGATGTGGTGGA'] |
| 718 | NM_173560.3(RFX6): c.380 + 2T > C | 222546 | RFX6 | ['GCAGACACAGCTCACGCTGCAGTGGYGAGA CTCGCCCGCAGGGTACACTGA'] |
| 719 | NM_173560.3(RFX6): c.649T > C (p.Ser217Pro) | 222546 | RFX6 | ['AAAATGTACTAATTTTTTAAGGTTTYCTGGA AGCAAGCTAAAGAATGAGGT'] |
| 720 | NM_000037.3(ANK1): c.-108T > C | 286 | ANK1 | ['CTGCGGGGCCTGTGACGTGCGGGCCRGGCC CCCGAGGGCCTTATCGGCCCC'] |
| 721 | NM_001145308.4(LRTOMT): c.313T > C (p.Trp105Arg) | 220074 | LRTOMT | ['TCACATCCTCACCACCCTGGACCACYGGAGC AGCCGCTGCGAGTACTTGAG'] |
| 722 | NM_001012515.2(FECH): c.1268T > C (p.Phe423Ser) | 2235 | FECH | ['CCTGTCTGCAGGGAGACTAAATCCTYCTTCA CCAGCCAGCAGCTGTGACCC'] |
| 723 | NM_000140.3(FECH): c.315-48T > C | 2235 | FECH | ['TATTGAGTAGAAAACATTTCTCAGGYTGCTA AGCTGGAATAAAATCCACTT'] |
| 724 | NM_024120.4(NDUFAF5): c.686T > C (p.Leu229Pro) | 79133 | NDUFAF5 | ['GCTGTCAATGACCTGGGACATCTGCYTGGG AGAGCTGGCTTTAATACTCTG'] |
| 725 | NM_000277.1(PAH): c.932T > C (p.Leu311Pro) | 5053 | PAH | ['TTACAGGAAATTGGCCTTGCCTCTCYGGGTG CACCTGATGAATACATTGAA'] |
| 726 | NM_000277.1(PAH): c.764T > C (p.Leu255Ser) | 5053 | PAH | ['GGCCTGCTTTCCTCTCGGGATTTCTYGGGTG GCCTGGCCTTCCGAGTCTTC'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 727 | NM_000277.1(PAH): c.143T > C (p.Leu48Ser) | 5053 | PAH | ['TCACTCAAAGAAGAAGTTGGTGCATYGCC AAAGTATTGCGCTTATTTGAG'] |
| 728 | NM_000277.1(PAH): c.1045T > C (p.Ser349Pro) | 5053 | PAH | ['AAAGGCATATGGTGCTGGGCTCCTGBCATCC TTTGGTGAATTACAGGTATG'] |
| 729 | NM_000277.1(PAH): c.293T > C (p.Leu98Ser) | 5053 | PAH | [GCTCTGACAAACATCATCAAGATCTYGAGG CATGACATTGGTGCCACTGTC'] |
| 730 | NM_000277.1(PAH): c.734T > C (p.Val245Ala) | 5053 | PAH | ['TGCACTGGTTTCCGCCTCCGACCTGHGGCTG GCCTGCTTTCCTCTCGGGAT'] |
| 731 | NM_000277.1(PAH): c.194T > C (p.Ile65Thr) | 5053 | PAH | ['GAGAATGATGTAAACCTGACCCACANTGAA TCTAGACCTTCTCGTTTAAAG'] |
| 732 | NM_000130.4(F5): c.1160T > C (p.Ile387Thr) | 2153 | F5 | ['CATTTGGATAATTTCTCAAACCAAAYTGGAA AACATTATAAGAAAGTTATG'] |
| 733 | NM_000512.4(GALNS): c.413T > C (p.Val138Ala) | 2588 | GALNS | ['AAGGCCGGCTACGTCAGCAAGATTGYCGGC AAGTGGTAAGTCTCCTGGCCA'] |
| 734 | NM_018077.2(RBM28): c.1052T > C (p.Leu351Pro) | 55131 | RBM28 | ['TCCTTTGACTCAGAAGAAGAAGAACYTGGG GAGCTTCTCCAACAGTTTGGA'] |
| 735 | NM_203395.2(IYD): c.347T > C (p.Ile116Thr) | 389434 | IYD | ['AATGAGCAAGTCCCAATGGAAGTCAYTGAT AATGTCATCAGAACGGCAGGT'] |
| 736 | NM_015702.2(MMADHC): c.776T > C (p.Leu259Pro) | 27249 | MMADHC | ['CATTTAGGATTCTCTGTTGATGACCYTGGAT GCTGTAAAGTGATTCGTCAT'] |
| 737 | NM_014165.3(NDUFAF4): c.194T > C (p.Leu65Pro) | 29078 | NDUFAF4 | ['AAAGATGAAAAGCTGCTGTCGTTTCYAAAA GATGTGTATGTTGATTCCAAA'] |
| 738 | NM_001136271.2(NKX2-6): c.451T > C (p.Phe151Leu) | 137814 | NKX2-6 | ['GCAGGTGCTGGCCCTGGAGCGGCGCYTCAA GCAGCAGCGGTACCTGTCAGC'] |
| 739 | NM_013319.2(UBIAD1): c.511T > C (p.Ser171Pro) | 29914 | UBIAD1 | ['TATCTACTTTGGAGGCCTGTCTGGCYCCTTT CTCTACACAGGAGGTAAGAT'] |
| 740 | NM_001127628.1(FBP1): c.581T > C (p.Phe194Ser) | 2203 | FBP1 | ['TTGTCTAAAAAGGCCATCGGGGAGTYCATTT TGGTGGACAAGGATGTGAAG'] |
| 741 | NM_000046.3(ARSB): c.349T > C (p.Cys117Arg) | 411 | ARSB | ['TTTACAGCACCAAATAATCTGGCCCYGTCAG CCCAGCTGTGTTCCTCTGGA'] |
| 742 | NM_000046.3(ARSB): c.707T > C (p.Leu236Pro) | 411 | ARSB | ['TCTTTCCAGCCTCTGTTTCTCTACCYTGCTCT CCAGTCTGTGCATGAGCCC'] |
| 743 | NM_000404.2(GLB1): c.152T > C (p.Ile51Thr) | 2720 | GLB1 | ['AAGGATGGCCAGCCATTTCGCTACAYCTCA GGAAGCATTCACTACTCCCGT'] |
| 744 | NM_000404.2(GLB1): c.247T > C (p.Tyr83His) | 2720 | GLB1 | ['AAGGGGCTGTGTGTGTCTTGGCAGGBATGTG CCCTGGAACTTTCATGAGCC'] |
| 745 | NM_024782.2(NHEJ1): c.367T > C (p.Cys123Arg) | 79840 | NHEJ1 | ['CCTCCCCTTCTATTGGAATTTCCACYGCATG CTAGCTAGTCCTTCCCTGGT'] |
| 746 | NM_139241.3(FGD4): c.893T > C (p.Met298Thr) | 121512 | FGD4 | ['CAGAAATTGGCACCATTCCTTAAGABGTATG GAGAATATGTGAAAGGATTT'] |
| 747 | NM_020631.4(PLEKHG5): c.1940T > C (p.Phe647Ser) | 57449 | PLEKHG5 | ['TTGGGCCTTCCCTAACCAGGGTCCTYCCTCC TTATCTACCTGAATGAGTTT'] |
| 748 | NM_015559.2(SETBP1): c.2612T > C (p.Ile871Thr) | 26040 | SETBP1 | ['GAGACGATCCCCAGCGACAGCGGCAYTGGG ACAGACAACAACAGCACTTCT'] |
| 749 | NM_138387.3(G6PC3): c.554T > C (p.Leu185Pro) | 92579 | G6PC3 | ['CTCCTAGGCGCTGTCCTGGGCTGGCYGATGA CTCCCCGAGTGCCTATGGAG'] |
| 750 | NM_022489.3(INF2): c.556T > C (p.Ser186Pro) | 64423 | INF2 | ['CTTCAGCATTGTCATGAACGAGCTCYCCGGC AGCGACAACGTGCCCTACGT'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
| --- | --- | --- | --- | --- |
| 751 | NM_022489.3(INF2): c.125T > C (p.Leu42Pro) | 64423 | INF2 | ['GACCCCGAGCTGTGCATCCGGCTGCYCCAG ATGCCCTCTGTGGTCAACTAC'] |
| 752 | NM_018122.4(DARS2): c.492 + 2T > C | 55157 | DARS2 | ['TTTGAAATTAAGAACTTCGTGAAGGBACCA ACCTCTGTTATTAATAAAATA'] |
| 753 | NM_015272.3(RPGRIP1L): c.1975T > C (p.Ser659Pro) | 23322 | RPGR1P1L | ['CCTTCATCCCGAATATAACTTCACTYCTCAA TATCTTGTTCATGTTAATGA'] |
| 754 | NM_001029871.3(RSPO4): c.319T > C (p.Cys107Arg) | 343637 | RSPO4 | ['CTTCAGCCAGGACTTCTGCATCCGGYGCAAG AGGCAGTTTTACTTGTACAA'] |
| 755 | NM_000429.2(MAT1A): c.914T > C (p.Leu305Pro) | 4143 | MAT1A | ['GCTGCCCGCTGGGTGGCCAAGTCTCYGGTG AAAGCAGGGCTCTGCCGGAGA'] |
| 756 | NM_032581.3(FAM126A): c.158T > C (p.Leu53Pro) | 84668 | FAM126A | ['AACATTTTGTCTTTCTTCTAGTTGCBAGAAC CTGTCTGTCACCAGCTCTTT'] |
| 757 | NM_006364.2(SEC23A): c.1144T > C (p.Phe382Leu) | 10484 | SEC23A | ['GGGTGATTCTTTCAATACTTCCTTAYTCAAA CAAACTTTTCAAAGAGTCTT'] |
| 758 | NM_018006.4(TRMU): c.229T > C (p.Tyr77His) | 55687 | TRMU | ['CCATCAAGTGTCCTACGTAAAGGAGYATTG GAATGATGTGTTCAGGTGAGT'] |
| 759 | NM_001174089.1(SLC4A11): c.2480T > C (p.Leu827Pro) | 83959 | SLC4A11 | ['CTGCAGGTGCTTCAGCTGCTGCTGCYGTGTG CCTTCGGCATGAGCTCCCTG'] |
| 760 | NM_001174089.1(SLC4A11): c.589T > C (p.Ser197Pro) | 83959 | SLC4A11 | ['AGTGACAGGGGTGCGGTACCAGCAGYCGTG GCTCTGCATCATGTGAGTTGC'] |
| 761 | NM_148960.2(CLDN19): c.269T > C (p.Leu90Pro) | 149461 | CLDN19 | ['GCCCTGATGGTGGTGGCCGTGCTCCYGGGCT TCGTGGCCATGGTCCTCAGC'] |
| 762 | NM_153704.5(TMEM67): c.2498T > C (p.Ile833Thr) | 91147 | TMEM67 | ['AACACAGATGGTCAGACTTTTGAGAYTGCA ATTTCTAACCAGATGAGACAA'] |
| 763 | NM_153704.5(TMEM67): c.1769T > C (p.Phe590Ser) | 91147 | TMEM67 | ['ACAGGTCTTTACTGGCTTATTTTCTYCAAAG TGAGTGAGTTTCTGAATTTT'] |
| 764 | NM_153704.5(TMEM67): c.1843T > C (p.Cys615Arg) | 91147 | TMEM67 | ['AGAACGTTTTGTCACTTATGTTGGAHGTGCC TTTGCTCTGAAGGTAAGTTT'] |
| 765 | NM_153704.5(TMEM67): c.755T > C (p.Met252Thr) | 91147 | TMEM67 | ['ACATCTTGTCAAGCTCTTGGAAATAYGTGTG TGATGAACATGAATTCTTAC'] |
| 766 | NM_017777.3(MKS1): c.80 + 2T > C | 54903 | MKS1 | ['CCCCGTGCGCAACTTGCGCCTCCGGYAGTCG CACCGCCCCAGCCCCGAGGC'] |
| 767 | NM_001041.3(SI): c.1022T > C (p.Leu341Pro) | 6476 | SI | ['AATTACATGCTCATTTACTTTAAGCYTGTTG GACTACCAGCAATGCCAGCA'] |
| 768 | NM_001041.3(SI): c.1859T > C (p.Leu620Pro) | 6476 | SI | ['ATGGAATGGTCTATAACTGGAATGCYGGAG TTCAGTTTGTTTGGAATACCT'] |
| 769 | NM_015506.2(MMACHC): c.347T > C (p.Leu116Pro) | 25974 | MMACHC | ['CACCCCAACCGACGCCCCAAGATCCYGGCC CAGACAGCAGCCCATGTAGCT'] |
| 770 | NM_000190.3(HMBS): c.739T > C (p.Cys247Arg) | 3145 | HMBS | ['GCACGATCCCGAGACTCTGCTTCGCYGCATC GCTGAAAGGGCCTTCCTGAG'] |
| 771 | NM_000190.3(HMBS): c.242T > C (p.Leu81Pro) | 3145 | HMBS | ['GAGAAAAGCCTGTTTACCAAGGAGCYTGAA CATGCCCTGGAAGAATGAG'] |
| 772 | NM_000237.2(LPL): c.662T > C (p.Ile221Thr) | 4023 | LPL | ['ACCAGAGGGTCCCCTGGTCGAAGCAYTGGA ATCCAGAAACCAGTTGGGCAT'] |
| 773 | NM_000237.2(LPL): c.337T > C (p.Trp113Arg) | 4023 | LPL | ['AGACTCCAATGTCATTGTGGTGGACYGGCTG TCACGGGCTCAGGAGCATTA'] |
| 774 | NM_000237.2(LPL): c.755T > C (p.Ile252Thr) | 4023 | LPL | ['AACATTGGAGAAGCTATCCGCGTGAYTGCA GAGAGAGGACTTGGAGGTAAA'] |

TABLE 6-continued

Diseases/disorders containging T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 775 | NM_000263.3(NAGLU): c.142T > C (p.Phe48Leu) | 4669 | NAGLU | ['GCTGGGGCCAGGCCCCGCGGCCGACYTCTC CGTGTCGGTGGAGCGCGCTCT'] |
| 776 | NM_000018.3(ACADVL): c.1372T > C (p.Phe458Leu) | 37 | ACADVL | ['GCGTGTGCTCCGAGATCTTCGCATCYTCCGG ATCTTTGAGGGGACAAATGA'] |
| 777 | NM__018105.2(THAP 1): c.241T > C (p.Phe81Leu) | 55145 | THAP1 | ['GAAAGAGAATGCTGTGCCCACAATAYTTCTT TGTACTGAGCCACATGACAA'] |
| 778 | NM_005908.3(MANBA): c.1513T > C (p.Ser505Pro) | 4126 | MANBA | ['AGACAAGAGTCGTCCTTTTATTACGYCCAGT CCTACAAATGGGGCTGAAAC'] |
| 779 | NM_000124.3(ERCC6): c.2960T > C (p.Leu987Pro) | 2074 | ERCC6 | ['AAGCAGTTTTTGACAAATAGAGTGCYAAAA GACCCAAAACAAAGGCGGTTT'] |
| 780 | NM_014845.5(FIG4): c.122T > C (p.Ile41Thr) | 9896 | FIG4 | ['GAAACGAAATATCGTGTCTTGAAGAYTGAT AGAACAGAACCAAAAGATTTG'] |
| 781 | NM_000787.3(DBH): c.339+2T > C | 1621 | DBH | ['GATGGGGACACTGCCTATTTTGCGGYGAGTC TCTCCTCCCTGCCAGCTCTC'] |
| 782 | NM_000102.3(CYP17A1): c.316T > C (p.Ser106Pro) | 1586 | CYP17A1 | ['TCTAAAGGCAACTCTAGACATCGCGYCCAA CAACCGTAAGGGTATCGCCTT'] |
| 783 | NM_000102.3(CYP17A1): c.1216T > C (p.Trp406Arg) | 1586 | CYP17A1 | ['GGCGCTGCATCACAATGAGAAGGAGYGGCA CCAGCCGGATCAGTTCATGCC'] |
| 784 | NM_000102.3(CYP17A1): c.1358T > C (p.Phe453Ser) | 1586 | CYP17A1 | ['GAGATCCTGGCCCGCCAGGAGCTCTYCCTCA TCATGGCCTGGCTGCTGCAG'] |
| 785 | NM_152783.4(D2HGDH): c.1331T > C (p.Val444Ala) | 728294 | D2HGDH | ['GGAGATGGTAACCTGCACCTCAATGYGACG GCGGAGGCCTTCAGCCCCTCG'] |
| 786 | NM_000255.3(MUT): c.313T > C (p.Trp105Arg) | 4594 | MUT | ['TCCTACCATGTATACCTTTAGGCCCYGGACC ATCCGCCAGTATGCTGGTTT'] |
| 787 | NM_000411.6(HLCS): c.710T > C (p.Leu237Pro) | 3141 | HLCS | ['CTGTACCAGAAGTTCATGGCCTATCYTTCTC AGGGAGGGAAGGTGTTGGGC'] |
| 788 | NM_022132.4(MCCC2): c.499T > C (p.Cys167Arg) | 64087 | MCCC2 | ['AATTGCCATGCAAAACAGGCTCCCCYGCAT CTACTTAGGCAAGTCACCAGA'] |
| 789 | NM_020166.4(MCCC1): c.1310T > C (p.Leu437Pro) | 56922 | MCCC1 | ['CATTATGACCCCATGATTGCGAAGCYGGTCG TGTGGGCAGCAGATCGCCAG'] |
| 790 | NM_198578.3(LRRK2): c.6059T > C (p.Ile2020Thr) | 120892 | LR12K2 | ['ATTGCAAAGATTGCTGACTACGGCAYTGCTC AGTACTGCTGTAGAATGGGG'] |
| 791 | NM_000022.2(ADA): c.320T > C (p.Leu107Pro) | 100 | ADA | ['GAGGTGCGGTACAGTCCGCACCTGCYGGCC AACTCCAAAGTGGAGCCAATC'] |
| 792 | NM_199242.2(UNC13D): c.1208T > C (p.Leu403Pro) | 201294 | UNC13D | ['CTGGCCGCCTCATTCAGCTCCCTGCYGACCT ACGGCCTCTCCCTCATCCGG'] |
| 793 | NM_152443.2(RDH12): c.523T > C (p.Ser175Pro) | 145226 | RDH12 | ['CCCTGCACGGGTGGTTAATGTGTCCYCGGTG GCTCACCACATTGGCAAGAT'] |
| 794 | NM_020435.3(GJC2): c.857T > C (p.Met286Thr) | 57165 | GJC2 | ['TGCCTGCTGCTCAACCTCTGTGAGAYGGCCC ACCTGGGCTTGGGCAGCGCG'] |
| 795 | NM_000159.3(GCDH): c.883T > C (p.Tyr295His) | 2639 | GCDH | ['CTTCGGCTGCCTGAACAACGCCCGGYACGG CATCGCGTGGGCGTGCTTGG'] |
| 796 | NM_000920.3(PC): c.434T > C (p.Val145Ala) | 5091 | PC | ['CGGTTTATTGGGCCAAGCCCAGAAGBGGTC CGCAAGATGGGAGACAAGGTG'] |
| 797 | NM_207118.2(GTF2H5): c.62T > C (p.Leu21Pro) | 404672 | GTF2H5 | ['GATCCTGCCATGAAGCAGTTTCTGCYGTACT TGGATGAGTCCAATGCCCTG'] |
| 798 | NM_005787.5(ALG3): c.211T > C (p.Trp71Arg) | 10195 | ALG3 | ['TCTTCTTCCAGACACAGAGATTGACYGGAA GGCTACATGGCCGAGGTAGA'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 799 | NM_024514.4(CYP2R1): c.296T > C (p.Leu99Pro) | 120227 | CYP2R1 | ['GGCTATGATGTAGTAAAGGAATGCCYTGTTC ATCAAAGCGAAATTTTTGCA'] |
| 800 | NM_017929.5(PEX26): c.2T > C (p.Met1Thr) | 55670 | PEX26 | ['CTGGGCCTTGGACCCGGACTCGTTAYGAAG AGCGATTCTTCGACCTCTGCA'] |
| 801 | NM_017929.5(PEX26): c.134T > C (p.Leu45Pro) | 55670 | PEX26 | ['CTTCTGGAGGAGGCGGCCGACCTCCYGGTG GTGCACCTGGACTTCCGGGCG'] |
| 802 | NM_213599.2(ANO5): c.1066T > C (p.Cys356Arg) | 203859 | ANO5 | ['TGGTCAGATGATCATGTGCCCACTCBGTGAT CAAGTGTGTGATTATTGGAG'] |
| 803 | NM_022370.3(ROBO3): c.2113T > C (p.Ser705Pro) | 64221 | ROBO3 | ['CCAGCTGGTGCAAGGTTTCCGGGTGHCTTGG AGGGTAGCAGGCCCTGAGGG'] |
| 804 | NM_022370.3(ROBO3): c.14T > C (p.Leu5Pro) | 64221 | ROBO3 | ['CTGGGTCGAGCCATGCTGCGCTACCYGCTGA AACGCTGCTGCAGATGAAC'] |
| 805 | NM_207352.3(CYP4V2): c.332T > C (p.Ile111Thr) | 285440 | CYP4V2 | ['GTATGTTTTCTCTTCCTAAGGTAABTTTAAC TAGTTCAAAGCAAATTGAC'] |
| 806 | NM_178857.5(RP1L1): c.2878T > C (p.Trp960Arg) | 94137 | RP1L1 | ['GTCTCCAGAGGCTGTGGTCCGCGAAYGGCT GGACAACATTCCAGAAGAGCC'] |
| 807 | NM_018668.4(VPS33B): c.89T > C (p.Leu30Pro) | 26276 | VPS33B | ['GCTCGAGACCAGCTCATCTATCTGCYGGAGC AGGTCAGTGCTTGCCTGACG'] |
| 808 | NM_024006.5(VKORC1): c.134T > C (p.Val45Ala) | 79001 | VKORC1 | ['CGGGATTACCGCGCGCTCTGCGACGYGGGC ACCGCCATCAGCTGTTCGCGC'] |
| 809 | NM_000551.3(VHL): c.334T > C (p.Tyr112His) | 7428 | VHL | ['TGGCACGGGCCGCCGCATCCACAGCHACCG AGGTACGGGCCCGGCGCTTAG'] |
| 810 | NM_000551.3(VHL): c.292T > C (p.Tyr98His) | 7428 | VHL | ['CAACTTCGACGGCGAGCCGCAGCCCYACCC AACGCTGCCGCCTGGCACGGG'] |
| 811 | NM_000551.3(VHL): c.188T > C (p.Leu63Pro) | 7428 | VHL | ['GAGGCCGGGCGGCCGCGGCCCGTGCYGCGC TCGGTGAACTCGCGCGAGCCC'] |
| 812 | NM_000551.3(VHL): c.488T > C (p.Leu163Pro) | 7428 | VHL | ['GTGTATACTCTGAAAGAGCGATGCCYCCAG GTTGTCCGGAGCCTAGTCAAG'] |
| 813 | NM_014874.3(MFN2): c.227T > C (p.Leu76Pro) | 9927 | MFN2 | ['CCCGTTACCACAGAAGAACAGGTTCBGGAC GTCAAAGGTTACCTATCCAAA'] |
| 814 | NM_015046.5(SETX): c.1166T > C (p.Leu389Ser) | 23064 | SETX | MACATGTATGAAGAAATGGAAACATYAGCC AGTGTACTTCAGTCAGATATT'] |
| 815 | NM_005609.2(PYGM): c.1187T > C (p.Leu396Pro) | 5837 | PYGM | ['TGGCCGGTGCACCTCTTGGAGACGCYGCTGC CGCGGCACCTCCAGATCATC'] |
| 816 | NM_005609.2(PYGM): c.2392T > C (p.Trp798Arg) | 5837 | PYGM | ['CTTTGACCTGCAGAACCCAAGAGAGHGGAC GCGGATGGTGATCCGGAACAT'] |
| 817 | NM_213653.3(HFE2): c.842T > C (p.Ile281Thr) | 148738 | HFE2 | ['CATGTGGAGATCCAAGCTGCCTACAYTGGC ACAACTATAATCATTCGGCAG'] |
| 818 | NM_213653.3(HFE2): c.238T > C (p.Cys80Arg) | 148738 | HFE2 | ['TGGAGGGGTGGGCTCTGGCGGCCTCBGTCG AGCCCTCCGCTCCTATGCGCT'] |
| 819 | NM_213653.3(HFE2): c.302T > C (p.Leu101Pro) | 148738 | HFE2 | ['ACCGCCCGCACCTGCCGCGGGGACCYCGCC TTCCATTCGGCGGTACATGGC'] |
| 820 | NM_000045.3(ARG1): c.32T > C (p.Ile11Thr) | 383 | ARG1 | ['GCCAAGTCCAGAACCATAGGGATTAYTGGA GCTCCTTTCTCAAAGGGACAG'] |
| 821 | NM_032409.2(PINK1): c.1040T > C (p.Leu347Pro) | -1 | — | ['GCCGCCATGATGCTGCTGCAGCTGCYGGAA GGCGTGGACCATCTGGTTCAA'] |
| 822 | NM_153006.2(NAGS): c.1289T > C (p.Leu430Pro) | -1 | — | ['GCCAGGTACAACGCCGCCGCCATTCYGACC ATGGAGCCCGTCCTGGGGGC'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 823 | NM_153006.2(NAGS): c.1450T > C (p.Trp484Arg) | -1 | — | ['CCGGGTCACCAACCCCATCAATCCCBGGTAG GTCCTGCCACTCCCAGCTCT'] |
| 824 | NM_001173464.1(KIF21A): c.3029T > C (p.Ile1010Thr) | 55605 | KIF21A | ['AGTATTTCTGATTGTCAGGCCAACAYAATGC AGATGGAAGAAGCAAAGGTT'] |
| 825 | NM_001173464.1(KIF21A): c.1067T > C (p.Met356Thr) | 55605 | KIF21A | ['GTCAGCCCTTCAGACAGAGACTTTAYGGAA ACGTTAAACACCCTGAAATAC'] |
| 826 | NM_000434.3(NEU1): c.1088T > C (p.Leu363Pro) | 4758 | NEU1 | ['TCATGGCGGAAAGAGACAGTCCAGCYATGG CCAGGCCCCAGTGGCTATTCA'] |
| 827 | NM_000434.3(NEU1): c.718T > C (p.Trp240Arg) | 4758 | NEU1 | ['CCTCAGCGATGATCATGGTGCCTCCYGGCGC TACGGAAGTGGGGTCAGCGG'] |
| 828 | NM_000026.2(ADSL): c.1312T > C (p.Ser438Pro) | 158 | ADSL | ['TGATGCCTACTTCAGTCCCATTCACYCCCAG TTGGATCATTTACTGGATCC'] |
| 829 | NM_000026.2(ADSL): c.674T > C (p.Met225Thr) | 158 | ADSL | ['TCCAAGGTAGAGCAGCTTGACAAGAYGGTG ACAGAAAAGGCAGGATTTAAG'] |
| 830 | NM_018400.3(SCN3B): c.29T > C (p.Leu10Pro) | 55800 | SCN3B | ['CCTGCCTTCAATAGATTGTTTCCCCYGGCTT CTCTCGTGCTTATCTACTGG'] |
| 831 | NM_024577.3(SH3TC2): c.505T > C (p.Tyr169His) | 79628 | SH3TC2 | ['CCTTCCTGTATCAGGAGTCCCAGGTRTATTG TTTCCAGGTGTTTATCATCT'] |
| 832 | NM_000243.2(MEFV): c.2177T > C (p.Val726Ala) | 4210 | MEFV | ['GTGGGCATCTTCGTGGACTACAGAGHTGGA AGCATCTCCTTTTACAATGTG'] |
| 833 | NM_000483.4(APOC2): c.142T > C (p.Trp48Arg) | -1 | — | ['GGTGAAGGAATCTCTCTCCAGTTACYGGGA GTCAGCAAAGACAGCCGCCCA'] |
| 834 | NM_058172.5(ANTXR2): c.566T > C (p.Ile189Thr) | 118429 | ANTXR2 | ['CTCTTCTTTCTAAAGCTTGAAAGAAYTGCTG ATTCCAAGGAGCAAGTTTTC'] |
| 835 | M_001128085.1(ASPA): c.454T > C (p.Cys152Arg) | -1 | — | ['TCAGACTTCTCTGGCTCCACTACCCYGCTAC GTTTATCTGATTGAGCATCC'] |
| 836 | NM_022464.4(SIL1): c.645 + 2T > C | 64374 | SIL1 | ['TGACTTATGGACGAAGAAATACAGTRCCTG ATGGACATAATATTCAAGATC'] |
| 837 | NM_001037633.1(SIL1): c.1370T > C (p.Leu457Pro) | 64374 | SIL1 | ['CTGCTGGGCTCTGTCAACAGCTTGCYGAAGG AGCTGAGATGAGGCCCCACA'] |
| 838 | NM_000391.3(TPP1): c.1093T > C (p.Cys365Arg) | 1200 | TPP1 | ['TCTCTCAGGTGACAGTGGGGCCGGGYGTTG GTCGTCTCTGGAAGACACCA'] |
| 839 | NM_182760.3(SUMF1): c.1006T > C (p.Cys336Arg) | 285362 | SUMF1 | ['AGTGAAGAAAGGTGGATCCTACATGYGCCA TAGGGTAAGTCATGTCACTAA'] |
| 840 | NM_182760.3(SUMF1): c.463T > C (p.Ser155Pro) | 285362 | SUMF1 | ['CTTATAGGCTGAGAAGTTTGGCGACYCCTTT GTCTTTGAAGGCATGTTGAG'] |
| 841 | NM_177986.3(DSG4): c.574T > C (p.Ser192Pro) | -1 | — | ['TGCAGATGAAGAAAATCATCTGAATHCTAA AATTGCCTACAAGATCGTCTC] |
| 842 | NM_004183.3(BEST1): c.253T > C (p.Tyr85His) | 7439 | BEST1 | ['CCCCCGCCCCTCCTGCCCAGGCTTCYACGTG ACGCTGGTCGTGACCCGCTG'] |
| 843 | NM_004183.3(BEST1): c.122T > C (p.Leu41Pro) | 7439 | BEST1 | ['TATGGCGAGTTCTTAATCTTCCTGCYCTGCT ACTACATCATCCGCTTTATT'] |
| 844 | NM_004183.3(BEST1): c.614T > C (p.Ile205Thr) | 7439 | BEST1 | ['CTTGGAGGTCGAATCCGGGACCCTAYCCTGC TCCAGAGCCTGCTGAACGTG'] |
| 845 | NM_004183.3(BEST1): c.704T > C (p.Val235Ala) | 7439 | BEST1 | ['TACGACTGGATTAGTATCCCACTGGYGTATA CACAGGTGAGGACTAGGCTG'] |
| 846 | NM_024312.4(GNPTAB): c.1120T > C (p.Phe374Leu) | 79158 | GNPTAB | ['TGTTTGTTGTTGTTAAAAGGATGTTYTCGA AATTTGAGCCACTTGCCTAC'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 847 | NM_000158.3(GBE1): c.671T > C (p.Leu224Pro) | 2632 | GBE1 | ['TATAAACATTTTACATGCAATGTACYACCAA GAATCAAAGGCCTTGGTAAG'] |
| 848 | NM_017890.4(VPS13B): c.8459T > C (p.Ile2820Thr) | 157680 | VPS13B | ['CAGGTGCCATCTTCAAACAGTTCCAYTATTT ATGTCTGGTGCACAGTTTTG'] |
| 849 | NM_000019.3(ACAT1): c.935T > C (p.Ile312Thr) | 38 | ACAT1 | ['CTCAATGTTACACCACTGGCAAGAAYAGTA GGTAAGGCCAGGCGAGGTGGC'] |
| 850 | NM_020184.3(CNNM4): c.971T > C (p.Leu324Pro) | 26504 | CNNM4 | ['CTCAGTTTTCCCATTAGCAAGCTCCYGGACT TTTTTCTGGGCCAGGAGATT'] |
| 851 | NM_001171507.2(MCFD2): c.407T > C (p.Ile136Thr) | 90411 | MCFD2 | ['GATGACAAGAACAATGATGGATACAYTGAC TATGCTGAATTTGCAAAATCA'] |
| 852 | NM_174936.3(PCSK9): c.646T > C (p.Phe216Leu) | 255738 | PCSK9 | ['TGTGCCCGAGGAGGACGGGACCCGCYTCCA CAGACAGGTAAGCACGGCCGT'] |
| 853 | NM_000419.3(ITGA2B): c.1787T > C (p.Ile596Thr) | 3674 | ITGA2B | ['GACTTCCGGGACAAGCTGAGCCCCAYTGTG CTCAGCCTCAATGTGTCCCTA'] |
| 854 | NM_000419.3(ITGA2B): c.641T > C (p.Leu214Pro) | 3674 | ITGA2B | ['CCCTTCCAGGCCGGAGAGCTGGTGCYTGGG GCTCCTGGCGGCTATTATTTC'] |
| 855 | NM_004817.3(TJP2): c.143T > C (p.Val48Ala) | 9414 | TJP2 | ['TCCAAAAGAGGATTTGGAATTGCAGYGTCC GGAGGCAGAGACAACCCCCAC'] |
| 856 | NM_173477.4(1JSH1G): c.143T > C (p.Leu48Pro) | 124590 | USH1G | ['GCCTACCATGGCAACCTCGAGTCGCYGCGTC TCATTGTGAGCCGCGGGTGA'] |
| 857 | NM_000271.4(NPC1): c.3182T > C (p.Ile1061Thr) | 4864 | NPC1 | ['GACGCTCTGAAGAAAGCCCGACTTAYAGCC AGTAATGTCACCGAAACCATG'] |
| 858 | NM_000271.4(NPC1): c.1133T > C (p.Val378Ala) | 4864 | NPC1 | ['TTTGTCCGGGTCACAACCAATCCAGYTGACC TCTGGTCAGCCCCCAGCAGC'] |
| 859 | NM_000271.4(NPC1): c.337T > C (p.Cys113Arg) | 4864 | NPC1 | ['ACTGAACCTGTTTTGTGAGCTGACAYGTAGC CCTCGACAGAGTCAGTTTTT'] |
| 860 | NM_000543.4(SMPD1): c.911T > C (p.Leu304Pro) | 6609 | SMPD1 | ['CGGGCCCTGACCACCGTCACAGCACYTGTG AGGAAGTTCCTGGGGCCAGTG'] |
| 861 | NM_000226.3(KRT9): c.503T > C (p.Leu168Ser) | 3857 | KRT9 | [CTCAATTCTCGGCTGGCCTCTTACTYGGATA AGGTGCAGGCTCTAGAGGAG'] |
| 862 | NM_000226.3(KRT9): c.470T > C (p.Met157Thr) | 3857 | KRT9 | ['CTGACTGCTAATGAGAAGAGCACCANGCAG GAACTCAATTCTCGGCTGGCC'] |
| 863 | NM_000051.3(ATM): c.7967T > C (p.Leu2656Pro) | −1 | — | ['CCAGCAGACCAGCCAATTACTAAACYTAAG AATTTAGAAGATGTTGTTGTC'] |
| 864 | NM_000487.5(ARSA): c.410T > C (p.Leu137Pro) | 410 | ARSA | ['GGGGTGGGGCCTGAGGGGGCCTTCCYGCCC CCCCATCAGGGCTTCCATCGA'] |
| 865 | NM_017653.3(DYM): c.1624T > C (p.Cys542Arg) | 54808 | DYM | ['AATGATGTTAGAGATCATCAACTCCYGCCTG ACAAATTCCCTTCACCACAA'] |
| 866 | NM_016038.2(SBDS): c.258 + 2T > C | 51119 | SBDS | ['GACCAAACTGAAATCTGTAAGCAGGYGGGT AACAGCTGCAGCATAGCTAAC'] |
| 867 | NM_001079802.1(FKTN): c.527T > C (p.Phe176Ser) | 2218 | FKTN | ['ACTCATGCGATCCACTTGGTAGTCTYTCATG AGAGGAGTGGCAACTACCTC'] |
| 868 | NM_013382.5(POMT2): c.2242T > C (p.Trp748Arg) | 29954 | POMT2 | ['GGCAGGACTAAGGTGGCTGGACTCAYGGGA CTTTTGAGGCCACTGCAAAGA'] |
| 869 | NM_024529.4(CDC73): c.191T > C (p.Leu64Pro) | 79577 | CDC73 | ['ACATTGGATTCCATTTTATTTCTACYTAATA ACGTGCACCTTTCTCATCCT'] |
| 870 | NM_000268.3(NF2): c.1079T > C (p.Leu360Pro) | 4771 | NF2 | ['ACGAGGGATGAGTTGGAGAGGAGGCYGCTG CAGATGAAAGAAGAAGCAACA'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 871 | NM_000268.3(NF2): c.1604T > C (p.Leu535Pro) | 4771 | NF2 | ['GAATACATGGAAAAGAGCAAGCATCYGCAG GAGCAGCTCAATGAACTCAAG'] |
| 872 | NM_000268.3(NF2): c.185T > C (p.Phe62Ser) | 4771 | NF2 | ['CTGGGGCTCCGAGAAACCTGGTTCTYTGGAC TGCAGTACACAATCAAGGAC'] |
| 873 | NM_139248.2(LIPH): c.322T > C (p.Trp108Arg) | 200879 | LIPH | ['AGACATGAACGTAGTTGTTGTTGATYGGAAT CGAGGAGCTACAACTTTAAT'] |
| 874 | NM_015102.4(NPHP4): c.2972T > C (p.Phe991Ser) | 261734 | NPHP4 | ['GCCACGCTGGGGGTCGCCGAGTTCTYTGAGT TTGTGCTTAAGAACCCCCAC'] |
| 875 | NM_024105.3(ALG12): c.473T > C (p.Leu158Pro) | 79087 | ALG12 | ['ACCCTCCCGCACTGTCTTGCAGTCCYGCTGG CCCTCGCGGCCTGGCTGCGG'] |
| 876 | NM_000280.4(PAX6): c.773T > C (p.Phe258Ser) | 5080 | PAX6 | ['GTCCCACCTGATTTCCAGGTATGGTYTTCTA ATCGAAGGGCCAAATGGAGA'] |
| 877 | NM_024426.4(WT1): c.1351T > C (p.Phe451Leu) | 7490 | WT1 | ['CTCTGTCCATTTAGGTGTGAAACCAYTCCAG TGTAAAACTTGTCAGCGAAA'] |
| 878 | NM_024426.4(WT1): c.1378T > C (p.Phe460Leu) | 7490 | WT1 | ['CCAGTGTAAAACTTGTCAGCGAAAGYTCTCC CGGTCCGACCACCTGAAGAC'] |
| 879 | NM_005957.4(MTHFR): c.968T > C (p.Leu323Pro) | 4524 | MTHFR | ['GTGCCAGGCCTCCACTTCTACACCCYCAACC GCGAGATGGCTACCACAGAG'] |
| 880 | NM_016247.3(IMPG2): c.370T > C (p.Phe124Leu) | 50939 | IMPG2 | ['TCACGCCCAGGAAGTCGATCCCAAARAGTC CTGAAGGCTTCCCAGACAGCT'] |
| 881 | NM_002225.3(IVD): c.134T > C (p.Leu45Pro) | 3712 | IVD | ['CCCGTGGACGATGCAATCAATGGGCYAAGC GAGGAGCAGAGGCAGGTGAGG'] |
| 882 | NM_001127328.2(ACADM): c.1136T > C (p.Ile379Thr) | 34 | ACADM | ['CAGTTAGCTACTGATGCTGTGCAGAYACTTG GAGGCAATGGATTTAATACA'] |
| 883 | NM_001127328.2(ACADM): c.742T > C (p.Cys248Arg) | 34 | ACADM | ['TTAGGAATTAAACATGGGCCAGCGAYGTTC AGATACTAGAGGAATTGTCTT'] |
| 884 | NM_000016.5(ACADM): c.199T > C (p.Tyr67His) | 34 | ACADM | ['GGAAATCATCCCAGTGGCTGCAGAAYATGA TAAAACTGGTGAAGTAGGTAT'] |
| 885 | NM_000155.3(GALT): c.221T > C (p.Leu74Pro) | 2592 | GALT | ['CCCCGCCATGACCCTCTCAACCCTCBGTGTC CTGGGGCCATCCGAGCCAAC'] |
| 886 | NM_000155.3(GALT): c.512T > C (p.Phe171Ser) | 2592 | GALT | ['CTCCGTATCCCTATCTGATAGATCTYTGAAA ACAAAGGTGCCATGATGGGC'] |
| 887 | NM_000155.3(GALT): c.580T > C (p.Phe194Leu) | 2592 | GALT | ['CCCTTGACAGGTATGGGCCAGCAGTYTCCTG CCAGATATTGCCCAGCGTGA'] |
| 888 | NM_000250.1(MPO): c.752T > C (p.Met251Thr) | 4353 | MPO | ['ACTCCGGACCAGGAGCGCTCACTCAYGTTC ATGCAATGGGGCCAGCTGTTG'] |
| 889 | NM_020247.4(ADCK3): c.1398 + 2T > C | 56997 | ADCK3 | ['CTCAGCCAGGAGATTCGGAACGAGGYTTGT CTGTGCCAGCAGACAGGTGGG'] |
| 890 | NM_000229.1(LCAT): c.508T > C (p.Trp170Arg) | 3931 | LCAT | ['GACTGTGCGCGCCGCCCCCTATGACYGGCG GCTGGAGCCCGGTGAGTGTCT'] |
| 891 | NM_000229.1(LCAT): c.698T > C (p.Leu233Pro) | 3931 | LCAT | ['CGCTTTATTGATGGCTTCATCTCTCYTGGGG CTCCCTGGGGTGGCTCCATC'] |
| 892 | NM_000229.1(LCAT): c.524-22T > C | 3931 | LCAT | ['CAGGTGCCCCAGACCCCAGCTGCCCYGACC CCTTCCACCCGCTGCAGGCCA'] |
| 893 | NM_000403.3(GALE): c.548T > C (p.Leu183Pro) | 2582 | GALE | ['CCACAGACTTGAACGCAGTGCTGCYGCGC TATTTCAACCCCACAGGTGCC'] |
| 894 | NM_000527.4(LDLR): c.694 + 2T > C | 3949 | LDLR | ['ACAAATCTGACGAGGAAAACTGCGGYATGG GCGGGGCCAGGGTGGGGCGG'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 895 | NM_000375.2(UROS): c.217T > C (p.Cys73Arg) | 7390 | UROS | ['CAGAGCAGTGGAAGCAGCAGAGTTAYGTTT GGAGCAAAACAATAAAACTGA'] |
| 896 | NM_000375.2(UROS): c.-26 - 177T > C | 7390 | UROS | ['GCTAACATGCTCTTTCTTGGCCTTAYCAGTG ACAGGGGTCTTCAGAAAGAA'] |
| 897 | NM_000372.4(TYR): c.265T > C (p.Cys89Arg) | 7299 | TYR | ['GCCTTCCGTCTTTTATAATAGGACCYGCCAG TGCTCTGGCAACTTCATGGG'] |
| 898 | NM_000017.3(ACADS): c.529T > C (p.Trp177Arg) | 35 | ACADS | ['CACCGCCCGGGCCGAGGGCGACTCABGGGT TCTGAATGGAACCAAAGCCTG'] |
| 899 | NM_000053.3(ATP7B): c.3443T > C (p.Ile1148Thr) | 540 | ATP7B | ['GCGCCTCAGCCACTCACGGTTTCCARTCAGC ACAGAGAAGGTCTGGGGGAC'] |
| 900 | NM_000053.3(ATP7B): c.2123T > C (pLeu708Pro) | 540 | ATP7B | ['GCCTTCACTGTCCTTGTCTTTCAGCYCCTCG GTGGGTGGTACTTCTACGTT'] |
| 901 | NM_000520.4(HEXA): c.1453T > C (p.Trp485Arg) | 3073 | HEXA | ['AGCAGGGGCTGTTGCCGAAAGGCTGYGGAG CAACAAGTTGACATCTGACCT'] |
| 902 | NM_000520.4(HEXA): c.632T > C (p.Phe211Ser) | 3073 | HEXA | ['TGGCATCTGGTAGATGATCCTTCCTYCCCAT ATGAGAGCTTCACTTTTCCA'] |
| 903 | NM_000520.4(HEXA): c.538T > C (p.Tyr180His) | 3073 | HEXA | ['CTTGCTGTTGGATACATCTCGCCATYACCTG CCACTCTCTAGCATCCTGGA'] |
| 904 | NM_016335.4(PRODH): c.1322T > C (p.Leu441Pro) | 5625 | PRODH | ['CTGGGCCAGGTATGCGCCCCGCACCRGCTTG GCCCCAAAACACCAGCCCTC'] |
| 905 | NM_000152.3(GAA): c.953T > C (p.Met318Thr) | 2548 | GAA | ['GTGTTCCTGCTAAACAGCAATGCCAYGGGT AAGCTGCCCGCCGCCCAGCGC'] |
| 906 | NM_012213.2(MLYCD): c.119T > C (p.Met40Thr) | 23417 | MLYCD | ['GCGGCCGGCGCCCTGGAGCGGGCCAYGGAC GAGCTGCTGCGCCGCGCGGTG'] |
| 907 | NM_012464.4(TLL1): c.713T > C (p.Val238Ala) | 7092 | TLL1 | ['AAGAACTGTGATAAATTTGGGATTGYTGTTC ATGAATTGGGTCATGTGATA'] |
| 908 | NM_000112.3(SLC26A2): c.-26 + 2T > C | 1836 | SLC26A2 | ['CCTGCAGCGGCCCGGACCCGAGAGGYGAGA AGAGGGAAGCGGACCAGGGAA'] |
| 909 | NM_138691.2(TMC1): c.1543T > C (p.Cys515Arg) | 117531 | TMC1 | ['CCCTGCAGATGTACCTCGAGGACCTYGCTGG GAAACAATGGTGGGACAGGT'] |
| 910 | NM_138694.3(PKHD1): c.10658T > C (p.Ile3553Thr) | 5314 | PKHD1 | ['GTTGTCCTACAAGGAGAGGAGCCCAYTGAA ATACGCTCAGGTGTTTCCATT'] |
| 911 | NM_001034116.1(EIF2B4): c.1393T > C (p.Cys465Arg) | 8890 | EIF2B4 | ['TGCAGATGACCCTGATGATCTGCAAYGTAA GCGGGGAGAACATGTTGCGCT'] |
| 912 | NM_001034116.1(EIF2B4): c.1465T > C (p.Tyr489His) | 8890 | EIF2B4 | ['ATCCCTACGGTTGTTGAATCTAGTCYATGAT GTGACTCCCCCAGAGCTTGT'] |
| 913 | NM_018960.4(GNMT): c.149T > C (p.Leu50Pro) | 27232 | GNMT | ['ACCGCCGAGTACAAGGCATGGCTGCYTGGG CTGCTGCGCCAGCACGGCTGC'] |
| 914 | NM_181457.3(PAX3): c.268T > C (p.Tyr90His) | 5077 | PAX3 | ['CTGCGTCTCCAAGATCCTGTGCAGGYACCAG GAGACTGGCTCCATACGTCC'] |
| 915 | NM_024301.4(FKRP): c.899T > C (p.Val300Ala) | 79147 | FKRP | ['GAGACCACGCGCTGCTTCGGAACCGYGGTG GGCGACACGCCCGCCTACCTC'] |
| 916 | NM_021020.3(LZTS1): c.85T > C (p.Ser29Pro) | 11178 | LZTS1 | ['TTCGCAGTACAAGCTGCGCAAGTCCYCCCAC CTCAAGAAGCTCAACCGGTA'] |
| 917 | NM_005857.4(ZMPSTE24): c.1018T > C (p.Trp340Arg) | 10269 | ZMPSTE24 | ['TGTACTAGGCCATGAACTGGGCACYGGAA GTTGGGACATACAGTCAAAAA'] |
| 918 | NM_017838.3(NHP2): c.415T > C (p.Tyr139His) | 55651 | NHP2 | ['GCCCCATGAGGAGTACCAGGAGGCTYACGA TGAGTGCCTGGAGGAGGTGCA'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 919 | NM_000157.3(GBA): c.1448T > C (p.Leu483Pro) | 2629 | GBA | ['GGGATGCATCAGTGCCACTGCGTCCVGGTC GTTCTTCTGACTGGCAACCAG'] |
| 920 | NM_001005741.2(GBA): c.751T > C (p.Tyr251His) | 2629 | GBA | ['CATCTACCACCAGACCTGGGCCAGAYACTTT GTGAAGTAAGGGATCAGCAA'] |
| 921 | NM_001243133.1(NLRP3): c.1718T > C (p.Phe573Ser) | 114548 | NLRP3 | ['AAATTCGAAAAGGGGTATTTGATTTYTGTTG TACGTTTCCTCTTTGGCCTG'] |
| 922 | NM_001243133.1(NLRP3): c.926T > C (p.Phe309Ser) | 114548 | NLRP3 | ['GGCTTCGATGAGCTGCAAGGTGCCTYTGAC GAGCACATAGGACCGCTCTGC'] |
| 923 | NM_001243133.1(NLRP3): c.1058T > C (p.Leu353Pro) | 114548 | NLRP3 | ['CTCATCACCACGAGACCTGTGGCCCYGGAG AAACTGCAGCACTTGCTGGAC'] |
| 924 | NM_057176.2(BSND): c.35T > C (p.Ile12Thr) | 7809 | BSND | ['GAGAAGACCTTCCGGATCGGCTTCAYTGTGC TGGGGCTTTTCCTGCTGGCC'] |
| 925 | NM_001195794.1(CLRN1): c.488T > C (p.Leu163Pro) | 7401 | CLRN1 | ['TCTGTTGCAGGCTCCTGTGGCTGTCYTGTCA TGATATTGTTTGCCTCTGAA'] |
| 926 | NM_175073.2(APTX): c.668T > C (p.Leu223Pro) | 54840 | APTX | ['GCTGTGGCCAGGGAACACCTTGAACYCCTT AAGCATATGCACACTGTGGGG'] |
| 927 | NM_020365.4(EIF2B3): c.1037T > C (p.Ile346Thr) | 8891 | EIF2B3 | ['CCACCAGTCCATTCGTCAGCCCAGAYTGTCA GCAAACACCTGGTAAGTGCT'] |
| 928 | NM_031433.3(MFRP): c.545T > C (p.Ile182Thr) | -1 | — | ['ATCCAGGTGGCCACAGACCATGCAAYACAG CTCAAGATCGAAGCCCTCAGC'] |
| 929 | NM_016180.4(SLC45A2): c.1082T > C (p.Leu361Pro) | 51151 | SLC45A2 | ['AGTGCACACAACTCCACAGAGTTTCYCATCT ACGAAAGAGGAGTCGAGGTT'] |
| 930 | NM_006005.3(VVFS1): c.2486T > C (p.Leu829Pro) | 7466 | WFS1 | ['AGCCTCATCGAGTTCAGCACCATCCYGGAG GGCCGCCTGGGCAGCAAGTGG'] |
| 931 | NM_024960.4(PANK2): c.178T > C (p.Ser60Pro) | 80025 | PANK2 | ['GATCAAAGGAATTTTATACATTGACYCAGTC GGATTCAATGGACGGTCACA'] |
| 932 | NM_024960.4(PANK2): c.437T > C (p.Met146Thr) | 80025 | PANK2 | ['ACCACTTTTGAAGAAGCTCTTGAAAYGGCAT CTCGTGGAGATAGCACCAAA'] |
| 933 | NM_020427.2(SLURP1): c.43T > C (p.Trp15Arg) | 57152 | SLURP1 | ['TGTGCAGCTGCTGCTCGTGGCAGCCYGGAG CATGGGCTGTGGTGAGTGGGC'] |
| 934 | NM_020427.2(SLURP1): c.229T > C (p.Cys77Arg) | 57152 | SLURP1 | ['GGTGACCCGCTCCTGCTCCAGCTCCYGTGTG GCCACCGACCCCGACAGCAT'] |
| 935 | NM_021830.4(C10orf2): c.1142T > C (p.Leu381Pro) | 56652 | C10orf2 | ['CTTCGGGAGGAGGTGCTAGGAGAACBGTCA AATGTGGAGCAAGCAGCTGGC'] |
| 936 | NM_001033855.2(DCLRE1C): c. 2T > C (p.Met1Thr) | 64421 | DCLRE1C | ['CCGGACTCTGGGATCGGCGGCGCTAYGAGT TCTTTCGAGGGGCAGATGGCC'] |
| 937 | NM_153741.1(DPM3): c.254T > C (p.Leu85Ser) | 54344 | DPM3 | ['CAGATACAGGAGGCCCGAGCCGACTYAGCC CGCAGGGGCTGCGCTTCTGA'] |
| 938 | NM_000441.1(SLC26A4): c.707T > C (p.Leu236Pro) | 5172 | SLC26A4 | ['GCCTTCCAAGTGCTGGTCTCACAGCYAAAG ATTGTCCTCAATGTTTCAACC'] |
| 939 | NM_000441.1(SLC26A4): c.1588T > C (p.Tyr530His) | 5172 | SLC26A4 | ['TGGAAGCATCCCTAGCACAGATATCYACAA AAGTACCAAGAATTACAAAAA'] |
| 940 | NM_000441.1(SLC26A4): c.-103T > C | -1 | — | [CTTTCCCTTCGACCAAGGTGTCTGTYGCTCC GTAAATAAACGTCCCACTG'] |
| 941 | NM_000441.1(SLC26A4): c.1003T > C (p.Phe335Leu) | 5172 | SLC26A4 | ['ATTTTTCACTTAAAAACTCACTAGGHTTTTG CCTCCTGAACTTCCACCTGT'] |
| 942 | NM_022458.3(LMBR1): c.423 + 4842T > C | 64327 | LMBR1 | ['AACAAAGATTTTTTAATATGTTTCYATCCT GTGTCACAGTTTGAAATTGT'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 943 | NM_022458.3(LMBR1): c.423 + 4808T > C | 64327 | LMBR1 | ['AAAGCTGAGCAACATGACAGCACAAYAGAG GAGGAACAAAGATTTTTTAA'] |
| 944 | NM_145693.2(LPIN1): c.1441 + 2T > C | 23175 | LPIN1 | ['GCGACCACCGGGAGATCACGAAAGGYACCG CGGGCCTCGCGCGGGCGCCCT'] |
| 945 | NM_022124.5(CDH23): c.5663T > C (p.Phe1888Ser) | 64072 | CDH23 | ['AGTGGCTGCAATGCACGCCTCACCTYCAAC ATCACTGCGGGCAACCGCGAG'] |
| 946 | NM_153212.2(GJB4): c.409T > C (p.Phe137Leu) | 127534 | GJB4 | ['GTGGACGTACTTGCTGAGCCTCATCYTCAAG GCCGCCGTGGATGCTGGCTT'] |
| 947 | NM_021044.2(DHH): c.2T > C (p.Met1Thr) | 50846 | DHH | ['TTTTGGCCGAGGTCCGCTGTATCCAYGGCTC TCCTGACCAATCTACTGCCC'] |
| 948 | NM_021044.2(DHH): c.485T > C (p.Leu162Pro) | 50846 | DHH | ['CGCGACCGCAACAAGTATGGGTTGCYGGCG CGCCTCGCAGTGGAAGCCGGC'] |
| 949 | NM_020638.2(FGF23): c.287T > C (p.Met96Thr) | 8074 | FGF23 | ['GTGATGAGCAGAAGATACCTCTGCAYGGAT TTCAGAGGCAACATTTTTGGA'] |
| 950 | NM_022041.3(GAN): c.1268T > C (p.Ile423Thr) | 8139 | GAN | ['TGCTATGCAGCTATGAAAAAGAAAAYCTAC GCCATGGGTGGAGGCTCCTAC'] |
| 951 | NM_015665.5(AAAS): c.787T > C (p.Ser263Pro) | 8086 | AAAS | ['CAGTGGGGGCGGCTGCTCTCAGCTYCACC CGTGGATGCTGCTATCCGGGT'] |
| 952 | NM_021615.4(CHST6): c.827T > C (p.Leu276Pro) | 4166 | CHST6 | ['TACCGCCTGGTGCGCTTCGAGGACCYGGCG CGGGAGCCGCTGGCAGAAATC'] |
| 953 | NM_000368.4(TSC1): c.539T > C (p.Leu180Pro) | 7248 | TSC1 | ['GTGGCGGAAGTCTATCTCGTCCATCYCCATG CCAGTGTGTACGCACTCTTT'] |
| 954 | NM_020661.2(AICDA): c.238T > C (p.Trp80Arg) | 57379 | AICDA | ['CCCTGGCCGCTGCTACCGCGTCACCYGGTTC ACCTCCTGGAGCCCCTGCTA'] |
| 955 | NM_020661.2(AICDA): c.317T > C (p.Leu106Pro) | 57379 | AICDA | ['CTGCGAGGGAACCCCAACCTCAGTCYGAGG ATCTTCACCGCGCGCCTCTAC'] |
| 956 | NM_020661.2(AICDA): c.452T > C (p.Phe151Ser) | 57379 | AICDA | ['GATTATTTTTACTGCTGGAATACTTYTGTAG AAAACCACGAAAGAACTTTC'] |
| 957 | NM_020632.2(ATP6V0A4): c. 1739T > C (p.Met580Thr) | 50617 | ATP6V0A4 | ['ATCATTCTGCAATTTATCCCTGAGAYGATTT TTATCCTGTGTCTGTTTGGA'] |
| 958 | NM_054027.4(ANKH): c.143T > C (p.Met48Thr) | 56172 | ANKH | ['GCTGTCAAGGAGGATGCAGTCGAGAYGCTG GCCAGCTACGGGCTGGCGTAC'] |
| 959 | NM_054027.4(ANKH): c.1015T > C (p.Cys339Arg) | 56172 | ANKH | ['TGTTTGATGTCTTTCTCCCCAGCTCYGTTTCG TGATGTTTTGGACACCCAA'] |
| 960 | NM_054027.4(ANKH): c.1172T > C (p.Leu391Pro) | -1 | — | ['GTGAGGGCGCATCTCACCGGGTGGCYGATG ACACTGAAGAAAACCTTCGTC'] |
| 961 | NM_016373.3(WWOX): c.872T > C (p.Leu291Pro) | 51741 | WWOX | ['ACAAAAACGACTATTGGGCGATGCYGGCT TATAACAGGTCCAAGCTCTGC'] |
| 962 | NM_021102.3(SPINT2): c.337 + 2T > C | 10653 | SPINT2 | ['CAGCGGATTCCTCTGTCCCAAGTGGYAGGTT CTTAAAGAGACCCGCGATGG'] |
| 963 | NM_014588.5(VSX1): c.50T > C (p.Leu17Pro) | 30813 | VSX1 | ['GACGGGCGCACTAGCAGCAGGGCGCYGGTG CCTGGCGGTTCCCCTAGGGGC'] |
| 964 | NM_006946.2(SPTBN2): c.758T > C (p.Leu253Pro) | 6712 | SPTBN2 | ['GAAAGGAACTGGGACTTACCAAGCYGCTG GATCCCGAAGGTGGGGCCAGA'] |
| 965 | NM_012452.2(TNFRSF13B): c. 310T > C (p.Cys104Arg) | 23495 | TNFRSF13B | ['GCACCCTAAGCAATGTGCATACTTCYGTGAG AACACCTCAGGAGCCCAGT'] |
| 966 | NM_170784.2(MKKS): c.830T > C (p.Leu277Pro) | 8195 | MKKS | ['GAAAATGCAGTCTTGGACCAGCTGCYTAAC CTAGGAAGGCAGCTAATCAGT'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 967 | NM_015717.4(CD207): c.790T > C (p.Trp264Arg) | 50489 | CD207 | ['AATGGCGTGTCATCCACCCAGGACCRGTCCC CTTCCATCCCTGCTTTAGTC'] |
| 968 | NM_153717.2(EVC): c.919T > C (p.Ser307Pro) | 2121 | EVC | ['TGTGGAAAAGAAGGAGAGAGAATACYCTGA ACAGCTAATCGATAATGTGCG'] |
| 969 | NM_014384.2(ACAD8): c.455T > C (p.Met152Thr) | 27034 | ACAD8 | ['AAATTTTGCCCACCGCTCTGTACCAYGGAGA AGTTTGCTTCCTACTGCCCTC'] |
| 970 | NM_004924.4(ACTN4): c.784T > C (p.Ser262Pro) | 81 | ACTN4 | ['CGAGAAGGCCATAATGACCTATGTGYCCAG CTTCTACCATGCCTTTTCAGG'] |
| 971 | NM_005097.3(LGI1): c.136T > C (p.Cys46Arg) | 9211 | LGI1 | ['AGCGAAGCCAAAATGCCCTGCCGTGYGTAC TTGTACCAAAGATAATGCTTT'] |
| 972 | NM_005097.3(LGI1): c.695T > C (p.Leu232Pro) | 9211 | LGI1 | ['GCAGAATTTGCAAAGTCTCAAGACCYGCCTT ATCAATCATTGTCCATAGAC'] |
| 973 | NM_006329.3(FBLN5): c.679T > C (p.Ser227Pro) | 10516 | FBLN5 | ['GCAAACCTGCGTCAACACCTACGGCYCTTTC ATCTGCCGCTGTGACCCAGG'] |
| 974 | NM_006329.3(FBLN5): c.506T > C (p.Ile169Thr) | 10516 | FBLN5 | ['TTGCTTGCATTTCTGTTTCCAGACAYTGATG AATGTCGCTATGGTTACTGC'] |
| 975 | NM_013339.3(ALG6): c.1432T > C (p.Ser478Pro) | 29929 | ALG6 | ['GTTTTCTGTATTGGTGTGTTTTGTAYCTTGCT TGAACTTCCTGTTCTTCTT'] |
| 976 | NM_006899.3(IDH3B): c.395T > C (p.Leu132Pro) | 3420 | IDH3B | ['GAGCTAGCCTCCTATGATATGCGGCYGAGG TAGGTGGTCTGGGTGGGGTGA'] |
| 977 | NM_014363.5(SACS): c.5836T > C (p.Trp1946Arg) | 26278 | SACS | ['AATGGATTATACTTACTATGCAGTAYGGCCC GATCCTGATTTAGTTCATGA'] |
| 978 | NM_014363.5(SACS): c.9742T > C (p.Trp3248Arg) | 26278 | SACS | ['AAGTGAGTCTTGGCTTAAGAATGCAYGGCA TTTTATTAGTGAATCTGTAAG'] |
| 979 | NM_014363.5(SACS): c.3161T > C (p.Phe1054Ser) | 26278 | SACS | ['CAGATGGTATCAGCTGGTGAACTCTYTGACC CTGATATAGAAGTACTAAAG'] |
| 980 | NM_014324.5(AMACR): c.154T > C (p.Ser52Pro) | -1 | — | ['GAGCCGCTTGGGCCGGGGCAAGCGCYCGCT AGTGCTGGACCTGAAGCAGCC'] |
| 981 | NM_014324.5(AMACR): c.320T > C (p.Leu107Pro) | -1 | — | ['AATCAAGGCTTATTTATGCCAGGCYGAGTG GATTTGGCCAGTCAGGAAGC'] |
| 982 | NM_001040108.1(MLH3): c.3826T > C (p.Tlp1276Arg) | 27030 | MLH3 | ['GACAGAGGAACAAAGGAGACTCTTAYGGTC AGTACCACCATGAGAATGTGA'] |
| 983 | NM_014336.4(A1PL1): c.715T > C (p.Cys239Arg) | 23746 | AIPL1 | ['TACTCTGATCCTCAACTACTGCCAGYGCCTG CTGAAGAAGGAGGAGTACTA'] |
| 984 | NM_001001486.1(ATP2C1): c.1751T > C (p.Leu584Pro) | 27032 | ATP2C1 | ['CTCTCATTTGCTTTAGCCAGTCGTCYGGGAT TGTATTCCAAAACTTCCCAG'] |
| 985 | NM_007194.3(CHEK2): c.470T > C (p.Ile157Thr) | 11200 | CHEK2 | ['GAAGTGGGTCCTAAAAACTCTTACAYTGCAT ACATAGAAGATCACAGTGGC'] |
| 986 | NM_007255.2(B4GALT7): c.617T > C (pLeu206Pro) | 11285 | B4GALT7 | ['ACCTATGTCGGCGGCATCCTGCTGCYCTCCA AGCAGCACTACCGGCTGGTG'] |
| 987 | NM_000030.2(AGXT): c.613T > C (p.Ser205Pro) | 189 | AGXT | ['ATCTACAGGCATCGACATCCTGTACYCGGGC TCCCAGAAGGCCCTGAACGC'] |
| 988 | NM_000030.2(AGXT): c.731T > C (p.Ile244Thr) | 189 | AGXT | ['AAGCCCTTCTCCTTCTACCTGGACAYCAAGT GGCTGGCCAACTTCTGGGGC'] |
| 989 | NM_201253.2(CRB1): c.3122T > C (p.Met1041Thr) | 23418 | CRB1 | ['ACATGGCACGAAGTGACCCTTTCCAYGACA GACCCACTGTCCCAGACCTCC'] |
| 990 | NM_201253.2(CRB1): c.3541T > C (p.Cys1181Arg) | 23418 | CRB1 | ['ACACTGTGAACTCAACATCGATGAAYGCTTT TCAAACCCCTGTATCCATGG'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 991 | NM_005094.3(SLC27A4): c.739T > C (p.Ser247Pro) | 10999 | SLC27A4 | ['AGATAAACTGTTCTACATCTACACAYCCGGC ACCACAGGGCTGCCCAAGGC'] |
| 992 | NM_032551.4(KISS1R): c.443T > C (p.Leu148Ser) | 84634 | KISS1R | ['CGCTGGTACGTGACGGTGTTCCCGTYGCGCG CCCTGCACCGCCGCACGCCC'] |
| 993 | NM_032551.4(KISS1R): c.305T > C (p.Leu102Pro) | 84634 | KISS1R | ['TGCTGCGTCCCCTTCACGGCCCTGCYGTACC CGCTGCCCGGCTGGGTGCTG'] |
| 994 | NM_014270.4(SLC7A9): c.131T > C (p.Ile44Thr) | 11136 | SLC7A9 | ['ATCTCCATCATCGTGGGCACCATCAYTGGCT CTGGGATCTTCGTTTCCCCC'] |
| 995 | NM_003332.3(TYROBP): c.2T > C (p.Met1Thr) | 7305 | TYROBP | ['TGGTGTCCAGCAGCATCCGGCTTCAYGGGG GGACTTGAACCCTGCAGCAGG'] |
| 996 | NM_000843.3(GRM6): c.1214T > C (p.Ile405Thr) | -1 | — | ['CAGGAGGGCAAGGTGCAGTTTGTGAYTGAT GCGGTGTACGCCATTGCCCAC'] |
| 997 | NM_022336.3(EDAR): c.259T > C (p.Cys87Arg) | 10913 | EDAR | ['GTTTTCCAAAGGAGGCTACCAGATAYGCAG GCGTCACAAAGACTGTGAGGG'] |
| 998 | NM_003835.3(RGS9): c.895T > C (p.Trp299Arg) | 8787 | RGS9 | ['CCCAACCAAGATGCGAGTGGAACGAYGGGC CTTCAACTTCAGCGAATTGAT'] |
| 999 | NM_004870.3(MPDU1): c.356T > C (p.Leu119Pro) | 9526 | MPDU1 | ['CTCCAGACGATCACCATCTGCTTCCYGGTCA TGCACTACAGAGGACAGACT'] |
| 1000 | NM_004870.3(MPDU1): c.2T > C (p.Met1Thr) | 9526 | MPDU1 | ['ACTGGCGGAAGCTAGCTTTGCAATAYGGCG GCCGAGGCGGACGGACCGCTT'] |
| 1001 | NM_004870.3(MPDU1): c.221T > C (p.Leu74Ser) | 9526 | MPDU1 | ['CTGGGAGCCAAGAGTGCTGAAGGGTYGAGT CTCCAGTCTGTAATGCTGGAG'] |
| 1002 | NM_000334.4(SCN4A): c.2078T > C (p.Ile693Thr) | 6329 | SCN4A | ['ACGCTGAACATGCTCATCAAGATCAYTGGC AATTCAGTGGGGCGCTGGGT'] |
| 1003 | NM_006580.3(CLDN16): c.500T > C (p.Leu167Pro) | 10686 | CLDN16 | ['GCTGGGTTTGGATTCTCACCCTGCYCCTTG GTCTTGACTGCGTGAAATTC'] |
| 1004 | NM_006580.3(CLDN16): c.434T > C (p.Leu145Pro) | 10686 | CLDN16 | ['ATATGCCCTGGTCTTCCAGTGAAGCYGGTGG TAACTCGAGCGTTGATGATT'] |
| 1005 | NM_003907.2(EIF2B5): c.1882T > C (p.Trp628Arg) | 8893 | EIF2B5 | ['CTTTCTTCCATAGCTGCTAAAGGCCYGGAGC CCTGTTTTTAGGAACTACAT'] |
| 1006 | NM_183235.2(RAB27A): c.389T > C (p.Leu130Pro) | 5873 | RAB27A | ['TATTGTGAAAACCCAGATATAGTGCYGTGTG GAAACAAGAGTGATCTGGAG'] |
| 1007 | NM_001128227.2(GNE): c.2228T > C (p.Met743Thr) | 10020 | GNE | ['CCCGCCCTGCTGGGTGCTGCCAGCAYGGTTC TGGACTACACAACACGCAGG'] |
| 1008 | NM_004273.4(CHST3): c.776T > C (p.Leu259Pro) | 9469 | CHST3 | ['CGCTGCGGCCCCCTCAACGTGACGCYGGCC GCAGAGGCCTGCCGCCGCAAG'] |
| 1009 | NM_004273.4(CHST3): c.920T > C (p.Leu307Pro) | 9469 | CHST3 | ['CTGGTGCGCGACCCCCGGGCCGTGCYGGCC TCGCGCATGGTGGCCTTCGCC'] |
| 1010 | NM_004273.4(CHST3): c.857T > C (p.Leu286Pro) | 9469 | CHST3 | ['CGGCAGCTGGAGTTCCTGCAGCCGCYGGCC GAGGACCCCCGCCTGGACCTG'] |
| 1011 | NM_172201.1(KCNE2): c.161T > C (p.Met54Thr) | 9992 | KCNE2 | ['TTCTACTATGTCATCCTGTACCTCAYGGTGA TGATTGGAATGTTCTCTTTC'] |
| 1012 | NM_172201.1(KCNE2): c.170T > C (p.Ile57Thr) | 9992 | KCNE2 | ['GTCATCCTGTACCTCATGGTGATGAYTGGAA TGTTCTCTTTCATCATCGTG'] |
| 1013 | NM_172201.1(KCNE2): c.178T > C (p.Phe60Leu) | 9992 | KCNE2 | ['GTACCTCATGGTGATGATTGGAATGHTCTCT TCATCATCGTGGCCATCCT'] |
| 1014 | NM_001139.2(ALOX12B): c.1277T> > C (p.Leu426Pro) | 242 | ALOX12B | ['TCATCCTCCTTGCTCTCCCCACAGCYCCTCA TCCCCCATACCCGATACACC'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1015 | NM_003640.3(IKBKAP): c.2204 + 6T > C | 8518 | IKBKAP | ['ATTCGGAAGTGGTTGGACAAGTAAGYGCCA TTGTACTGTTTGCGACTAGTT'] |
| 1016 | NM_005413.3(SIX3): c.749T > C (p.Val250Ala) | 6496 | SIX3 | ['GCCACCGGCCTCACTCCCACACAAGYAGGC AACTGGTTTAAGAACCGGCGG'] |
| 1017 | NM_004820.3(CYP7B1): c.647T > C (p.Phe216Ser) | 9420 | CYP7B1 | [HITATTAGTGAGCTAAGAGATGATTYTTTAA AATTTGATGACAAGTTTGCA'] |
| 1018 | NM_194248.2(OTOF): c.3032T > C (p.Leu1011Pro) | 9381 | OTOF | 'CTGTGTCCCACCTGGGACCAGATGCYGGTGT TCGACAACCTGGAGCTCTAT] |
| 1019 | NM_194248.2(OTOF): c.1544T > C (p.Ile515Thr) | 9381 | OTOF | ['GACGTGGCCATCGGCACCCACTTCAYTGACC TGCGCAAGATTTCTAATGAC'] |
| 1020 | NM_004737.4(LARGE): c.1483T > C (p.Trp495Arg) | 9215 | LARGE | ['GATGCTGGAGGCCATCTGCAAGCACYGGGA GGGGCCCATCAGCCTGGCCCT'] |
| 1021 | NM_002420.5(TRPM1): c.296T > C (p.Leu99Pro) | 4308 | TRPM1 | ['GAGGCCTCCATGCACAGATATTAAGRGCTTG GGGAGTTCCAGCTGCCAATC'] |
| 1022 | NM_004700.3(KCNQ4): c.842T > C (p.Leu281Ser) | 9132 | KCNQ4 | ['ACCTGTTTGTGTCTCCAGATTACATYGACAA CCATCGGCTATGGTGACAAG'] |
| 1023 | NM_003839.3(TNFRSF11A): c. 523T > C (p.Cys175Arg) | 8792 | TNFRSF11 | ['ACTGAACCACCTTTTCCCCCACAGCYGTACC TTCCTTGGAAAGAGAGTAGA'] |
| 1024 | NM_030761.4(WNT4): c.35T > C (p.Leu12Pro) | 54361 | WNT4 | ['CGCTCGTGCCTGCGTTCGCTGCGCCYCCTCG TCTTCGCCGTCTTCTCAGCC'] |
| 1025 | NM_000050.4(ASS1): c.535T > C (p.Trp179Arg) | 445 | ASS1 | ['CATCCCGGTCACTCCCAAGAACCCGYGGAG CATGGATGAGAACCCTCATGCA'] |
| 1026 | NM_002977.3(SCN9A): c.2543T > C (p.Ile848Thr) | -1 | — | ['ACATTGAACATGCTGATTAAGATCAYTGGTA ACTCAGTAGGGGCTCTAGGT'] |
| 1027 | NM_002977.3(SCN9A): c.4382T > C (p.Ile1461Thr) | -1 | — | ['TTTCTTTACCTTGGAGGTCAAGACAYCTTTA TGACAGAAGAACAGAAGAAA'] |
| 1028 | NM_002977.3(SCN9A): c.647T > C (p.Phe216Ser) | 6335 | SCN9A | ['GGCAATGTTTCAGCTCTTCGAACTTYCAGAG TATTGAGAGCTTTGAAAACT'] |
| 1029 | NM_003880.3(WISP3): c.232T > C (p.Cys78Arg) | 8838 | WISP3 | ['AGATGGCTGTGGATGCTGTAAAATCYGTGC CAAGCAACCAGGGGAAATCTG'] |
| 1030 | NM_003880.3(WISP3): c.1000T > C (p.Ser334Pro) | 8838 | WISP3 | ['TAAATGGAAGATGCTGTGGATTACAYCTTGT GTGTGTCAGAGAAACTGCAG'] |
| 1031 | NM_001457.3(FLNB): c.703T > C (p.Ser235Pro) | 2317 | FLNB | ['CGAGCACTCAGTTATGACTTACCTGYCCCAG TTCCCCAAAGCCAAGCTCAA'] |
| 1032 - 1036 | NM_003060.3(SLC22A5): c.1051T > C (p.Trp351Arg) | 6584 | SLC22A5 | ['GATTTGTTACTGACAAGGCCTAGGGNAAGTT TTCACAGCCTAAAACACAGT', 'TACAAGACCTAAGTTCCAAGAAGCARCAGTC CCACAACATTCTGGATCTGC', 'GGTCACCATCATGTCCATAATGCTGYGGTAT GTAAAAGAGACCTGCCTGAG', 'ATGCCTCAGACAAAATTCAAAGCCTRTGTCA TCAGAGAGTGAAAAGGATAT', 'GGCTGTTGTGGGAAATATGGACTCTYGTGGG GAATCTCTCCAGATCTTAAG'] |
| 1037 | NM_000369.2(TSHR): c.1891T > C (p.Phe631Leu) | 7253 | TSHR | ['TGCCAAGAGGATGGCTGTGTTGATCYTCACC GACTTCATATGCATGGCCCC'] |
| 1038 | NM_000369.2(TSHR): c.1358T > C (p.Met453Thr) | 7253 | TSHR | ['AAACTGAACGTCCCCCGCTTTCTCAYGTGCA ACCTGGCCTTTGCGGATTTC'] |
| 1039 | NM_000369.2(TSHR): c.1526T > C (p.Val509Ala) | 7253 | TSHR | ['ACTGTCTTTGCAAGCGAGTTATCGGYGTATA CGCTGACGGTCATCACCCTG'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1040 | NM_000369.2(TSHR): c.1798T > C (p.Cys600Arg) | 7253 | TSHR | ['AGTTGCCTTCGTCATCGTCTGCTGCYGTTAT GTGAAGATCTACATCACAGT'] |
| 1041 | NM_000369.2(TSHR): c.1400T > C (p.Leu467Pro) | 7253 | TSHR | ['GCGGATTTCTGCATGGGGATGTACCYGCTCC TCATCGCCTCTGTAGACCTC'] |
| 1042 | NM_001003722.1(GLE1): c.2051T > C (p.Ile684Thr) | 2733 | GLE1 | ['CAGAAATGTTTGCAACACAAGGACAYTCCT GTCCCCAAGGGCTTTCTGACT'] |
| 1043 | NM_024009.2(GJB3): c.101T > C (p.Leu34Pro) | 2707 | GJB3 | ['TCCGTGGTGTTCGTCTTCCGGGTGCYGGTAT ACGTGGTGGCTGCAGAGCGC'] |
| 1044 | NM_001080463.1(DYNC2H1): c.3719T > C (p.Ile1240Thr) | 79659 | DYNC2H1 | ['GATTTGCTCAGAGTAGCTGATACAAYTGTAG CCAAAGCTGCCGACCTTAAA'] |
| 1045 | NM_018129.3(PNPO): c.784T > C (p.Ter262Gln) | 55163 | PNPO | [CTGGCTCTATGAGAGACTTGCACCTYAACTC TGGGACCTGCTGGCCCAGAG'] |
| 1046 | NM_003722.4(TP63): c.1033T > C (p.Cys345Arg) | 8626 | TP63 | ['CCGACGCTGCTTTGAGGCCCGGATCYGTGCT TGCCCAGGAAGAGACAGGAA'] |
| 1047 | NM_003722.4(TP63): c.1646T > C (p.Ile549Thr) | 8626 | TP63 | ['CCTCCGTATCCCACAGATTGCAGCAYTGTCA GGTGAGTCCACAGCATGTGC'] |
| 1048 | NM_003722.4(TP63): c.1738T > C (p.Ser580Pro) | 8626 | TP63 | ['CACCATCTATCAGATTGAGCATTACBCCATG GATGTAAGTAACTGTTAGAC'] |
| 1049 | NM_004086.2(COCH): c.349T > C (p.Trp117Arg) | −1 | — | ['CATCCAGTCTCAAATGCTTTCTAGAYGGTCT GCTTCTTTCACAGTAACTAG'] |
| 1050 | NM_004086.2(COCH): c.1535T > C (p.Met512Thr) | −1 | — | ['GCACCTCTGGATGACCTGAAAGATAYGGCT TCTAAACCGAAGGAGTCTCAT'] |
| 1051 | NM_006412.3(AGPAT2): c.683T > C (p.Leu228Pro) | 10555 | AGPAT2 | ['ACAGGAACAGTCACAGTGCAGGTGCYGGAA GCCATCCCCACCAGCGGCCTC'] |
| 1052 | NM_003659.3(AGPS): c.1406T > C (p.Leu469Pro) | 8540 | AGPS | ['AATCAGCTAAGTGTAGCCACATTACYGTTTG AGGGGGATCGTGAGAAGGTT'] |
| 1053 | NM_004550.4(NDUFS2): c.1237T > C (p.Ser413Pro) | 4720 | NDUFS2 | ['GGGAGAGTTTGGGGTGTACCTGGTGYCTGA TGGCAGCAGCCGCCCTTATCG'] |
| 1054 | NM_006892.3(DNMT3B): c.808T > C (p.Ser270Pro) | 1789 | DNMT3B | ['CCAGTGGTTTGGCGATGGCAAGTTCYCCGA GGTGAGTCCGGGGAAGGGCAA'] |
| 1055 | NM_002538.3(OCLN): c.656T > C (p.Phe219Ser) | 100506658 | OCLN | ['CAAATATATGCCCTCTGCAACCAATYTTATA CACCTGCAGCTACTGGACTC'] |
| 1056 | NM_001211.5(BUB1B): c.3035T > C (p.Leu1012Pro) | −1 | — | ['AATGATGAGGCCACAGTGTCTGTTCYTGGG GAGCTTGCAGCAGAAATGAAT'] |
| 1057 | NM_016203.3(PRKAG2): c.1459T > C (p.Tyr487His) | 51422 | PRKAG2 | ['ACAGAATCTTGCTGCTGAGAAAACAYACAA TAACCTAGATATCACGGTGAC'] |
| 1058 | NM_016203.3(PRKAG2): c.1642T > C (p.Ser548Pro) | 51422 | PRKAG2 | ['TAGTATTGTGGGTATTATTTCCCTGYCGGAC ATTCTGCAAGCCCTGATCCT'] |
| 1059 | NM_001287.5(CLCN7): c.2297T > C (p.Leu766Pro) | 1186 | CLCN7 | ['TTCAAGCTGTTCCGGGCCCTGGGCCYGCGGC ACCTGGTGGTGGTGGACAAC'] |
| 1060 | NM_004646.3(NPHS1): c.793T > C (p.Cys265Arg) | 4868 | NPHS1 | ['GGCAGGACAGAGCTTGGAGCTGCCGYGCGT GGCCCGAGGGGGTAATCCCTT'] |
| 1061 | NM_003002.3(SDHD): c.416T > C (p.Leu139Pro) | 6392 | SDHD | ['CTTTCAGCTTTAACCTTTGCTGGGCYTTGCT ATTTCAACTATCACGATGTG'] |
| 1062 | NM_001164277.1(SLC37A4): c.352T > C (p.Trp118Arg) | 2542 | SLC37A4 | ['TAATGGCCTGGCCCAGGGGCTGGGCYGGCC CCATGTGGGAAGGTCCTGCG'] |
| 1063 | NM_002546.3(TNFRSF11B): c.349T > C (p.Phe117Leu) | 4982 | TNFRSF11B | ['GGAAGGGCGCTACCTTGAGATAGAGYTCTG CTTGAAACATAGGAGCTGCCC'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1064 | NM_005422.2(TECTA): c.5509T > C (p.Cys1837Arg) | 7007 | TECTA | ['GGGCGTGAGGATCAATGACAGACAGBGCAC CGGCATCGAGGGGGAAGATTT'] |
| 1065 | NM_007262.4(PARK7): c.497T > C (p.Leu166Pro) | 11315 | PARK7 | ['CCTGGGACCAGCTTCGAGTTTGCGCYTGCAA TTGTTGAAGCCCTGAATGGC'] |
| 1066 | NM_006009.3(TUBA1A): c.1190T > C (p.Leu397Pro) | 7846 | TUBA1A | ['GCTCGCCTGGACCACAAGTTTGACCYGATGT ATGCCAAACGTGCCTTTGTT'] |
| 1067 | NM_002700.2(POU4F3): c.668T > C (p.Leu223Pro) | 5459 | POU4F3 | ['CTCAAGATCCCCGGCGTGGGCTCGCYGAGC CAAAGCACCATCTGCAGGTTC'] |
| 1068 | NM_005025.4(SERPINI1): c.145T > C (p.Ser49Pro) | 5274 | SERPINI1 | ['TGGTGAAGATGAAAATATTCTCTTCYCTCCA TTGAGTATTGCTCTTGCAAT'] |
| 1069 | NM_001040667.2(HSF4): c.341T > C (p.Leu114Pro) | 3299 | HSF4 | ['TTCGTGCGCGGCCGCGAGCAGCTACYGGAG CGCGTGCGGCGCAAGGTGGGG'] |
| 1070 | NM_002942.4(ROBO2): c.2834T > C (p.Ile945Thr) | 6092 | ROBO2 | ['AATAGCAACAGTGGCCCAAATGAGAYTGGA AATTTTGGCCGTGGAGGTAAG'] |
| 1071 | NM_000492.3(CFTR): c.3857T > C (p.Phe1286Ser) | 1080 | CFTR | ['ACTTTGCAACAGTGGAGGAAAGCCTYTGGA GTGATACCACAGGTGAGCAAA'] |
| 1072 | NM_000492.3(CFTR): c.3763T > C (p.Ser1255Pro) | 1080 | CFTR | ['TGGATCAGGGAAGAGTACTTTGTTAYCAGCT TTTTTGAGACTACTGAACAC'] |
| 1073 | NM_000492.3(CFTR): c.3194T > C (p.Leu1065Pro) | 1080 | CFTR | ['ACAAGCTTAAAAGGACTATGGACACBTCGT GCCTTCGGACGGCAGCCTTAC'] |
| 1074 | NM_000492.3(CFTR): c.3469 - 20T > C | 1080 | CFTR | ['TGTCTGCCATTCTTAAAAACAAAAAYGTTGT TATTTTATTTCAGATGCGA'] |
| 1075 | NM_005603.4(ATP8B1): c.863T > C (p.Leu288Ser) | 5205 | ATP8B1 | ['TTTTGGAGAAACACAAGTTTTCCTTYGGATG CTGATAAAATTTTGTTACGT'] |
| 1076 | NM_005603.4(ATP8B1): c.2097 + C | 5205 | ATP8B1 | ['GAGGAGATTGAAAAAGACTTAATTGYGAGT TTTAGCCTTAATAACTTTTTC'] |
| 1077 | NM_005603.4(ATP8B1): c.1982T > C (p.Ile661Thr) | 5205 | ATP8B1 | ['ACCCTATGCCTTTGCTACAAGGAAAYTGAA GAAAAAGAATTTACAGAATGG'] |
| 1078 | NM_005144.4(HR): c.-320T > C | 55806 | HR | ['CGCAGCACGGAGTCTCGGCGTCCCAYGGCG CAACCTACGGCCTCGGCCCAG'] |
| 1079 | NM_003322.4(TULP1): c.1471T > C (p.Phe491Leu) | 7287 | TULP1 | ['GGTCACCCAGGCCTCAGTCAAGAACYTCCA GATTGTCCACGCTGATGACCG'] |
| 1080 | NM_003322.4(TULP1): c.1145T > C (p.Phe382Ser) | 7287 | TULP1 | [CTCCTGGGGAACCGCTTCACGGTCTYTGACA ACGGGCAGAACCCACAGCGT'] |
| 1081 | NM_000455.4(STK11): c.200T > C (p.Leu67Pro) | 6794 | STK11 | ['TCTTACGGCAAGGTGAAGGAGGTGCYGGAC TCGGAGACGCTGTGCAGGAGG'] |
| 1082 | NM_002241.4(KCNJ10): c.418T > C (p.Cys140Arg) | 3766 | KCNJ10 | ['TGGCTTCCGCTACATCAGTGAGGAAYGTCCA CTGGCCATTGTGCTTCTTAT'] |
| 1083 | NM_001172567.1(MYD88): c.317T > C (p.Leu106Pro) | 4615 | MYD88 | ['TCTGTAGGCCGACTGCTCGAGCTGCYTACCA AGCTGGGCCGCGACGACGTG'] |
| 1084 | NM_000466.2(PEX1): c.1991T > C (p.Leu664Pro) | 5189 | PEX1 | ['CCATCTGTTGTCCTGCTGGATGACCYTGACC TCATTGCTGGACTGCCTGCT'] |
| 1085 | NM_001303.3(COX10): c.2T > C (p.Met1Thr) | 1352 | COX10 | ['GGAGCGGCCCCAGACTCGTAAATTAYGGCC GCATCTCCGCACACTCTCCC'] |
| 1086 | NM_001300.5(KLF6): c.346T > C (p.Ser116Pro) | 1316 | KLF6 | ['TGTCAGCAGCGAATCCTCTGACAGCYCCGA GGAACTTTCTCCCACGGCCAA'] |
| 1087 | NM_001300.5(KLF6): c.190T > C (p.Trp64Arg) | 1316 | KLF6 | ['CAAATTTGACAGCCAGGAAGATCTGYGGAC CAAAATCATTCTGGCTCGGGA'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1088 | NM_001300.5(KLF6):c.506T > C (p.Leu169Pro) | 1316 | KLF6 | ['CTGTGGGGTTGCGTGCCCGGGGAGCYGCCC TCGCCAGGGAAGGTGCGCAGC'] |
| 1089 | NM_000085.4(CLCNKB):c.1294T > C (p.Tyr432His) | 1188 | CLCNKB | ['CGGGTACTTCATGCCCATCTTTGTCYATGGT GAGTCTGGGGTCCTGAGGTT'] |
| 1090 | NM_000214.2(JAG1):c.110T > C (p.Leu37Ser) | 182 | JAG1 | [TGTGGGGCCTCGGGTCAGTTCGAGTYGGAG ATCCTGTCCATGCAGAACGTG'] |
| 1091 | NM_003865.2(HESX1):c.77T > C (p.Ile26Thr) | 8820 | HESX1 | ['ACTTGCTCCTTTTCAATTGAGAGAAYCTTAG GACTGGACCAGAAGAAAGAC'] |
| 1092 | NM_003865.2(HESX1):c.357 + 2T > C | 8820 | HESX1 | ['TCATTATTGGGTGAAAAAACTTCCCDCCTGG TTTTGAGTAAAAGCAGTTCT'] |
| 1093 | NM_002618.3(PEX13):c.977T > C (p.Ile326Thr) | 5194 | PEX13 | ['CTTGATGGCCAAACAACAGGACTTAYACCT GCGAATTATGTCAAATTCTT'] |
| 1094 | NM_000303.2(PMM2):c.395T > C (p.Ile132Thr) | 5373 | PMM2 | ['AATGGGATGTTAAACGTGTCCCCTAYTGGA AGAAGCTGCAGCCAAGAAGAA'] |
| 1095 | NM_000303.2(PMM2):c.131T > C (p.Val44Ala) | 5373 | PMM2 | ['AGGCAGAAGATCAAAATCGGAGTGGYAGGC GGATCGGACTTTGAGAAAGTG'] |
| 1096 | NM_000104.3(CYP1B1):c.2T > C (p.Met1Thr) | 1545 | CYP1B1 | ['CGCCTTCTCCTCTCTGTCCCCAGCAYGGGCA CCAGCCTCAGCCCGAACGAC'] |
| 1097 | NM_032977.3(CASP10):c.440T > C (p.Met147Thr) | 843 | CASP10 | ['AAAGACTCGCTTCCCAAAACTGAAAYGGTG AGTGGGTCATACAGAATGGGT'] |
| 1098 | NM_003999.2(OSMR):c.2072T > C (p.Ile691Thr) | 9180 | OSMR | ['GGTTCAGAATGTTGCAAATACAAAAYTGAC AACCCGGAAGAAAAGGCATTG'] |
| 1099 | NM_000314.6(PTEN):c.370T > C (p.Cys124Arg) | 5728 | PTEN | ['TGACAATCATGTTGCAGCAATTCACBGTAAA GCTGGAAAGGGACGAACTGG'] |
| 1100 | NM_000314.6(PTEN):c.209T > C (p.Leu70Pro) | 5728 | PTEN | ['AAAAACCATTACAAGATATACAATCYGTAA GTATGTTTTCTTATTTGTATG'] |
| 1101 | NM_000314.6(PTEN):c.335T > C (p.Leu112Pro) | 5728 | PTEN | ['TTTTGTGAAGATCTTGACCAATGGCYAAGTG AAGATGACAATCATGTTGCA'] |
| 1102 | NM_000314.6(PTEN):c.722T > C (p.Phe241Ser) | 5728 | PTEN | ['CGACGGGAAGACAAGTTCATGTACTYTGAG TTCCCTCAGCCGTTACCTGTG'] |
| 1103 | NM_006949.3(STXBP2):c.626T > C (p.Leu209Pro) | 6813 | STXBP2 | ['TTGGCCCACGCCGTCCTGGCCAAGCHGAAC GCCTTCAAGGCAGACACTCCC'] |
| 1104 | NM_000358.2(TGFBI):c.1619T > C (p.Phe540Ser) | 7045 | TGFBI | ['AACCGGGAAGGAGTCTACACAGTCYTGCT CCCACAAATGAAGCCTTCCGA'] |
| 1105 | NM_000350.2(ABCA4):c.1622T > C (p.Leu541Pro) | 24 | ABCA4 | ['CAGCTCACCCAACGTGCCCTCTCTCYACTGG AGGAAAACATGTTCTGGGCC'] |
| 1106 | NM_000350.2(ABCA4):c.5819T > C (p.Leu1940Pro) | 24 | ABCA4 | ['GGAAATAAAACTGACATCTTAAGGCYACAT GAACTAACCAAGGTAAGGGAA'] |
| 1107 | NM_000860.5(HPGD):c.577T > C (p.Ser193Pro) | 3248 | HPGD | ['CTTTGTTAACACAGCCATCCTTGAAYCAATT GAAAAGAAGAAAACATGGG'] |
| 1108 | NM_000223.3(KRT12):c.386T > C (p.Met129Thr) | 3859 | KRT12 | ['CTTTCTGGATCAGAAAAAGAAACTAYGCAA AATCTTAATGATAGATTAGCT'] |
| 1109 | NM_000503.5(EYA1):c.1459T > C (p.Ser487Pro) | 2138 | EYA1 | ['GTTGACACTGGCCCTGAAAGCACTCYCGCTC ATTCACTCCCGGTGAGGCTC'] |
| 1110 | NM_000261.1(MYOC):c.1309T > C (p.Tyr437His) | 4653 | MYOC | ['TGCCTTCATCATCTGTGGCACCTTGYACACC GTCAGCAGCTACACCTCAGC'] |
| 1111 | NM_000261.1(MYOC):c.1297T > C (p.Cys433Arg) | 4653 | MYOC | ['GTCAGTCGCCAATGCCTTCATCATCYGTGGC ACCTTGTACACCGTCAGCAG'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1112 | NM_130838.1(UBE3A): c.389T > C (p.Ile130Thr) | 7337 | UBE3A | ['GATTATTCCCCTTTAATCCGTGTTAYTGGAA GAGTTTTTTCTAGTGCTGAG'] |
| 1113 | NM_000474.3(TWIST1): c.392T > C (p.Leu131Pro) | 7291 | TWIST1 | ['TCGCTGAACGAGGCGTTCGCCGCGCYGCGG AAGATCATCCCCACGCTGCCC'] |
| 1114 | NM_000192.3(TBX5): c.161T > C (p.Ile54Thr) | 6910 | TBX5 | ['TCCTTCTTGCAGGGCATGGAGGGAAYCAAA GTGTTTCTCCATGAAAGAGAA'] |
| 1115 | NM_002905.3(RDH5): c.841T > C (p.Tyr281His) | -1 | — | ['GACTGCTCGACACCCCCGAACCCGCBACAG CCCAGGTTGGGATGCCAAGCT'] |
| 1116 | NM_001089.2(ABCA3): c.302T > C (p.Leu101Pro) | 21 | ABCA3 | ['GTCACTGAGACAGTGCGCAGGGCACYTGTG ATCAACATGCGAGGTGAGACA'] |
| 1117 | NM_001089.2(ABCA3): c.4658T > C (p.Leu1553Pro) | 21 | ABCA3 | ['ATGGACCCCGTGGCCCGGCGCCTGCYTTGG GACACCGTGGCACGAGCCCGA'] |
| 1118 | NM_001089.2(ABCA3): c.977T > C (p.Leu326Pro) | 21 | ABCA3 | ['ATCGCCGCCTCCTTCATGACCCTGCYCTTCT GTGTCAAGGTGAGCATGGCG'] |
| 1119 | NM_005535.2(IL12RB1): c.592T > C (p.Cys198Arg) | 3594 | IL12RB1 | ['CTGCCTCTCCCCAGAGTCCTGCCTCYGCCCC CTGGAGATGAATGTGGCCCA'] |
| 1120 | NM_005055.4(RAPSN): c.41T > C (p.Leu14Pro) | 5913 | RAPSN | ['ACCAAGCAGCAGATCGAGAAGGGGCYCCAG CTGTACCAGTCCAACCAGACA'] |
| 1121 | NM_005055.4(RAPSN): c.848T > C (p.Leu283Pro) | 5913 | RAPSN | ['ATCATGACCGAGATCGGAAACCGCCYGGGG CAGGTGCAGGCGCTGCTGGGT'] |
| 1122 | NM_005055.4(RAPSN): c.416T > C (p.Phe139Ser) | 5913 | RAPSN | MATGCCTTCCTGGGCCTCAGCGTCTYCCAGA AGGCCCTGGAGAGCTTCGAG'] |
| 1123 | NM_005570.3(LMAN1): c.2T > C (p.Met1Thr) | 3998 | LMAN1 | ['CTCCTCCGCGTTCCAGAATCCAAGAYGGCG GGATCCAGGCAAAGGGGTCTC'] |
| 1124 | NM_000430.3(PAFAH1B1): c.505T > C (p.Ser169Pro) | 5048 | PAFAH1B1 | [CAGCGGCAAGCTTCTGGCTTCCTGTYCTGCA GATATGACCATTAAACTATG'] |
| 1125 | NM_000430.3(PAFAH1B1): c.92T > C (p.Phe31Ser) | 5048 | PAFAH1B1 | ['GGCTATGAAGAGGCATATTCAGTTTYTAAA AAGGAAGCTGAATTAGATGTG'] |
| 1126 | NM_006261.4(PROP1): c.263T > C (p.Phe88Ser) | 5626 | PROP1 | ['CAGTGGAACAGCTGGAGTCAGCCTYTGGG AGGAACCAGTACCCCGACATC'] |
| 1127 | NM_175929.2(FGF14): c.449T > C (p.Phe150Ser) | 2259 | FGF14 | ['GAACTTTTTACCCCTGAATGCAAGTYTAAAG AATCTGTTTTTGAAAATTAT'] |
| 1128 | NM_004970.2(IGFALS): c.1618T > C (p.Cys540Arg) | 3483 | IGFALS | ['GTGGCTGGAGGGTAACCCCTGGGACYGTGG CTGCCCTCTCAAGGCGCTGCG'] |
| 1129 | NM_005379.3(MYO1A): c.2728T > C (p.Ser910Pro) | 4640 | MYO1A | ['CCCTTGCCTGTTCCGTCCCTAGACTYCTTCTC GGATTCTCCTCCTGACCAA'] |
| 1130 | NM_006302.2(MOGS): c.1954T > C (p.Phe652Leu) | 7841 | MOGS | ['GCACTGGGCCCAGAGCTAGGAGTCYTTGC AGACTTTGGGAACCACACAAA'] |
| 1131 | NM_001009944.2(PKD1): c.2534T > C (p.Leu845Ser) | 5310 | PKD1 | ['TACGTGCCCACCAACGGCTCAGCCTYGGTGC TCCAGGTGGACTCTGGTGCC'] |
| 1132 | NM_004329.2(BMPR1A): c.370T > C (p.Cys124Arg) | 657 | BMPR1A | ['AGCCCAGCTACGCCGGACAATAGAAYGTTG TCGGACCAATTTATGTAACCA'] |
| 1133 | NM_004329.2(BMPR1A): c.1409T > C (p.Met470Thr) | 657 | BMPR1A | ['CCGAGTGATCCGTCATACGAAGATAYGCGT GAGGTTGTGTGTGTCAAACGT'] |
| 1134 | NM_000452.2(SLC10A2): c.728T > C (p.Leu243Pro) | 6555 | SLC10A2 | ['GTGGCGGGTTACTCCCTGGGGTTTCYTCTGG CTAGAATTGCTGGTCTACCC'] |
| 1135 | NM_030662.3(MAP2K2): c.400T > C (p.Tyr134His) | 5605 | MAP2K2 | ['CAACTCGCCGTACATCGTGGGCTTCYACGGG GCCTTCTACAGTGACGGGGA'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1136 | NM_033337.2(CAV3): c.260T > C (p.Leu87Pro) | 859 | CAV3 | ['CTGCTGGGCGTCCCACTGGCCCTGCHCTGGG GCTTCCTGTTCGCCTGCATC'] |
| 1137 | NM_000388.3(CASR): c.2417T > C (p.Phe806Ser) | 846 | CASR | ['CCGGAGAACTTCAATGAAGCCAAGTHCATC ACCTTCAGCATGCTCATCTTC'] |
| 1138 | NM_000388.3(CASR): c.382T > C (p.Phe128Leu) | 846 | CASR | ['AATTGATTCTTTGAACCTTGATGAGYTCTGC AACTGCTCAGAGCACATTCC'] |
| 1139 | NM_000388.3(CASR): c.1835T > C (p.Phe612Ser) | 846 | CASR | [GAGTTTCTGTCGTGGACGGAGCCCTYTGGGA TCGCACTCACCCTCTTTGCC'] |
| 1140 | NM_000388.3(CASR): c.2641T > C (p.Phe881Leu) | 846 | CASR | ['GCGTTGCAGCACCGCAGCTCACGCTYTCAA GGTGGCTGCCCGGGCCACGCT'] |
| 1141 | NM_000388.3(CASR): c.374T > C (p.Leu125Pro) | 846 | CASR | ['CAAAACAAAATTGATTCTTTGAACCYTGATG AGTTCTGCAACTGCTCAGAG'] |
| 1142 | NM_000388.3(CASR): c.2362T > C (p.Phe788Leu) | 846 | CASR | ['CACCTGCCTGCTGGCTGCCATCTGCYTCTTC TTTGCCTTCAAGTCCCGGAA'] |
| 1143 | NM_000388.3(CASR): c.38T > C (p.Leu13Pro) | 846 | CASR | ['AGCTGCTGCTGGGTCCTCTTGGCACYCACCT GGCACACCTCTGCCTACGGG'] |
| 1144 | NM_030653.3(DDX11): c.2271 + 2T > C | 1663 | DDX11 | ['CTGGCATATTCCAGGTGCATCCAGGYGCGG GCGTCATGCTGGGCTTGGGTC'] |
| 1145 | NM_001001557.2(GDF6): c.866T > C (p.Leu289Pro) | 392255 | GDF6 | ['TTCACCAGATCCCAGCGCAAGAACCYGTTC GCAGAGATGCGCGAGCAGCTG'] |
| 1146 | NM_000557.4(GDF5): c.1322T > C (p.Leu441Pro) | -1 | — | ['TGCGAGTTCCCATTGCGCTCCCACCYGGAGC CCACGAATCATGCAGTCATC'] |
| 1147 | NM_000392.4(ABCC2): c.1967 + 2T > C | 1244 | ABCC2 | ['TGATTCGGAAGCCACAGTCCGAGAGYGAGT TGCCTTCTTTCCATCCTAATG'] |
| 1148 | NM_000396.3(CTSK): c.926T > C (p.Leu309Pro) | 1513 | CTSK | ['AACTGGGGAAACAAAGGATATATCCYCATG GCTCGAAATAAGAACAACGCC'] |
| 1149 | NM_000304.3(PMP22): c.47T > C (p.Leu16Pro) | 5376 | PMP22 | ['ATCATCGTCCTCCACGTCGCGGTGCYGGTGC TGCTGTTCGTCTCCACGATC'] |
| 1150 | NM_000304.3(PMP22): c.82T > C (p.Trp28Arg) | 5376 | PMP22 | ['ATATCTATCTGATTCTCTCTAGCAAYGGATC GTGGGCAATGGACACGCAAC'] |
| 1151 | NM_001453.2(FOXC1): c.335T > C (p.Phe112Ser) | 2296 | FOXC1 | ['ATCTACCAGTTCATCATGGACCGCTHCCCCT TCTACCGGGACAACAAGCAG'] |
| 1152 | NM_001451.2(FOXF1): c.1138T > C (p.Ter380Arg) | 2294 | FOXF1 | ['CCAAGACATCAAGCCTTGCGTGATGYGAGG CTGCCGCCGCAGGCCCTCCTG'] |
| 1153 | NM_006432.3(NPC2): c.199T > C (p.Ser67Pro) | 10577 | NPC2 | ['CTCTTTTTTTCTCTTAGATATTCAGYCTAAAA GCAGCAAGGCCGTGGTGCA'] |
| 1154 | NM_001127221.1(CACNA1A): c.2141T > C (p.Val714Ala) | 773 | CACNA1A | ['CTGAATGTGTTCTTGGCCATCGCTGYGGACA ATCTGGCCAACGCCCAGGAG'] |
| 1155 | NM_001127221.1(CACNA1A): c.4469T > C (p.Phe1490Ser) | 773 | CACNA1A | ['GGGTACCGCATGGAGATGTCCATTYCTACG TCGTCTACTTTGTGGTGTTC'] |
| 1156 | NM_001127221.1(CACNA1A): c.5126T > C (p.Ile1709Thr) | 773 | CACNA1A | ['ATGCTCTTCTTCATCTATGCCATCAYTGGGA TGCAGGTGAGTGTCGTGTCC'] |
| 1157 | NM_000901.4(NR3C2): c.2771T > C (p.Leu924Pro) | 4306 | NR3C2 | ['CAGAGCTGGCAGAGGTTCTACCAACYGACC AAGCTGCTGGACTCCATGCAT'] |
| 1158 | NM_000901.4(NR3C2): c.2936T > C (p.Leu979Pro) | 4306 | NR3C2 | ['GTGGAGTCGGGGAACGCCAAGCCGCYCTAC TTCACCGGAAGTGACTGCCC'] |
| 1159 | NM_000339.2(SLC12A3): c.2576T > C (p.Leu859Pro) | 6559 | SLC12A3 | ['CTACCCTCCTCATTCCCTATCTCCYTGGCC GCAAGAGGAGGTGGAGCAAA'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1160 | NM_000339.2(SLC12A3): c.1261T > C (p.Cys421Arg) | 6559 | SLC12A3 | ['CTGGGGTGCCTGCGAGGGGCTGGCCYGCAG CTATGGCTGGAACTTCACCGA'] |
| 1161 | NM_000339.2(SLC12A3): c.1868T > C (p.Leu623Pro) | 6559 | SLC12A3 | ['TCGGTACAGGCTGGCTCCTACAACCYGGCCC TCAGCTACTCGGTGGGCCTC'] |
| 1162 | NM_000163.4(GHR): c.341T > C (p.Phe114Ser) | 2690 | GHR | ['TCTGCTGGGGAAAACAGCTGTTACTYTAATT CATCGTTTACCTCCATCTGG'] |
| 1163 | NM_000163.4(GHR): c.512T > C (p.Ile171Thr) | 2690 | GHR | ['AGTTTAACTGGGATTCATGCAGATAYCCAA GTGAGATGGGAAGCACCACGC'] |
| 1164 | NM_000525.3(KCNJ11): c.440T > C (p.Leu147Pro) | 3767 | KCNJ11 | ['ACTGAGGAGTGCCCACTGGCCATCCYGATC CTCATCGTGCAGAACATCGTG'] |
| 1165 | NM_000525.3(KCNJ11): c.124T > C (p.Cys42Arg) | 3767 | KCNJ11 | ['CCGCTTTGTGTCCAAGAAAGGCAACYGCAA CGTGGCCCACAAGAACATCCG'] |
| 1166 | NM_001122764.1(PPDX): c.35T > C (p.Ile12Thr) | 5498 | PPDX | ['ACCGTGGTCGTGCTGGGCGGAGGCAYCAGC GGCTTGGCCGCCAGTTACCAC'] |
| 1167 | NM_000182.4(HADHA): c.1025T > C (p.Leu342Pro) | 3030 | HADHA | ['AAAGAATCAAAGGCCTTGATGGGACYCTAC CATGGTCAGGTCCTGTGCAAG'] |
| 1168 | NM_003476.4(CSRP3): c.131T > C (p.Leu44Pro) | 8048 | CSRP3 | ['CTGGCAGTGGCCTGCAGGAAGGCTCYTGAC AGCACGACAGTCGCGGCTCAT'] |
| 1169 | NM_001204.6(BMPR2): c.367T > C (p.Cys123Arg) | 659 | BMPR2 | ['TTTCTGCTGTTGTAGCACAGATTTAHGTAAT GTCAACTTTACTGAGAATTT'] |
| 1170 | NM_000336.2(SCNN1B): c.1858T > C (p.Tyr620His) | 6338 | SCNN1B | ['CATCCCAGGCACCCCGCCCCCAACYATGA CTCCCTGCGTCTGCAGCCGCT'] |
| 1171 | NM_002181.3(IHH): c.569T > C (p.Val190Ala) | 3549 | IHH | ['TCAAAGGCCACGTGCATTGCTCCGYCAAGT CCGGTGAGCCGCCGCCGGGG'] |
| 1172 | NM_000193.3(SHH): c.349T > C (p.Trp117Arg) | 6469 | SHH | ['TTTGGCCATCTCGGTGATGAACCAGBGCCA GGAGTGAAACTGCGGGTGAC'] |
| 1173 | NM_000193.3(SHH): c.995T > C (p.Val332Ala) | 6469 | SHH | ['GACCGCCGGCTCCTGCCCGCCGCTGYGCAC AGCGTGACCCTAAGCGAGGAG'] |
| 1174 | NM_000179.2(MSH6): c.2633T > C (p.Val878Ala) | 2956 | MSH6 | ['AAAATTATAGGGATCATGGAAGAAGBTGCT GATGGTTTTAAGTCTAAAATC'] |
| 1175 | NM_000098.2(CPT2): c.1342T > C (p.Phe448Leu) | 1376 | CPT2 | ['AACCCTCACTATTGACTGCGTCCAGYTTCAG AGAGGAGGCAAAGAATTCCT'] |
| 1176 | NM_007315.3(STAT1): c.2117T > C (p.Leu706Ser) | 6772 | STAT1 | ['GGAACTGGATATATCAAGACTGAGTYGATT TCTGTGTCTGAAGTGTAAGTG'] |
| 1177 | NM_007315.3(STAT1): c.1799T > C (p.Leu600Pro) | 6772 | STAT1 | ['AAGGACCAGCAGCCGGGGACCTTCCYGCTG CGGTTCAGTGAGAGCTCCCGG'] |
| 1178 | NM_024420.2(PLA2G4A): c.331T > C (p.Ser111Pro) | 5321 | PLA2G4A | ['AGGGACAGCAACATTTACTGTATCTYCTATG AAGGTGGGAGAAAAGAAAGA'] |
| 1179 | NM_000352.4(ABCC8): c.394T > C (p.Phe132Leu) | 6833 | ABCC8 | ['CTATCACAACATCGAGACTTCCAACBTCCCC AAGCTGCTAATTGGTAGGTG'] |
| 1180 | NM_033163.3(FGF8): c.118T > C (p.Phe40Leu) | 2253 | FGF8 | ['GCTGGGCAGGGAGCTCGCTTCCCTGYTCCGG GCTGGCCGGGAGCCCCAGGG'] |
| 1181 | NM_153767.3(KCNJ1): c.1013T > C (p.Met338Thr) | 3758 | KCNJ1 | ['AACATCTTTCTCATTATAAAGGCACRTGGCA CAGTGAGGGGTCTCCACTTC'] |
| 1182 | NM_000095.2(COMP): c.982T > C (p.Cys328Arg) | 1311 | COMP | ['AACCCACCCTGTCATCCAGGACAACYGCCC GCTGGTGCGGAACCCAGACCA'] |
| 1183 | NM_000095.2(COMP): c.1042T > C (p.Cys348Arg) | 1311 | COMP | ['GGACGAGGACAAGTGGGGCGATGCGYGCGA CAACTGCCGGTCCCAGAAGAA'] |

TABLE 6-continued

Diseases/disorders containging T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1184 | NM_002047.2(GARS): c.548T > C (p.Leu183Pro) | 2617 | GARS | ['ATCCTGGAGATCGATTGCACCATGCYCACCC CTGAGCCAGTTTTAAAGTGA'] |
| 1185 | NM_000435.2(NOTCH3): c.1363T > C (p.Cys455Arg) | 4854 | NOTCH3 | ['CCTCGACCGCATAGGCCAGTTCACCYGTATC TGTATGGCAGGTGGGTGGTG'] |
| 1186 | NM_001166107.1(HMGCS2): c.520T > C (p.Phe174Leu) | 3158 | HMGCS2 | ['CTGCTACGGTGGTACTGCCTCCCTCYTCAAT GCTGCCAACTGGATGGAGTC'] |
| 1187 | NM_001038.5(SCNN1A): c.1477 C (p.Trp493Arg) | 6337 | SCNN1A | ['CCAGCTCTCTGCTGGTTACTCACGAYGGCCC TCGGTGACATCCCAGGTAGA'] |
| 1188 | NM_000161.2(GCH1): c.662T > C (p.Met221Thr) | 2643 | GCH1 | ['ATGGTAATGCGAGGTGTACAGAAAAYGAAC AGCAAAACTGTGACCAGCACA'] |
| 1189 | NM_000059.3(BRCA2): c.7529T > C (p.Leu2510Pro) | 675 | BRCA2 | ['CGCGTCTTTCCACAGCCAGGCAGTCYGTATC TTGCAAAAACATCCACTCTG'] |
| 1190 | NM_000180.3(GUCY2D): c.1694T > C (p.Phe565Ser) | 3000 | GUCY2D | ['GGAGACAGGGTTTGGCTGAAGAAATYCCCA GGGGATCAGCACATAGCTATC'] |
| 1191 | NM_000180.3(GUCY2D): c.2846T > C (p.Ile949Thr) | 3000 | GUCY2D | ['AATGGGCAGCGACACGCGGCAGAGAYCGCC AACATGTCACTGGACATCCTC'] |
| 1192 | NM_198056.2(SCN5A): c.3963 + 2T > C | 6331 | SCN5A | ['CTGTCACGATTTGAGGGCATGAGGGYAAGA GAGGTGGCTGCCTTCCCACCA'] |
| 1193 | NM_000335.4(SCN5A): c.5380T > C (p.Tyr1794His) | 6331 | SCN5A | ['GAGTGAGGACGACTTCGATATGTTCYATGA GATCTGGGAGAAATTTGACCC'] |
| 1194 | NM_000023.2(SGCA): c.524T > C (p.Val175Ala) | 6442 | SGCA | ['CCCGGAGAGCTTCAGCTGCTCAACGYCACCT CTGCCTTGGACCGTGGGGGC'] |
| 1195 | NM_002427.3(MMP13): c.224T > C (p.Phe75Ser) | 4322 | MMP13 | ['AGGCTCCGAGAAATGCAGTCTTTCTYCGGCT TAGAGGTGACTGGCAAACTT'] |
| 1196 | NM_002427.3(MMP13): c.221T > C (p.Phe74Ser) | 4322 | MMP13 | ['GAGAGGCTCCGAGAAATGCAGTCTTYCTTC GGCTTAGAGGTGACTGGCAAA'] |
| 1197 | NM_002427.3(MMP13): c.272T > C (p.Met91Thr) | 4322 | MMP13 | ['CTTGACGATAACACCTTAGATGTCAYGAAA AAGCCAAGATGCGGGGTTCCT'] |
| 1198 | NM_004525.2(LRP2): c.7564T > C (p.Tyr2522His) | 4036 | LRP2 | ['CTCCTTTTGTATGACTAGGTACCTGYACTGG GCTGACTGGGATACACATGC'] |
| 1199 | NM_000211.4(ITGB2): c.446T > C (p.Leu149Pro) | 3689 | ITGB2 | ['GATGACCTCAGGAATGTCAAGAAGCYAGGT GGCGACCTGCTCCGGGCCCTC'] |
| 1200 | NM_000211.4(ITGB2): c.412T > C (p.Ser138Pro) | 3689 | ITGB2 | ['GTACTATCTGATGGACCTCTCCTACYCCATG CTTGATGACCTCAGGAATGT'] |
| 1201 | NM_005502.3(ABCA1): c.4429T > C (p.Cys1477Arg) | 19 | ABCA1 | ['CAAAATCAAGAAGATGCTGCCTGTGYGTCC CCCAGGGGCAGGGGGGCTGCC'] |
| 1202 | NM_005502.3(ABCA1): c.6026T > C (p.Phe2009Ser) | 19 | ABCA1 | ['TTGACTGGGAGAGAACACGTGGAGTYCTTT GCCCTTTTGAGAGGAGTCCCA'] |
| 1203 | NM_130439.3(MXI1): c.552 + 2T > C | 4601 | MXI1 | ['AACAAAGCCAAAGCACACATCAAGGYGAGA ATTTTTACTTTCAGATTTGCA'] |
| 1204 | m.5874T > C | 4579 | MT-TY | ['GTCTTTAGATTTACAGTCCAATGCTYCACTC AGCCATTTTACCTCACCCCC'] |
| 1205 | m.7512T > C | 4574 | MT-TS1 | ['CCAACCCCATGGCCTCCATGACTTTYTCAAA AAGGTATTAGAAAAACCATT'] |
| 1206 | m.7510T > C | 4574 | MT-TS1 | ['AGCCAACCCCATGGCCTCCATGACTYTTTCA AAAAGGTATTAGAAAAACCA'] |
| 1207 | m.7511T > C | 4574 | MT-TS1 | ['GCCAACCCCATGGCCTCCATGACTTYTCAA AAAGGTATTAGAAAAACCAT'] |

TABLE 6-continued

Diseases/disorders containging T to C Changes. The table includes human gene
mutations that may be corrected by chainging a cytosine (C) to a thymine (T). The gene
name, gene symbol, and Gene ID are indicated.

| SEQ ID NO: Name | Gene ID | Gene Symbol | Flanks |
|---|---|---|---|
| 1208 m.616T > C | 4558 | MT-TF | ['CCTCCTCAAAGCAATACACTGAAAABGTTTA GACGGGCTCACATCACCCCA'] |
| 1209 m.4409T > C | 4569 | MT-TM | ['TATCACACCCCATCCTAAAGTAAGGYCAGCT AAATAAGCTATCGGGCCCAT'] |
| 1210 m.8356T > C | 4566 | MT-TK | ['AAAGATTAAGAGAACCAACACCTCTYTACA GTGAAATGCCCCAACTAAATA'] |
| 1211 m.12297T > C | 4568 | MT-TL2 | ['AAAGGATAACAGCTATCCATTGGTCYTAGG CCCCAAAAATTTTGGTGCAAC'] |
| 1212 m.3271T > C | 4567 | MT-TL1 | ['CCGGTAATCGCATAAAACTTAAAACYTTAC AGTCAGAGGTTCAATTCCTCT'] |
| 1213 m.3250T > C | 4567 | MT-TL1 | ['GGTTTGTTAAGATGGCAGAGCCCGGYAATC GCATAAAACTTAAAACTTTAC'] |
| 1214 m.3290T > C | 4567 | MT-TL1 | ['TAAAACTTTACAGTCAGAGGTTCAAYTCCTC TTCTTAACAACATACCCATG'] |
| 1215 m.4290T > C | 4565 | MT-TI | ['AAATATGTCTGATAAAAGAGTTACTYTGATA GAGTAAATAATAGGAGCTTA'] |
| 1216 m.4291T > C | 4565 | MT-TI | ['AATATGTCTGATAAAAGAGTTACTTYGATAG AGTAAATAATAGGAGCTTAA'] |
| 1217 m.9997T > C | 4563 | MT-TG | ['ATCTATTGATGAGGGTCTTACTCTTYTAGTA TAAATAGTACCGTTAACTTC'] |
| 1218 m.10010T > C | 4563 | MT-TG | ['GGTCTTACTCTTTTAGTATAAATAGYACCGT TAACTTCCAATTAACTAGTT'] |
| 1219 m.4336T > C | 4572 | MT-TQ | ['GCTTAAACCCCTTATTTCTAGGACYATGAG AATCGAACCCATCCCTGAGA'] |
| 1220 m.14709T > C | 4556 | MT-TE | ['CGGACTACAACCACGACCAATGATAYGAAA AACCATCGTTGTATTTCAACT'] |
| 1221 m.14674T > C | 4556 | MT-TE | ['TCAACAGAAACAAAGCATACATCATBATTCT CGCACGGACTACAACCACGA'] |
| 1222 m.5692T > C | 4570 | MT-TN | ['GGGACTTAAACCCACAAACACTTAGYTAAC AGCTAAGCACCCTAATCAACT'] |
| 1223 m.5728T > C | 4570 | MT-TN | ['GCACCCTAATCAACTGGCTTCAATCYACTTC TCCCGCCGCCGGGAAAAAAG'] |
| 1224 m.2991T > C | 4550 | MT-RNR2 | ['TCAACAATAGGGTTTACGACCTCGAYGTTGG ATCAGGACATCCCGATGGTG'] |
| 1225 m.1291T > C | 4549 | MT-RNR1 | ['ATCTTCAGCAAACCCTGATGAAGGCYACAA AGTAAGCGCAAGTACCCACGT'] |
| 1226 m.1095T > C | 4549 | MT-RNR1 | ['CTGGGATTAGATACCCCACTATGCTYAGCCC TAAACCTCAACAGTTAAATC'] |
| 1227 m.8528T > C | -1 | - | ['TTATAACAAACCCTGAGAACCAAAAYGAAC GAAAATCTGTTCGCTTCATTC'] |
| 1228 m.8993T > C | 4508 | MT-ATP6 | ['AGCCTACTCATTCAACCAATAGCCCBGGCCG TACGCCTAACCGCTAACATT'] |
| 1229 m.9101T > C | 4508 | MT-ATP6 | ['ATTAACCTTCCCTCTACACTTATCAYCTTCA CAATTCTAATTCTACTGACT'] |
| 1230 m.9176T > C | 4508 | MT-ATP6 | ['ATCCAAGCCTACGTTTTCACACTTCBAGTAA GCCTCTACCTGCACGACAAC'] |
| 1231 m.8851T > C | 4508 | MT-ATP6 | ['AAACCTAGCCATGGCCATCCCCTTAYGAGC GGGCACAGTGATTATAGGCTT'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1232 | m.9185T > C | 4508 | MT-ATP6 | ['TACGTTTTCACACTTCTAGTAAGCCYCTACC TGCACGACAACACATAATGA'] |
| 1233 | m.7587T > C | 4513 | MT-CO2 | ['ATAGGCTAAATCCTATATATCTTAAYGGCAC ATGCAGCGCAAGTAGGTCTA'] |
| 1234 | m.6742T > C | 4512 | MT-CO1 | ['GGTATGGTCTGAGCTATGATATCAAYTGGCT TCCTAGGGTTTATCGTGTGA'] |
| 1235 | m.6721T > C | 4512 | MT-CO1 | ['AAAGAACCATTTGGATACATAGGTAYGGTC TGAGCTATGATATCAATTGGC'] |
| 1236 | m.7275T > C | 4512 | MT-CO1 | ['CATGAAACATCCTATCATCTGTAGGYTCATT CATTTCTCTAACAGCAGTAA'] |
| 1237 | m.15572T > C | 4519 | MT-CYB | ['CATCAAGCCCGAATGATATTTCCTAYTCGCC TACACAATTCTCCGATCCGT'] |
| 1238 | m.15197T > C | 4519 | MT-CYB | ['GGCCACAGTAATTACAAACTTACTAYCCGCC ATCCCATACATTGGGACAGA'] |
| 1239 | m.14849T > C | 4519 | MT-CYB | ['CATCTCCGCATGATGAAACTTCGGCYCACTC CTTGGCGCCTGCCTGATCCT'] |
| 1240 | NC_012920.1: m.14484T > C | 4541 | MT-ND6 | ['GCTGTAGTATATCCAAAGACAACCAYCATTC CCCCTAAATAAATTAAAAAA'] |
| 1241 | m.14487T > C | 4541 | MT-ND6 | ['GTAGTATATCCAAAGACAACCATCAYTCCCC CTAAATAAATTAAAAAAACT'] |
| 1242 | m.12706T > C | 4540 | MT-ND5 | ['ATCAGTTCTTCAAATATCTACTCATYTTCCT AATTACCATACTAATCTTAG'] |
| 1243 | m.10563T > C | 4539 | MT-ND4L | ['CTCACACCTCATATCCTCCCTACTAYGCCTA GAAGGAATAATACTATCGCT'] |
| 1244 | m.10663T > C | 4539 | MT-ND4L | ['ATATTGTGCCTATTGCCATACTAGTYTTTGC CGCCTGCGAAGCAGCGGTNG'] |
| 1245 | m.10191T > C | 4537 | MT-ND3 | ['TTACGAGTGCGGCTTCGACCCTATAYCCCCC GCCCGCGTCCCTTTCTCCAT'] |
| 1246 | m.10158T > C | 4537 | MT-ND3 | ['ACAACTCAACGGCTACATAGAAAAAYCCAC CCCTTACGAGTGCGGCTTCGA'] |
| 1247 | m.4681T > C | 4536 | MT-ND2 | ['CAAGCAACCGCATCCATAATCCTTCYAATAG CTATCCTCTTCAACAATATA'] |
| 1248 | m.4160T > C | 4535 | MT-ND1 | ['TACCCCGATTCCGCTACGACCAACYCATAC ACCTCCTATGAAAAAACTTC'] |
| 1249 | m.3394T > C | 4535 | MT-ND1 | ['GCTTACCGAACGAAAAATTCTAGGCYATAT ACAACTACGCAAAGGCCCCAA'] |
| 1250 | m.3308T > C | 4535 | MT-ND1 | ['GGTTCAATTCCTCTTCTTAACAACABACCCA TGGCCAACCTCCTACTCCTC'] |
| 1251 | m.3949T > C | 4535 | MT-ND1 | ['ACTAGTCTCAGGCTTCAACATCGAAYACGCC GCAGGCCCCTTCGCCCTATT'] |
| 1252 | NM_003140.2(SRY): c.326T > C (p.Phe109Ser) | 6736 | SRY | ['CTTACTGAAGCCGAAAATGGCCATYCTTCC AGGAGGCACAGAAATTACAG'] |
| 1253 | NM_003140.2(SRY): c.203T > C (p.Ile68Thr) | 6736 | SRY | ['GTGAAGCGACCCATGAACGCATTCAYCGTG TGGTCTCGCGATCAGAGGCGC'] |
| 1254 | NM_021083.2(XK): c.880T > C (p.Cys294Arg) | 7504 | XK | ['ACTCTATACTGGTATCAACATGTTCNGCTGG TCTGCTGTACAGCTGAAAAT'] |
| 1255 | NM_000354.5(SERPINA7): c. 740T > C (p.Leu247Pro) | 6906 | SERPINA7 | ['CACCAGATGGAACAATACTATCACCYAGTG GATATGGAATTGAACTGCACA'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1256 | NM_000044.3(AR): c.2033T > C (p.Leu678Pro) | 367 | AR | ['TGTCAGCCCATCTTTCTGAATGTCCYGGAAG CCATTGAGCCAGGTGTAGTG'] |
| 1257 | NM_000044.3(AR): c.2423T > C (p.Met808Thr) | 367 | AR | ['ATCACCCCCAGGAATTCCTGTGCAYGAAA GCACTGCTACTCTTCAGCATT'] |
| 1258 | NM_000044.3(AR): c.2596T > C (p.Ser866Pro) | 367 | AR | ['CTACCAGCTCACCAAGCTCCTGGACYCCGTG CAGCCTGTAAGCAAACGATG'] |
| 1259 | NM_000451.3(SHOX): c.877T > C (p.Ter293Arg) | 6473 | SHOX | ['GAAGCACGCGGAGGCCCTGGGGCTCYGACC CGCCGCGCAGCCCCCCGCGCG'] |
| 1260 | NM_000330.3(RS1): c.286T > C (p.Trp96Arg) | -1 | — | ['TTGAGCCGGGCCTTGTTTGCAGTCCRCGAAG AATACCAGCCCACATACTGC'] |
| 1261 | NM_000330.3(RS1): c.38T > C (p.Leu13Pro) | 6247 | RS1 | ['ATAGAAGGCTTTTTGTTATTACTTCYCTTTG GCTATGAAGGTATGTGCTAT'] |
| 1262 | NM_000330.3(RS1): c.667T > C (p.Cys223Arg) | -1 | — | ['CCGAGCTGAGGCAGGCATCAGGCACRCTTG CTGACGCACTCCAGCAGCTCC'] |
| 1263 | NM_002764.3(PRPS1): c.344T > C (p.Met115Thr) | 5631 | PRPS1 | ['ATCTCAGCCAAGCTTGTTGCAAATAYGCTAT CTGTAGCAGGTGCAGATCAT'] |
| 1264 | NM_002764.3(PRPS1): c.455T > C (p.Leu152Pro) | 5631 | PRPS1 | ['AATTTGTATGCAGAGCCGGCTGTCCYAAAGT GGATAAGGGAGAATATCTCT'] |
| 1265 | NM_002764.3(PRPS1): c.869T > C (p.Ile290Thr) | 5631 | PRPS1 | ['TTTCCTTTCTTGCCTTTCTAGGTGAYTGACAT CTCTATGATCCTTGCAGAA'] |
| 1266 | NM_000291.3(PGK1): c.263T > C (p.Leu88Pro) | 5230 | PGK1 | ['CCAGTTGCTGTAGAACTCAAATCTCYGCTGG GCAAGTAAGTGCCAGGCTCT'] |
| 1267 | NM_000291.3(PGK1): c.946T > C (p.Cys316Arg) | 5230 | PGK1 | ['CACCTCTACCCCTCAGGGCTTGGACYGTGGT CCTGAAAGCAGCAAGAAGTA'] |
| 1268 | NM_000291.3(PGK1): c.758T > C (p.Ile253Thr) | 5230 | PGK1 | ['CATCATTTTGGCTCCCCTGTGTAGAYTGGCA CTTCTCTGTTTGATGAAGAG'] |
| 1269 | NM_001122606.1(LAMP2): c.961T > C (p.Trp321Arg) | 3920 | LAMP2 | ['CATTGCAAATAACAATCTCAGCTACYGGGA TGCCCCCTGGGAAGTTCTTA'] |
| 1270 | NM_000206.2(IL2RG): c.343T > C (p.Cys115Arg) | 3561 | IL2RG | ['ATTCTCTGAAGAAATCACTTCTGGCYGTCAG TTGCAAAAAAGGAGATCCA'] |
| 1271 | NM_000206.2(IL2RG): c.452T > C (p.Leu151Pro) | 3561 | IL2RG | ['ACACAGATGCTAAAACTGCAGAATCYGGGT AATTTGGAAAGAAAGGGTCAA'] |
| 1272 | NM_000194.2(HPRT1): c.122T > C (p.Leu41Pro) | 3251 | HPRT1 | ['GAAAGGGTGTTTATTCCTCATGGACYAATTA TGGACAGGTAAGTAAGATCT'] |
| 1273 | NM_000194.2(HPRT1): c.170T > C (p.Met57Thr) | 3251 | HPRT1 | ['CTTGCTCGAGATGTGATGAAGGAGAYGGGA GGCCATCACATTGTAGCCCTC'] |
| 1274 | NM_000132.3(F8): c.6554T > C (p.Leu2185Ser) | 2157 | F8 | ['ATTCGCAGCACTCTTCGCATGGAGTYGATGG GCTGTGATTTAAATAGTAAG'] |
| 1275 | NM_000132.3(F8): c.985T > C (p.Cys329Arg) | 2157 | F8 | ['GGACCTTGGACAGTTTCTACTGTTTYGTCAT ATCTCTTCCCACCAACATGG'] |
| 1276 | NM_000132.3(F8): c.5372T > C (p.Met1791Thr) | 2157 | F8 | ['AGAGCAGAAGTTGAAGATAATATCAYGGTG AGTTAAGGACAGTGGAATTAC'] |
| 1277 | NM_000132.3(F8): c.1754T > C (p.Ile585Thr) | 2157 | F8 | ['CCTTTCAATATATGTAATTAACAGAYAATGT CAGACAAGAGGAATGTCATC'] |
| 1278 | NM_000132.3(F8): c.935T > C (p.Phe312Ser) | 2157 | F8 | ['TCCTTGGAAATCTCGCCAATAACTTYCCTTA CTGCTCAAACACTCTTGATG'] |
| 1279 | NM_000132.3(F8): c.980T > C (p.Leu327Pro) | 2157 | F8 | ['TTGATGGACCTTGGACAGTTTCTACYGTTTT GTCATATCTCTTCCCACCAA'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1280 | NM_000132.3(F8): c.1174T > C (p.Ser392Pro) | 2157 | F8 | ['CTCTCCTTCCTTTATCCAAATTCGCYCAGTTG CCAAGAAGCATCCTAAAAC'] |
| 1281 | NM_000132.3(F8): c.1417T > C (p.Tyr473His) | 2157 | F8 | ['ATCAGGAATCTTGGGACCTTTACTTYATGGG GAAGTTGGAGACACACTGTT'] |
| 1282 | NM_000132.3(F8): c.1481T > C (p.Ile494Thr) | 2157 | F8 | ['AATCAAGCAAGCAGACCATATAACAYCTAC CCTCACGGAATCACTGATGTC'] |
| 1283 | NM_000132.3(F8): c.1729T > C (p.Ser577Pro) | 2157 | F8 | ['CCCTCTCCTCATCTGCTACAAAGAAYCTGTA GATCAAAGAGGAAACCAGGT'] |
| 1284 | NM_000132.3(F8): c.1958T > C (p.Val653Ala) | 2157 | F8 | ['CAGTTGTCAGTTTGTTTGCATGAGGYGGCAT ACTGGTACATTCTAAGCATT'] |
| 1285 | NM_000132.3(F8): c.2029T > C | 2157 | F8 | ['TTCTGTCTTCTTCTCTGGATATACCYTCAAAC ACAAAATGGTCTATGAAGA'] |
| 1286 | NM_000132.3 (F8): c.6193T > C | 2157 | F8 | ['GTTTCTTTACTTGGGCAAAGGACAGYGGGCC CCAAAGCTGGCCAGACTTCA'] |
| 1287 | NM_007325.4(GRIA3): c.2117T > C (p.Met706Thr) | 2892 | GRIA3 | ['GTGTACGAGAAAATGTGGTCTTACAYGAAA TCAGCGGAGCCATCTGTGTTT'] |
| 1288 | NM_000402.4(G6PD): c.1058T > C (p.Leu353Pro) | 2539 | G6PD | ['GAGGGCGAGGCCACCAAAGGGTACCYGGAC GACCCCACGGTGCCCCGCGGG'] |
| 1289 | NM_000402.4(G6PD): c.1054T > C (p.Tyr352His) | 2539 | G6PD | ['TGGAGGGCGAGGCCACCAAAGGGYACCT GGACGACCCCACGGTGCCCCG'] |
| 1290 | NM_001097642.2(GJB1): c.397T > C (p.Trp133Arg) | 2705 | GJB1 | ['GGTCCACATCTCAGGGACACTGTGGYGGAC CTATGTCATCAGCGTGGTGTT'] |
| 1291 | NM_000166.5(GJB1): c.407T > C (p.Val136Ala) | 2705 | GJB1 | ['TCAGGGACACTGTGGTGGACCTATGYCATC AGCGTGGTGTTCCGGCTGTTG'] |
| 1292 | NM_000032.4(ALAS2): c.595T > C (p.Tyr199His) | 212 | ALAS2 | ['TGTGTCCGTCTGGTGTAGTAATGATYACCTG GGCATGAGCCGACACCCTCA'] |
| 1293 | NM_020061.5(OPN1MW): c.607T > C (p.Cys203Arg) | 5956 | OPN1LW | ['CTGGCCCCACGGCCTGAAGACTTCAYGCGG CCCAGACGTGTTCAGCGGCAG'] |
| 1294 | NM_000513.2(OPN1MW): c.607T > C (p.Cys203Arg) | 2652 | OPN1MW | ['CTGGCCCCACGGCCTGAAGACTTCAYGCGG CCCAGACGTGTTCAGCGGCAG'] |
| 1295 | NM_000513.2(OPN1MW): c.529T > C (p.Trp177Arg) | 2652 | OPN1MW | ['GGCCATCGTGGGCATTGCCTTCTCCYGGATC TGGGCTGCTGTGTGGACAGC'] |
| 1296 | NM_000273.2(GPR143): c.397T > C (p.Trp133Arg) | 4935 | GPR143 | ['GCTGTTGTACAGTGCCTGCTTCTGGHGGCTG TTTTGCTATGCAGTGGATGC'] |
| 1297 | NM_000133.3(F9): c.52T > C (p.Cys18Arg) | 2158 | F9 | ['AGAATCACCAGGCCTCATCACCATCYGCCTT TTAGGATATCTACTCAGTGC'] |
| 1298 | NM_000133.3(F9): c.1058T > C (p.Val353Ala) | 2158 | F9 | ['TTCCTCAAATTTGGATCTGGCTATGYAAGTG GCTGGGGAAGAGTCTTCCAC'] |
| 1299 | NM_000133.3(F9): c.1144T > C (p.Cys382Arg) | 2158 | F9 | ['AGTTCCACTTGTTGACCGAGCCACAHGTCTT CGATCTACAAAGTTCACCAT'] |
| 1300 | NM_000133.3(F9): c.1328T > C (p.Ile443Thr) | 2158 | F9 | ['TGTGCAATGAAAGGCAAATATGGAAYATAT ACCAAGGTATCCCGGTATGTC'] |
| 1301 | NM_000133.3(F9): c.1357T > C (p.Trp453Arg) | 2158 | F9 | ['TACCAAGGTATCCCGGTATGTCAACYGGATT AAGGAAAAAACAAAGCTCAC'] |
| 1302 | NM_000133.3(F9): c.82T > C (p.Cys28Arg) | 2158 | F9 | ['TTTAGGATATCTACTCAGTGCTGAAYGTACA GGTTTGTTTCCTTTTTTAAA'] |
| 1303 | NM_000133.3(F9): c.277 + 2T > C | 2158 | F9 | ['CTGAATTTTGGAAGCAGTATGTTGGYAAGC AATTCATTTTATCCTCTAGCT'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1304 | NM_000133.3(F9): c.1031T > C (p.Ile344Thr) | 2158 | F9 | ['ATTGCTGACAAGGAATACACGAACAYCTTC CTCAAATTTGGATCTGGCTAT'] |
| 1305 | NM_000169.2(GLA): c.484T > C (p.Trp162Arg) | -1 | — | ['CATTGATGCCCAGACCTTTGCTGACYGGGGA GTAGATCTGCTAAAATTTGA'] |
| 1306 | NM_000169.2(GLA): c.806T > C (p.Val269Ala) | -1 | — | ['TTATTTCATTCTTTTTCTCAGTTAGYGATTGG CAACTTTGGCCTCAGCTGG'] |
| 1307 | NM_015107.2(PHF8): c.836T > C (p.Phe279Ser) | 23133 | PHF8 | ['CCAACAAATGCCAATCTGACTCTCTYTGAGT GCTGGAGCAGTTCCTCTAAT'] |
| 1308 | NM_033290.3 (MID1): c.1877T > C (p.Leu626Pro) | 4281 | MID1 | ['TATGATGCTTTGAACTCCATCCACCYCTACA CCTTCGACGTCGCATTTGCG'] |
| 1309 | NM_033290.3 (MID1): c.884T > C (p.Leu295Pro) | 4281 | MID1 | ['TTCAAGGTGATGAGGCTTCGCAAACYGGCT CAGCAGATTGCAAACTGCAAA'] |
| 1310 | NM_000444.5(PHEX): c.755T > C (p.Phe252Ser) | 5251 | PHEX | ['CAGTATCGGGATGCCCTTTACAAGTYCATGG TGGATACTGCCGTGCTTTTA'] |
| 1311 | NM_000444.5(PHEX): c.1664T > C (p.Leu555Pro) | 5251 | PHEX | ['CTCATAGGATTTCCAGCAGGAGAGCYCCAG AAGCCTTTCTTTTGGGGAACA'] |
| 1312 | NM_001205019.1(GK): c.1525T > C (p.Trp509Arg) | 2710 | GK | ['AGAAAGTGAAATTCGTTATTCTACAYGGAA GAAAGCTGTGATGAAGTCAAT'] |
| 1313 | NM_000475.4(NR0B1): c.890T > C (p.Leu297Pro) | 190 | NR0B1 | ['AACTGCTGGGCGTCCCTGCTCATGCYTGAGC TGGCCCAGGACCGCTTGCAG'] |
| 1314 | NM_000531.5(OTC): c.332T > C (p.Leu111Pro) | 5009 | OTC | ['CTTCTGGGAGGACATCCTTGTTTTCYTACCA CACAAGATATTCATTTGGGT'] |
| 1315 | NM_000531.5(OTC): c.134T > C (p.Leu45Pro) | 5009 | OTC | ['CTGAAGGGCCGTGACCTTCTCACTCYAAAA AACTTTACCGGAGAAGAAATT'] |
| 1316 | NM_000531.5(OTC): c.717+2T > C | 5009 | OTC | ['TTGGCAGAGCAGTATGCCAAAGAGGYATGC TCTTTACATGTAAAGCTATTA'] |
| 1317 | NM_001399.4(EDA): c.181T > C (p.Tyr61His) | 1896 | EDA | ['CCTCCACCTGCTGACGTTGTGCTGCYACCTA GAGTTGCGCTCGGAGTTGCG'] |
| 1318 | NM_001015877.1(PHF6): c.2T > C (p.Met1Thr) | 84295 | PHF6 | ['CATTCTAAAGGCAATTTAAAAATCAYGTCA AGCTCAGTTGAACAGAAAAAA'] |
| 1319 | NM_001128834.2(PLP1): c.487T > C (p.Trp163Arg) | 5354 | PLP1 | ['CATCACCTATGCCCTGACCGTTGTGYGGCTC CTGGTGTTTGCCTGCTCTGC'] |
| 1320 | NM_001128834.2(PLP1): c.671T > C (p.Leu224Pro) | 5354 | PLP1 | ['CCTGGCAAGGTTTGTGGCTCCAACCYTCTGT CCATCTGCAAAACAGCTGAG'] |
| 1321 | NM_001128834.2(PLP1): c.560T > C (p.Ile187Thr) | 5354 | PLP1 | ['AACACCTGGACCACCTGCCAGTCTAYTGCCT TCCCCAGCAAGACCTCTGCC'] |
| 1322 | NM_001128834.2(PLP1): c.710T > C (p.Phe237Ser) | 5354 | PLP1 | [ATTTTCCTGCAGTTCCAAATGACCTYCCACC TGTTTATTGCTGCATTTGTG'] |
| 1323 | NM_000116.4(TAZ): c.352T > C (p.Cys118Arg) | 6901 | TAZ | ['CTCCCACTTCTTCAGCTTGGGCAAGYGTGTG CCTGTGTGCCGAGGTGAGCT'] |
| 1324 | NM_000377.2(WAS): c.244T > C (p.Ser82Pro) | 7454 | WAS | ['CTTCGTGAAGGATAACCCCCAGAAGYCCTA CTTCATCCGCCTTTACGGCCT'] |
| 1325 | NM_000377.2(WAS): c.809T > C (p.Leu270Pro) | 7454 | WAS | ['AACCTCGACCCAGATCTGCGGAGTCYGTTCT CCAGGGCAGGAATCAGCGAG'] |
| 1326 | NM_182680.1(AMELX): c.2T > C (p.Met1Thr) | -1 | — | ['CTTACATTTCAGAACCATCAAGAAAYGGGG ACCTGGATTTTATTTGCCTGC'] |
| 1327 | NM_000074.2(CD40LG): c.464T > C (p.Leu155Pro) | 959 | CD40LG | ['ACCATGAGCAACAACTTGGTAACCCYGGAA AATGGGAAACAGCTGACCGTT'] |

TABLE 6-continued

Diseases/disorders containging T to C Changes.The table includes human gene mutations that may be corrected by changing a cytosine (C) to a thymine (T). The gene name, gene symbol,and Gene ID are indicated.

| SEQ ID NO: | Name | Gene ID | Gene Symbol | Flanks |
|---|---|---|---|---|
| 1328 | NM_139058.2(ARX): c.98T > C (p.Leu33Pro) | 170302 | ARX | ['TCCTCCTACTGCATCGACAGCATCCYGGGCC GGAGGAGCCCGTGCAAAATG'] |
| 1329 | NM_001109878.1(TBX22): c.641T > C (p.Leu214Pro) | 50945 | TBX22 | ['TGATCATTTCTCCTCCAGATCATTCYGCAAT CCATGCATAAGTACAAACCC'] |
| 1330 | NM_000061.2(BTK): c.2T > C (p.Met1Thr) | 695 | BTK | ['GGTGAACTCCAGAAAGAAGAAGCTAYGGCC GCAGTGATTCTGGAGAGCATC'] |
| 1331 | NM_000061.2(BTK): c.1223T > C (p.Leu408Pro) | 695 | BTK | ['AAGGACCTGACCTTCTTGAAGGAGCYGGGG ACTGGACAATTTGGGGTAGTG'] |
| 1332 | NM_000061.2(BTK): c.1516T > C (p.Cys506Arg) | 695 | BTK | ['GCTGCTAGAGATGTGCAAGGATGTCYGTGA AGCCATGGAATACCTGGAGTC'] |
| 1333 | NM_000061.2(BTK): c.1625T > C (p.Leu542Pro) | 695 | BTK | ['GTTGTTAAAGTATCTGATTTCGGCCYGTCCA GGTGAGTGTGGCTTTTTCAT'] |
| 1334 | NM_000061.2(BTK): c.1741T > C (p.Trp581Arg) | 695 | BTK | ['CAAGTTCAGCAGCAAATCTGACATTYGGGC TTTTGGTAAGTGGATAAGATT'] |
| 1335 | NM_000061.2(BTK): c.1955T > C (p.Leu652Pro) | 695 | BTK | ['TTCAAAATTCTTCTGAGCAATATTCYAGATG TCATGGATGAAGAATCCTGA'] |
| 1336 | NM_015884.3(MBTPS2): c.1424T > C (p.Phe475Ser) | 51360 | MBTPS2 | ['GATGGACAATGGATTCTAAACTCTTYCTTGG ATGCCACCCTTACCTCAGTG'] |
| 1337 | NM_014009.3(FOXP3): c.970T > C (p.Phe324Leu) | 50943 | FOXP3 | ['GATTCATCCCCACCCTCTGACAGAGYTCCTC CACAACATGGACTACTTCAA'] |
| 1338 | NM_014009.3(FOXP3): c.1099T > C (p.Phe367Leu) | 50943 | FOXP3 | ['GACACTCAATGAGATCTACCACTGGYTCAC ACGCATGTTTGCCTTCTTCAG'] |
| 1339 | NM_022567.2(NYX): c.302T > C (p.Ile101Thr) | 60506 | NYX | ['CTGCGCCACAACAACCTGTCCTTCAYCACGC CCGGCGCCTTCAAGGGCCTG'] |
| 1340 | NM_003639.4(IKBKG): c.1249T > C (p.Cys417Arg) | 8517 | EKBKG | ['CACCCTGCAGATACATGTCATGGAGYGCATT GAGTAGGGCCGGCCAGTGCA'] |
| 1341 | NM_006579.2(EBP): c.53T > C (p.Leu18Pro) | 10682 | EBP | ['CCATACTGGCCTCAGCACCTAAGACYGGAC AACTTTGTACCTAATGACCGC'] |
| 1342 | NM_003159.2(CDKL5): c.215T > C (p.Ile72Thr) | 6792 | CDKL5 | ['CTTCGGACTCTCAAGCAGGAAAACAHTGTG GAGTTGAAGGAAGCATTTCGT'] |
| 1343 | NM_001011658.3(TRAPPC2): c. 248T > C (p.Phe83Ser) | -1 | — | ['GCCTTAATTATTTCACATATGAGGTYTATTA TGCTTCATGACATAAGACAA'] |
| 1344 | NM_001011658.3(TRAPPC2): c. 238 + 4T > C | -1 | — | ['AGTTACCTTTACTAAGAAGGTAAGGRTATGC CCCGCAGTGACAAATGCCGA'] |
| 1345 | NM_003688.3(CASK): c.802T > C (p.Tyr268His) | 8573 | CASK | ['GGATCCAGCTGAAAGGATCACTGTTYATGA AGCACTGAATCACCCATGGCT'] |
| 1346 | NM_003688.3(CASK): c.2740T > C (p.Trp914Arg) | 8573 | CASK | ['TGAGCTCGTGTGCACAGCCCCACAGYGGGT CCCTGTCTCCTGGGTCTATTA'] |
| 1347 | NM_001159702.2(FHL1): c.457T > C (p.Cys153Arg) | 2273 | FHL1 | ['AGGGGAGGACTTCTACTGCGTGACTYGCCA TGAGACCAAGTTTGCCAAGCA'] |
| 1348 | NM_001159702.2(FHL1): c.310T > C (p.Cys104Arg) | 2273 | FHL1 | ['GGAGGACTCCCCCAAGTGCAAGGGGYGCTT CAAGGCCATTGTGGCAGGTAC'] |
| 1349 | NM_001159702.2(FHL1): c.625T > C (p.Cys209Arg) | 2273 | FHL1 | ['CACCGCTGTGGAGGACCAGTATTACYGCGT GGATTGCTACAAGAACTTTGT'] |
| 1350 | NM_001363.4(DKC1): c.113T > C (p.Ile38Thr) | 1736 | DKC1 | ['ATACAACACGCTGAAGAATTTCTTANCAAA CCTGAATCCAAAGTTGCTAAG'] |
| 1351 | NM_178152.2(DCX): c.373T > C (p.Tyr125His) | 1641 | DCX | ['CTTATTTCTTGCCTTAGGGGAAAGCYATGTC TGTTCCTCAGACAACTTCTT'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1352 | NM_005183.3(CACNA1F): c.2267T > C (p.Ile756Thr) | 778 | CACNAF | ['ATCCTGTTGAACGTGTTTCTTGCCAYTGCTG TGGACAACCTGGCCAGTGGA'] |
| 1353 | NM_001493.2(GDI1): c.275T > C (p.Leu92Pro) | 2664 | GDI1 | ['ACAGGGCAGCTGGTAAAGATGCTACYGTAT ACAGAGGTGACTCGCTACCTG'] |
| 1354 | NM_006517.4(SLC16A2): c.1313T > C (p.Leu438Pro) | 6567 | SLC16A2 | ['ATCATGGCCCCCATTGCATTTGAGCYGGTGG GCCCAATGCAGGCCTCACAG'] |
| 1355 | NM_006517.4(SLC16A2): c.1190T > C (p.Leu397Pro) | 6567 | SLC16A2 | ['CTCCAGGTCCTTTCCTTCCTGCTCCYGGGCC TGATGTCCATGATGATTCCC'] |
| 1356 | NM_006517.4(SLC16A2): c.1481T > C (p.Leu494Pro) | 6567 | SLC16A2 | ['CCCCCCATCATCGGGGCTGTAATCCYCTTCT TCGTCCCTCTGATGCATCAA'] |
| 1357 | NM_004586.2(RPS6KA3): c.803T > C (p.Phe268Ser) | 6197 | RPS6KA3 | ['GAAATGCTTACTGGTACACTCCCTTYCCAAG GAAAAGATCGAAAAGAAACA'] |
| 1358 | NM_000489.4(ATRX): c.4840T > C (p.Cys1614Arg) | 546 | ATRX | ['AAGTTTTCTTCATACAGTTCTTTTGYGTGAC AAACTGGATTTCAGCACGGC'] |
| 1359 | NM_000489.4(ATRX): c.6250T > C (p.Tyr2084His) | 546 | ATRX | ['GAAGTGGCTTCGAAACATTGACTATYACCGT TTAGATGGTTCCACTACTGC'] |
| 1360 | NM_000489.4(ATRX): c.1226T > C (p.Leu409Ser) | 546 | ATRX | ['GATATTAAGAAGGCTCATCTTGCATYGGAA GAAGACTTAAATTCCGAGTTT'] |
| 1361 | NM_000489.4(ATRX): c.6149T > C (p.Ile2050Thr) | 546 | ATRX | ['CAGTCCCTCATATCTCTGGACTTGAYTGAAG ATTTTCTTGAATTAGCTAGT'] |
|  | NM_001110556.1(FLNA): c.720 + 2T > C | 2316 | FLNA |  |
| 1362 | NM_001127899.3(CLCN5): c.1768T > C (p.Ser590Pro) | 1184 | CLCN5 | ['AGGTGGGGTGACTCGGATGACTGTTYCTCTT GTTGTCATAATGTTTGAACT'] |
| 1363 | NM_004992.3(MECP2): c.464T > C (p.Phe155Ser) | 4204 | MECP2 | ['GACACATCCCTGGACCCTAATGATBTGACT TCACGGTAACTGGGAGAGGG'] |
| 1364 | NM_001061.4(TBXAS1): c.1463T > C (p.Leu488Pro) | 6916 | TBXAS1 | ['TGCCTCGGGGTGCGTCTAGGGCTGCYTGAG GTCAAGTTGACACTGCTCCAC'] |
| 1365 | NM_001061.4(TBXAS1): c.248T > C (p.Leu83Pro) | 6916 | TBXAS1 | ['TTTTTTATTCCTCCCAGGTACTATCYTGGTCG TCGGATGTTTATTGTTATT'] |
| 1366 | NM_000128.3(F11): c.901T > C (p.Phe301Leu) | 2160 | F11 | ['TTCTTCATTTTACCATGACACTGATYTCTTGG GAGAAGAACTGGATATTGT'] |
| 1367 | NM_000128.3(F11): c.166T > C (p.Cys56Arg) | 2160 | F11 | ['GGTAGTCTGCACTTACCACCCAAGAYGTTTA CTCTTCACTTTCACGGCGGA'] |
| 1368 | NM_000203.4(IDUA): c.1469T > C (p.Leu490Pro) | 3425 | IDUA | ['AGCCCCGACGGCGAGTGGCGGCGCCYGGGC CGGCCCGTCTTCCCCACGGCA'] |
| 1369 | NM_000431.3(MVK): c.803T > C (p.Ile268Thr) | 4598 | MVK | ['ATCGTGGCCCCCCTCCTGACCTCAAYAGATG CCATCTCCCTGGAGTGTGAG'] |
| 1370 | NM_014425.3 (INVS): c.1478T > C (p.Leu493Ser) | 27130 | INVS | ['TTATGCTTATAGGGAAGAACAGCTTYGCATT GGTCCTGCAACAATGGATAC'] |
| 1371 | NM_000108.4(DLD): c.1178T > C (p.Ile393Thr) | 1738 | DLD | ['GACTACAATTGTGTGCCATCAGTGAYTTACA CACACCCTGAAGTTGCTTGG'] |
| 1372 | NM_000170.2(GLDC): c.2T > C (p.Met1Thr) | 2731 | GLDC | ['GGGCAGGGGACGGTGGCCGCGGCCAYGCAG TCCTGTGCCAGGGCGTGGGGG'] |
| 1373 | NM_000151.3(G6PC): c.229T > C (p.Trp77Arg) | 2538 | G6PC | ['AGACTGGCTCAACCTCGTCTTTAAGYGGTAA GAACCATATAGAGAGGAGAT'] |
| 1374 | NM_004453.3 (ETFDH): c.2T > C (p.Met1Thr) | 2110 | ETFDH | ['CCGAGAGTCCTGGTGACTTTGAACAYGCTG GTGCCGCTAGCCAAGCTGTCC'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1375 | NM_000136.2(FANCC): c.1661T > C (p.Leu554Pro) | -1 | — | ['CTGGCCCGAGAGCTCCTTAAAGAGCYGCGA ACTCAAGTCTAGAAGGCACGC'] |
| 1376 | NM_000131.4(F7): c.38T > C (p.Leu13Pro) | 2155 | F7 | ['GCCCTCAGGCTCCTCTGCCTTCTGCYTGGGC TTCAGGGCTGCCTGGCTGCA'] |
| 1377 | NM_000131.4(F7): c.983T > C (p.Phe328Ser) | 2155 | F7 | ['CCCCTCTGCCTGCCCGAACGGACGTYCTCTG AGAGGACGCTGGCCTTCGTG'] |
| 1378 | NM_024649.4(BBS1): c.1553T > C (p.Leu518Pro) | -1 | — | ['ACAACCCGTCCTGTCCTGGGGCTGCYGGTCT GCTTCCTGTACAACGAGGCG'] |
| 1379 | NM_000490.4(AVP): c.200T > C (p.Val67Ala) | 551 | AVP | ['TGCGCGGACGAGCTGGGCTGCTTCGYGGGC ACGGCTGAGGCGCTGCGCTGC'] |
| 1380 | NM_000490.4(AVP): c.61T > C (p.Tyr21His) | 551 | AVP | ['CCTACTGGCCTTCTCCTCCGCGTGCYACTTC CAGAACTGCCCGAGGGGCGG'] |
| 1381 | NM_001692.3 (ATP6V1B1): c.242T > C (p.Leu81Pro) | 525 | ATP6V1B1 | ['GGGACTCAGAGGAGCGGGCAGGTGCYTGAG GTGGCTGGCACCAAGGCGATT'] |
| 1382 | NM_003361.3 (UMOD): c.649T > C (p.Cys217Arg) | 7369 | UMOD | ['GGGCGGTGCGCGCATGGCCGAGACCBGCGT GCCAGTCCTGCGCTGCAACAC'] |
| 1383 | NM_003361.3 (UMOD): c.376T > C (p.Cys126Arg) | 7369 | UMOD | ['TAGCCACTGCCACGCCCTGGCCACAYGTGTC AATGTGGTGGGCAGCTACTT'] |
| 1384 | NM_003361.3 (UMOD): c.943T > C (p.Cys315Arg) | 7369 | UMOD | ['CAAATCGAATAATGGCAGATGGCACYGCCA GTGCAAACAGGACTTCAACAT'] |
| 1385 | NM_080911.2(UNG): c.752T > C (p.Phe251Ser) | 7374 | UNG | ['AATCAGAACTCGAATGGCCTTGTTTYCTTGC TCTGGGGCTCTTATGCTCAG'] |
| 1386 | NM_199292.2(TH): c.707T > C (p.Leu236Pro) | 7054 | TH | ['CAGGTGTACCGCCAGCGCAGGAAGCYGATT GCTGAGATCGCCTTCCAGTAC'] |
| 1387 | NM_001065.3(TNFRSF1A): c.175T > C (p.Cys59Arg) | 7132 | TNFRSF1A | ['CCACCCTCAAAATAATTCGATTTGCYGTACC AAGTGCCACAAAGGTAGGGG'] |
| 1388 | NM_001065.3(TNFRSF1A): c.349T > C (p.Cys117Arg) | 7132 | TNFRSF1A | ['AATGGGTCAGGTGGAGATCTCTTCTYGCACA GTGGACCGGGACACCGTGTG'] |
| 1389 | NM_000546.5(TP53): c.755T > C (p.Leu252Pro) | 7157 | TP53 | ['GGCGGCATGAACCGGAGGCCCATCCYCACC ATCATCACACTGGAAGACTCC'] |
| 1390 | NM_000546.5(TP53): c.398T > C (p.Met133Thr) | 7157 | TP53 | ['CAGTACTCCCCTGCCCTCAACAAGAYGTTTT GCCAACTGGCCAAGACCTGC'] |
| 1391 | NM_000546.5(TP53): c.1031T > C (p.Leu344Pro) | 7157 | TP53 | ['GAGCGCTTCGAGATGTTCCGAGAGCYGAAT GAGGCCTTGGAACTCAAGGAT'] |
| 1392 | NM_001018005.1(TPM1): c.284T > C (p.Val95Ala) | 7168 | TPM1 | ['TCTCTGAACAGACGCATCCAGCTGGYTGAG GAAGAGTTGGATCGTGCCCAG'] |
| 1393 | NM_001159287.1(TPI1): c.832T > C (p.Phe278Leu) | 7167 | TPI1 | ['GGGTGGTGCTTCCCTCAAGCCCGAAYTCGTG GACATCATCAATGCCAAACA'] |
| 1394 | NM_003242.5(TGFBR2): c.923T > C (p.Leu308Pro) | 7048 | TGFBR2 | ['AAGCATGAGAACATACTCCAGTTCCYGACG GCTGAGGAGCGGAAGACGGAG'] |
| 1395 | NM_000660.5(TGFB1): c.673T > C (p.Cys225Arg) | 7040 | TGFB1 | ['CTTTCGCCTTAGCGCCCACTGCTCCYGTGAC AGCAGGGATAACACACTGCA'] |
| 1396 | NM_000660.5(TGFB1): c.241T > C (p.Tyr81His) | 7040 | TGFB1 | ['GCTGCCCGAGGCCGTGCTCGCCCTGYACAA CAGCACCCGCGACCGGGTGGC'] |
| 1397 | NM_000660.5(TGFB1): c.667T > C (p.Cys223Arg) | 7040 | TGFB1 | ['TGAGGGCTTTCGCCTTAGCGCCCACNGCTCC TGTGACAGCAGGGATAACAC'] |
| 1398 | NM_001128177.1(THRB): c.929T > C (p.Met310Thr) | 7068 | THRB | ['ATCATCCTCCTCAAAGGCTGCTGCAYGGAA ATCATGTCCCTTCGCGCTGCT'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1399 | NM_001128177.1(THRB): c.1336T ? C (p.Cys446Arg) | 7068 | THRB | ['CCGCTTCCTGCACATGAAGGTGGAAYGCCC CACAGAACTCTTCCCCCCTTT'] |
| 1400 | NM_001128177.1(THRB): c.1373T > C (p.Val458Ala) | 7068 | THRB | ['CTCTTCCCCCCTTTGTTCTTGGAAGYGTTCG AGGATTAGACTGACTGGATT'] |
| 1401 | NM_007313.2(ABL1): c.814T > C (p.Tyr272His) | 25 | ABL1 | ['GAAGCACAAGCTGGGCGGGGGCCAGYACGG GGAGGTGTACGAGGGCGTGTG'] |
| 1402 | NM_007313.2(ABL1): c.988T > C (p.Phe330Leu) | 25 | ABL1 | ['AGGGGTCTGCACCCGGGAGCCCCCGYTCTA TATCATCACTGAGTTCATGAC'] |
| 1403 | NM_007313.2(ABL1): c.1109T > C (p.Met370Thr) | 25 | ABL1 | ['ATGGCCACTCAGATCTCGTCAGCCAYGGAG TACCTGGAGAAGAAAAACTTC'] |
| 1404 | NM_021961.5(TEAD1): c.1261T > C (p.Tyr?His) | 7003 | TEAD1 | ['TGAACACGGAGCACAACATCATATTYACAG GCTTGTAAAGGACTGAACATG'] |
| 1405 | NM_001256850.1(TTN): c.2926T > C (p.Trp976Arg) | 7273 | TTN | ['TGGATACCCATCCCCGACAGTGACAHGGTA CAGGGAAGACTACCAAATCGA'] |
| 1406 | NM_133378.4(TTN): c.100163T > C (p.Leu33388Pro) | −1 | — | ['GAAAACACAGATGACCTGACAACCCYGATC ATCATGGACGTACAGAAACAA'] |
| 1407 | NM_003235.4(TG): c.3733T > C (p.Cys1245Arg) | 7038 | TG | ['CCCCACAGGCTCTGCCATGCAGCAGYGCCA ATTGCTGTGCCGCCAGGGCTC'] |
| 1408 | NM_003235.4(TG): c.3229T > C (p.Cys1077Arg) | 7038 | TG | ['TCTCTCTCCCACAGGCCCGACAACCYGCGAG AAATCTCGAACCAGTGGGCT'] |
| 1409 | NM_000733.3(CD3E): c.520 + 2T > C | 916 | CD3E | ['CGGGTGCTGGCGGCAGGCAAAGGGGYAAGG CTGTGGAGTCCAGTCAGAGGA'] |
| 1410 | NM_003000.2(SDHB): c.487T > C (p.Ser163Pro) | 6390 | SDHB | ['GCCTTATTTGAAGAAGAAGGATGAAYCTCA GGAAGGCAAGCAGCAGTATCT'] |
| 1411 | NM_003106.3(SOX2): c.290T > C (p.Leu97Pro) | −1 | — | ['CCGTTCATCGACGAGGCTAAGCGGCYGCGA GCGCTGCACATGAAGGAGCAC'] |
| 1412 | NM_001024858.2(SPTB): c.604T > C (p.Trp202Arg) | 6710 | SPTB | ['TAATGTCACCAACTTTACCTCCAGCYGGAAG GATGGCTTGGCCTTTAATGC'] |
| 1413 | NM_001024858.2(SPTB): c.6055T > C (p.Ser2019Pro) | 6710 | SPTB | ['GGTGTGCCAGTTCTCGAGGGATGCCYCTGTG GCTGAGGCGTGGCTGATTGC'] |
| 1414 | NM_003126.2(SPTA1): c.779T > C (p.Leu260Pro) | 6708 | SPTA1 | ['TTGGCTCTCCAGAGACAGAAAGCTCBGTCCA ATGCTGCAAACTTACAACGA'] |
| 1415 | NM_003126.2(SPTA1): c.781T > C (p.Ser261Pro) | 6708 | SPTA1 | ['GGCTCTCCAGAGACAGAAAGCTCTGYCCAA TGCTGCAAACTTACAACGATT'] |
| 1416 | NM_003126.2(SPTA1): c.620T > C (p.Leu207Pro) | 6708 | SPTA1 | ['AAATTTGAAGACTTCCAAGTGGAGCYGGTA GCTAAGAAGGGAGAGTTGTT'] |
| 1417 | NM_005633.3(SOS1): c.1294T > C (p.Trp432Arg) | 6654 | SOS1 | ['CGAGATTCAGAAGAATATTGATGGTYGGGA GGGAAAAGACATTGGACAGTG'] |
| 1418 | NM_006920.4(SCN1A): c.3577T > C (p.Trp1193Arg) | −1 | — | ['TGTGGAAGAAGGCAGAGGAAAACAAYGGT GGAACCTGAGAAGGACGTGTTT'] |
| 1419 | NM_006920.4(SCN1A): c.4250T > C (p.Val1417Ala) | −1 | — | ['TTTGGGTATCTCTCTTTGCTTCAAGYGTAA GTGAACACTATTTTCTCTGA'] |
| 1420 | NM_006920.4(SCN1A): c.434T > C (p.Met145Thr) | 6323 | SCN1A | ['ACTATTTTGACAAACTGTGTGTTTAHGACAA TGAGTAACCCTCCTGATTGG'] |
| 1421 | NM_006920.4(SCN1A): c.4462T > C (p.Phe1488Leu) | −1 | — | ['TCTATACTTTGGAGGTCAAGACATCYTTATG ACAGAAGAACAGAAGAAATA'] |
| 1422 | NM_152296.4(ATP1A3): c.821T > C (p.Ile274Thr) | 478 | ATP1A3 | ['GGGCTGGAGGTGGGCAAGACGCCCAHCGCC ATCGAGATTGAGCACTTCATC'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1423 | NM_152296.4(ATP1A3): c.2338T > C (p.Phe780Leu) | 478 | ATP1A3 | ['CAGCAATATCCCGGAGATCACGCCCYTCCTG CTGTTCATCATGGCCAACAT'] |
| 1424 | NM_000702.3(ATP1A2): c.2291T > C (p.Leu764Pro) | 477 | ATP1A2 | ['CCTCAGAATCTCCCCACAGGCCGCCYGATCT TTGACAACTTGAAGAAATCC'] |
| 1425 | NM_000702.3(ATP1A2): c.2659T > C (p.Trp887Arg) | 477 | ATP1A2 | ['ACGGCTACTGGGAATCCGCCTCGACYGGGA TGACCGGACCATGAATGATCT'] |
| 1426 | NM_000702.3(ATP1A2): c.2192T > C (p.Met731Thr) | 477 | ATP1A2 | ['AAGAAGGCTGACATTGGCATTGCCAYGGGC ATCTCTGGCTCTGACGTCTCT'] |
| 1427 | NM_000702.3(ATP1A2): c.857T > C (p.Ile286Thr) | 477 | ATP1A2 | ['GGGCGGACACCCATAGCAATGGAGAYTGAA CACTTCATCCAGCTGATCACA'] |
| 1428 | NM_001035.2(RYR2): c.1298T > C (p.Leu433Pro) | 6262 | RYR2 | ['ATGTTTATGGTTTATTTTAGGGGCCYTGATG CTCTCAGCAAGAAAGCGAAG'] |
| 1429 | NM_000540.2(RYR1): c.14693T > C (p.Ile4898Thr) | 6261 | RYR1 | ['GTGGGTGTCCGGGCTGGCGGAGGCAYTGGG GACGAGATCGAGGACCCCGCG'] |
| 1430 | NM_000539.3(RHO): c.133T > C (p.Phe45Leu) | 6010 | RHO | ['GTTCTCCATGCTGGCCGCCTACATGTTCTG CTGATCGTGCTGGGCTTCCC'] |
| 1431 | NM_000321.2(RB1): c.1960+2T > C | 5925 | RB1 | ['CTCTTTCACTGTTTTATAAAAAGGYTAGTA GATGATTATTTTCAAGAGCA'] |
| 1432 | NM_000321.2(RB1): c.2134T > C (p.Cys712Arg) | 5925 | RB1 | ['TATGATGTGTTCCATGTATGGCATAYGCAAA GTGAAGAATATAGACCTTAA'] |
| 1433 | NM_000329.2(RPE65): c.1022T > C (p.Leu341Ser) | 6121 | RPE65 | ['AGATTTGAGTTTGTTTATAATTACTYATATTT AGCCAATTTACGTGAGAAC'] |
| 1434 | NM_000322.4(PRPH2): c.554T > C (p.Leu185Pro) | 5961 | PRPH2 | ['ATTCAGTGGATCAGCAATCGCTACCYGGACT TTTCCTCCAAAGAAGTCAAA'] |
| 1435 | NM_000322.4(PRPH2): c.2T > C (p.Met1Thr) | 5961 | PRPH2 | ['CAACCCGGACTACACTTGGCAAGCAYGGCG CTACTGAAAGTCAAGTTTGAC'] |
| 1436 | NM_001098668.2(SFTPA2): c.593T > C (p.Phe198Ser) | 729238 | SFTPA2 | ['ACTGAGGGTCCCAGCCCTGGAGACTYCCGC TACTCAGATGGGACCCCTGTA'] |
| 1437 | NM_003018.3(SFTPC): c.218T > C (p.Ile73Thr) | 6440 | SFTPC | ['TTTCCCCAGGTTCTGGAGATGAGCAHTGGGG CGCCGGAAGCCCAGCAACGC'] |
| 1438 | NM_003018.3 (SFTPC): c.581T > C (p.Leu194Pro) | 6440 | SFTPC | ['AGCACCCTGTGTGGCGAGGTGCCGCYCTACT ACATCTAGGACGCCTCCGGT'] |
| 1439 | NM_000055.2(BCHE): c.1004T > C (p.Leu335Pro) | 590 | BCHE | ['CTCACTGACATGCCAGACATATTACYTGAAC TTGGACAATTTAAAAAAACC'] |
| 1440 | NM_002739.3(PRKCG): c.355T > C (p.Ser119Pro) | 5582 | PRKCG | ['CCCCACCTTCTGCGACCACTGTGGCYCCCTC CTCTACGGGCTTGTGCACCA'] |
| 1441 | NM_002739.3(PRKCG): c.1927T > C (p.Phe643Leu) | 5582 | PRKCG | ['ACAGTGTGGCCGCAGCGGCGAGAACYTTGA CAAGTTCTTCACGCGGGCGGC'] |
| 1442 | NM_000141.4(FGFR2): c.1018T > C (p.Tyr340His) | 2263 | FGFR2 | ['TGTAACTTTTGAGGACGCTGGGGAAYATAC GTGCTTGGCGGGTAATTCTAT'] |
| 1443 | NM_000141.4(FGFR2): c.1024T > C (p.Cys342Arg) | 2263 | FGFR2 | ['TTTTGAGGACGCTGGGGAATATACHGCTTG GCGGGTAATTCTATTGGGAT'] |
| 1444 | NM_000141.4(FGFR2): c.868T > C (p.Trp290Arg) | 2263 | FGFR2 | ['CAGTGATGCCCAGCCCCACATCCAGBGGAT CAAGCACGTGGAAAAGAACGG'] |
| 1445 | NM_000141.4(FGFR2): c.799T > C (p.Ser267Pro) | 2263 | FGFR2 | ['CCAAGCCGGACTGCCGGCAAATGCCYCCAC AGTGGTCGGAGGAGACGTAGA'] |
| 1446 | NM_000506.3(F2): c.1139T > C (p.Met380Thr) | 2147 | F2 | ['CCTGCTGCCCTCCCAGGCAGGTGAYGCTTT TCCGGAAGAGTCCCCAGGAG'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1447 | NM_000313.3 (PROS1): c.1501T > C (p.Ser501Pro) | 5627 | PROS1 | ['TTCATTATTTTAAATAGATAATGTABCCAGT GCTGAGGGTTGGCATGTAAA'] |
| 1448 | NM_002834.3(PTPN11): c.854T > C (p.Phe285Ser) | 5781 | PTPN11 | ['TGACCGTGGTCTCTTTTTCTTCTAGNTGATCA TACCAGGGTTGTCCTACAC'] |
| 1449 | NM_002755.3(MAP2K1): c.158T > C (p.Phe53Ser) | 5604 | MAP2K1 | ['CAGCAGCGAAAGCGCCTTGAGGCCTYTCTT ACCCAGAAGCAGAAGGTGGGA'] |
| 1450 | NM_001042465.1(PSAP): c.1055T > C (p.Leu352Pro) | 5660 | PSAP | ['GCTTTTGACAAAATGTGCTCGAAGCYGCCG AAGTCCCTGTCGGAAGAGTGC'] |
| 1451 | NM_000207.2(INS): c.143T > C (p.Phe48Ser) | -1 | — | ['TACCTAGTGTGCGGGGAACGAGGCTBCTTCT ACACACCCAAGACCCGCCGG'] |
| 1452 | NM_000311.3(PRNP): c.593T > C (p.Phe198Ser) | 5621 | PRNP | ['ACCACAACCACCAAGGGGGAGAACTYCACC GAGACCGACGTTAAGATGATG'] |
| 1453 | NM_000371.3(TTR): c.149T > C (p.Val50Ala) | 7276 | TTR | ['GGCAGTCCTGCCATCAATGTGGCCGBGCATG TGTTCAGAAAGGCTGCTGAT'] |
| 1454 | NM_000371.3(TTR): c.224T > C (p.Leu75Pro) | 7276 | TTR | ['AGGAAAACCAGTGAGTCTGGAGAGCYGCAT GGGCTCACAACTGAGGAGGAA'] |
| 1455 | NM_000371.3(TTR): c.88T > C (p.Cys30Arg) | 7276 | TTR | ['CACCCAGGGCACCGGTGAATCCAAGYGTCC TCTGATGGTCAAAGTTCTAGA'] |
| 1456 | NM_000371.3(TTR): c.272T > C (p.Val91Ala) | 7276 | TTR | ['GAATTTGTAGAAGGGATATACAAAGYGGAA ATAGACACCAAATCTTACTGG'] |
| 1457 | NM_000371.3(TTR): c.400T > C (p.Tyr134His) | 7276 | TTR | ['CACCATTGCCGCCCTGCTGAGCCCCYACTCC TATTCCACCACGGCTGTCGT'] |
| 1458 | NM_000371.3(TTR): c.250T > C (p.Phe84Leu) | 7276 | TTR | ['GCATGGGCTCACAACTGAGGAGGAAYTTGT AGAAGGGATATACAAAGTGGA'] |
| 1459 | NM_000371.3(TTR): c.157T > C (p.Phe53Leu) | 7276 | TTR | ['TGCCATCAATGTGGCCGTGCATGTGHTCAGA AAGGCTGCTGATGACACCTG'] |
| 1460 | NM_000371.3(TTR): c.95T > C (p.Leu32Pro) | 7276 | TTR | ['GGCACCGGTGAATCCAAGTGTCCTCYGATG GTCAAAGTTCTAGATGCTGTC'] |
| 1461 | NM_000371.3(TTR): c.191T > C (p.Phe64Ser) | 7276 | TTR | ['GCTGCTGATGACACCTGGGAGCCATYTGCCT CTGGGTAAGTTGCCAAAGAA'] |
| 1462 | NM_000371.3(TTR): c.265T > C (p.Tyr89His) | 7276 | TTR | ['TGAGGAGGAATTTGTAGAAGGGATAYACAA AGTGGAAATAGACACCAAATC'] |
| 1463 | NM_000217.2(KCNA1): c.1223T > C (p.Val408Ala) | 3736 | KCNA1 | ['ATTGCCCTGCCCGTACCTGTCATTGYGTCCA ATTTCAACTATTTCTACCAC'] |
| 1464 | NM_000174.4(GP9): c.212T > C (p.Phe71Ser) | 2815 | GP9 | ['CTTCAGTCCGTGCCCCCGGGAGCCTBTGACC ACCTGCCCCAGCTGCAGACC'] |
| 1465 | NM_000174.4(GP9): c.167T > C (p.Leu56Pro) | 2815 | GP9 | ['GCCCTGCCGGCCCGCACCCGCCACCYTCTGC TGGCCAACAACAGCCTTCAG'] |
| 1466 | NM_000174.4(GP9): c.70T > C (p.Cys24Arg) | 2815 | GP9 | ['GGCCACCAAGGACTGCCCCAGCCCAYGTAC CTGCCGCGCCCTGGAAACCAT'] |
| 1467 | NM_000174.4(GP9): c.20T > C (p.Leu7Pro) | 2815 | GP9 | ['TGTCCCATGCCTGCCTGGGGAGCCCYGTTCC TGCTCTGGGCCACAGCAGAG'] |
| 1468 | NM_001001547.2(CD36): c.760T > C (p.Phe254Leu) | 948 | CD36 | ['CGATTTTTAAACAGATGCAGCCTCABTTCCA CCTTTTGTTGAGAAAAGCCA'] |
| 1469 | NM_000212.2(ITGB3): c.2332T > C (p.Ser778Pro) | -1 | — | ['CAACCCACTGTATAAAGAGGCCACGYCTAC CTTCACCAATATCACGTACCG'] |
| 1470 | NM_000212.2(ITGB3): c.176T > C (p.Leu59Pro) | 3690 | ITGB3 | ['GCTCCTGTCTTACAGGCCCTGCCTCYGGGCT CACCTCGCTGTGACCTGAAG'] |

TABLE 6-continued

Diseases/disorders containging T to C Changes.The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1471 | NM_000301.3(PLG): c.1771T > C (p.Ser591Pro) | 5340 | PLG | ['AGGGGGGTGTGTGGCCCACCCACATYCCTG GCCCTGGCAAGTCAGTCTTAG'] |
| 1472 | NM_001122757.2(POU1F1): c.655T > C (p.Trp219Arg) | 5449 | POU1F1 | ['CAAACTGAAAGCAATATTATCCAAAYGGCT GGAGGAAGCTGAGCAAGTAGG'] |
| 1473 | NM_000293.2(PHKB): c.2923T > C (p.Tyr975His) | 5257 | PHKB | ['ACCAACCCTGTCAGATATGACCATGHATGA GATGAATTTCTCTCTCCTTGT'] |
| 1474 | NM_004577.3(PSPH): c.155T > C (p.Met52Thr) | 5723 | PSPH | ['CTCCCTCCTAGGACACGGCGAGCCAYGGGC GGGGCAGTGCCTTTCAAAGCT'] |
| 1475 | NM_000175.3(GPI): c.1574T > C (p.Ile525Thr) | 2821 | GPI | ['CTGGGAAAGCAGCTGGCTAAGAAAABAGAG CCTGAGCTTGATGGCAGTGCT'] |
| 1476 | NM_000175.3(GPI): c.1016T > C (p.Leu339Pro) | 2821 | GPI | ['TTTGGGTGTGAGACACACGCCATGCYGCCCT ATGACCAGTACCTGCACCGC'] |
| 1477 | NM_000478.4(ALPL): c.1306T > C (p.Tyr436His) | 249 | ALPL | ['ACGAGAGAATGTCTCCATGGTGGACYATGG TGAGACCTCCAGGACCCAGGG'] |
| 1478 | NM_000478.4(ALPL): c.979T > C (p.Phe327Leu) | 249 | ALPL | ['GATCCTGCGGAAGAACCCCAAAGGCYTCTT CTTGCTGGTGGAAGGTAGGGA'] |
| 1479 | NM_018849.2(ABCB4): c.1207T > C (p.Tyr403His) | 5244 | ABCB4 | ['GGAGTTCAATGATGTTCACTTTTCTYACCCT TCTCGAGCTAACGTCAAGGT'] |
| 1480 | NM_198965.1(PTHLH): c.179T > C (p.Leu60Pro) | 5744 | PTHLH | ['CAAGATTTACGGCGACGATTCTTCCYTCACC ATCTGATCGCAGAAATCCAC'] |
| 1481 | NM_198965.1(PTHLH): c.131T > C (p.Leu44Pro) | 5744 | PTHLH | ['AGAGCTGTGTCTGAACATCAGCTCCYCCATG ACAAGGGGAAGTCCATCCAA'] |
| 1482 | NM_000315.2(PTH): c.52T > C (p.Cys18Arg) | 5741 | PTH | ['AGTTATGATTGTCATGTTGGCAATTYGTTTT CTTACAAAATCGGATGGGAA'] |
| 1483 | NM_000315.2(PTH): c.67T > C (p.Ser23Pro) | 5741 | PTH | ['GTTGGCAATTTGTTTTCTTACAAAAYCGGAT GGGAAATCTGTTAAGTAAGT'] |
| 1484 | NM_003122.4(SPINK1): c.2T > C (p.Met1Thr) | 6690 | SPINK1 | ['ACCTCTGGACGCAGAACTTCAGCCAYGAAG GTAACAGGCATCTTTCTTCTC'] |
| 1485 | NM_003122.4(SPINK1): c.41T > C (p.Leu14Pro) | 6690 | SPINK1 | ['ATCTTTCTTCTCAGTGCCTTGGCCCBGTTGA GTCTATCTGGTAAGTGTTGC'] |
| 1486 | NM_006194.3(PAX9): c.62T > C (p.Leu21Pro) | 5083 | PAX9 | ['GGAGTGTTCGTGAACGGGAGGCCGCYGCCC AACGCCATCCGGCTTCGCATC'] |
| 1487 | NM_005188.3(CBL): c.1111T > C (p.Tyr371His) | 867 | CBL | ['TTAATCAAAGGAACAATATGAATTAHACTG TGAGATGGGCTCCACATTCCA'] |
| 1488 | NM_005247.2(FGF3): c.466T > C (p.Ser156Pro) | 2248 | FGF3 | ['CAGCGCCGAGAGACTGTGGTACGTGYCTGT GAACGGCAAGGGCCGGCCCCG'] |
| 1489 | NM_005247.2(FGF3): c.17T > C (p.Leu6Pro) | 2248 | FGF3 | ['GATGCCACGATGGGCCTAATCTGGCYGCTA CTGCTCAGCCTGCTGGAGCCC'] |
| 1490 | NM_000222.2(KIT): c.1676T > C (p.Val559Ala) | 3815 | KIT | ['CCCATGTATGAAGTACAGTGGAAGGNTGTT GAGGAGATAAATGGAAACAAT'] |
| 1491 | NM_005249.4(FOXG1): c.643T > C (p.Phe215Leu) | 2290 | FOXG1 | ['CATCTACGAGTTCATCATGAAGAACYTCCCT TACTACCGCGAGAACAAGCA'] |
| 1492 | NM_001127500.1(MET): c.3446T > C (p.Met1149Thr) | 4233 | MET | ['CAATTTCTGACCGAGGGAATCATCAYGAAA GATTTTAGTCATCCCAATGTC'] |
| 1493 | NM_020975.4(RET): c.1858T > C (p.Cys620Arg) | 5979 | RET | ['CTTCCCTGAGGAGGAGAAGTGCTTCNGCGA GCCCGAAGACATCCAGGGTGA'] |
| 1494 | NM_020975.4(RET): c.1900T > C (p.Cys634Arg) | 5979 | RET | ['CACAGATCCACTGTGCGACGAGCTGNGCCC CACGGTGATCGCAGCCGCTGT'] |

TABLE 6-continued

Diseases/disorders containging T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1495 | NM_020975.4(RET): c.2753T > C (p.Met918Thr) | 5979 | RET | ['TAGGGTCGGATTCCAGTTAAATGGAYGGCA ATTGAATCCCTTTTTGATCAT'] |
| 1496 | NM_020630.4(RET): c.1852T > C (p.Cys618Arg) | 5979 | RET | ['CAACTGCTTCCCTGAGGAGGAGAAGNGCTT CTGCGAGCCCGAAGACATCCA'] |
| 1497 | NM_020630.4(RET): c.1825T > C (p.Cys609Arg) | 5979 | RET | ['GGGGATTAAAGCTGGCTATGGCACCNGCAA CTGCTTCCCTGAGGAGGAGAA'] |
| 1498 | NM_013251.3(TAC3): c.269T > C (p.Met90Thr) | 6866 | TAC3 | ['ATGCATGACTTCTTTGTGGGACTTAYGGGCA AGAGGAGCGTCCAGCCAGGT'] |
| 1499 | NM_006158.4(NEFL): c.281T > C (p.Leu94Pro) | 4747 | NEFL | ['ATCCGCACGCAGGAGAAGGCGCAGCYCCAG GACCTCAATGACCGCTTCGCC'] |
| 1500 | NM_006177.3(NRL): c.479T > C (p.Leu160Pro) | 4901 | NRL | ['TGCGGGCGCGACGAGGCGCTGCGGCYGAAG CAGAGGCGCCGCACGCTGAAG'] |
| 1501 | NM_000432.3(MYL2): c.52T > C (p.Phe18Leu) | 4633 | MYL2 | ['AGCCGGGGCGCCAACTCCAACGTGYTCTC CATGTTCGAACAGACCCAAAT'] |
| 1502 | NM_000257.3(MYH7): c.1046T > C (p.Met349Thr) | 4625 | MYH7 | ['TTCACTTCAGAGGAGAAAAACTCCAYGTAT AAGCTGACAGGCGCCATCATG'] |
| 1503 | NM_000257.3(MYH7): c.1594T > C (p.Ser532Pro) | 4625 | MYH7 | ['GCTTCCTCAGCCCATGGGCATCATGYCCATC CTGGAAGAGGAGTGCATGTT'] |
| 1504 | NM_000257.3(MYH7): c.5378T > C (p.Leu1793Pro) | 4625 | MYH7 | ['AACATGGAACAGACCATTAAGGACCYGCAG CACCGGCTGGACGAAGCCGAG'] |
| 1505 | NM_001040113.1(MYH11): c.3791T > C (p.Leu1264Pro) | 4629 | MYH11 | ['GAGGTGGAACATAAGAAGAAGAAGCYGGA GGCGCAGGTGCAGGAGCTGCAG'] |
| 1506 | NM_000530.6(MPZ): c.404T > C (p.Ile135Thr) | 4359 | MPZ | ['TGTGACGTCAAAAACCCTCCAGACAYAGTG GGCAAGACCTCTCAGGTCACG'] |
| 1507 | NM_000530.6(MPZ): c.341T > C (p.Ile114Thr) | 4359 | MPZ | ['CGCTGGAAGGATGGCTCCATTGTCAYACAC AACCTAGCTACAGTGACAAT'] |
| 1508 | NM_016835.4(MAPT): c.1839T > C (p.Asn613=) | 4137 | MAPT | ['AGTCCAAGTGTGGCTCAAAGGATAAYATCA AACACGTCCCGGGAGGCGGCA'] |
| 1509 | NM_198159.2(MITF): c.1051T > C (p.Ser351Pro) | 4286 | MITF | ['GAACAAGGGAACCATCTTAAAAGCAYCCGT GGACTATATCCGAAAGTTGCA'] |
| 1510 | NM_198159.2(MITF): c.1195T > C (p.Ser399Pro) | 4286 | MITF | ['AATGCAGGCTCGAGCTCATGGACTTYCCCTT ATTCCATCCACGGGTCTCTG'] |
| 1511 | NM_000426.3 (LAMA2): c.7691T > C (p.Leu2564Pro) | 3908 | LAMA2 | ['ACCAAGAATGAGTCCGGCATCATTCYTTTGG GAAGTGGAGGGACACCAGCA'] |
| 1512 | NM_000426.3(LAMA2): c.2584T > C (p.Cys862Arg) | 3908 | LAMA2 | ['ACAACCCTCTGTACCTGGAGGATCAYGTCA GCCATGCCAATGCAATGACAA'] |
| 1513 | NM_002435.2(MPI): c.413T > C (p.Met138Thr) | 4351 | MPI | ['CCCGATGCCAACCACAAGCCAGAGAYGGCC ATTGCCCTCACCCCCTTCCAG'] |
| 1514 | NM_000239.2(LYZ): c.221T > C (p.Ile74Thr) | 4069 | LYZ | ['GGAGACAGAAGCACTGATTATGGGAYATTT CAGATCAATAGCCGCTACTGG'] |
| 1515 | NM_000239.2(LYZ): c.244T > C (p.Trp82Arg) | 4069 | LYZ | ['GATATTTCAGATCAATAGCCGCTACHGGTGT AATGATGGCAAAACCCCAGG'] |
| 1516 | NM_000233.3(LHCGR): c.1627T > C (p.Cys543Arg) | -1 | — | [CAATGTGGTGGCCTTCTTCATAATTYGTGCT TGCTACATTAAAATTTATTT'] |
| 1517 | NM_000233.3(LHCGR): c.1193T > C (p.Met398Thr) | -1 | — | ['AAACTTACAGTGCCTCGTTTTCTCAYGTGCA ATCTCTCCTTTGCAGACTTT'] |
| 1518 | NM_000233.3 (LHCGR): c.391T > C (p.Cys131Arg) | -1 | — | ['TCCTGTCCCTAATCACAGGAGCATCYGTAAC ACAGGCATCAGAAAGTTTCC'] |

TABLE 6-continued

Diseases/disorders containging T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1519 | NM_000233.3(LHCGR): c.1103T > C (p.Leu368Pro) | -1 | — | ['GACTTCCTTAGGGTCCTGATTTGGCYGATTA ATATTCTAGCCATCATGGGA'] |
| 1520 | NM_000233.3(LHCGR): c.1505T > C (p.Leu502Pro) | -1 | — | ['TCTTCTCTAATTGCTATGTTGCCCCYTGTCGG TGTCAGCAATTACATGAAG'] |
| 1521 | NM_170707.3(LMNA): c.1589T > C (p.Leu530Pro) | 4000 | LMNA | ['TGCGGGAACAGCCTGCGTACGGCTCYCATC AACTCCACTGGGGAAGTAAGT'] |
| 1522 | NM_170707.3(LMNA): c.1139T > C (p.Leu380Ser) | 4000 | LMNA | ['GAGATCCACGCCTACCGCAAGCTCTYGGAG GGCGAGGAGGAGAGGTGGGCT'] |
| 1523 | NM_002292.3(LAMB2): c.961T > C (p.Cys321Arg) | 3913 | LAMB2 | ['CAAACACAACACACGTGGCCTCAACYGCGA GCAGTGTCAGGATTTCTATCG'] |
| 1524 | NM_000228.2(LAMB3): c.565 - 3T > C | 3914 | LAMB3 | ['AAATCCATAAGGTTAAGTTGGACCTRCAGA GGGAAGGGAAAGAGAAGCGCT'] |
| 1525 | NM_000421.3(KRT10): c.482T > C (p.Leu161Ser) | -1 | — | [CTGAATGACCGCCTGGCTTCCTACTYGGACA AAGTTCGGGCTCTGGAAGAA'] |
| 1526 | NM_000421.3(KRT10): c.449T > C (p.Met150Thr) | -1 | — | ['CTCTCTGGAAATGAAAAAGTAACCABGCAG AATCTGAATGACCGCCTGGCT'] |
| 1527 | NM_000422.2(KRT17): c.263T > C (p.Met88Thr) | 3872 | KRT17 | ['CTGGCTGGAGGTGAGAAGGCCACCAHGCAG AACCTCAATGACCGCCTGGCC'] |
| 1528 | NM_000422.2(KRT17): c.284T > C (p.Leu95Pro) | 3872 | KRT17 | ['ACCATGCAGAACCTCAATGACCGCCHGGCC TCCTACCTGGACAAGGTGCGT'] |
| 1529 | NM_000422.2(KRT17): c.296T > C (p.Leu99Pro) | 3872 | KRT17 | ['CTCAATGACCGCCTGGCCTCCTACCYGGACA AGGTGCGTGCCCTGGAGGAG'] |
| 1530 | NM_005557.3(KRT16): c.395T > C (p.Leu132Pro) | 3868 | KRT16 | ['CTCAATGACCGCCTGGCCTCCTACCYGGACA AGGTGCGTGCTCTGGAGGAG'] |
| 1531 | NM_005557.3(KRT16): c.362T > C (p.Met121Thr) | 3868 | KRT16 | ['CTGGTGGGCAGTGAGAAGGTGACCAHGCAG AACCTCAATGACCGCCTGGCC'] |
| 1532 | NM_000526.4(KRT14): c.1151T > C (p.Leu384Pro) | 3861 | KRT14 | ['ATGATTGGCAGCGTGGAGGAGCAGCYGGCC CAGCTCCGCTGCGAGATGGAG'] |
| 1533 | NM_000526.4(KRT14): c.356T > C (p.Met119Thr) | 3861 | KRT14 | ['CTGGTGGGCAGTGAGAAGGTGACCAYGCAG AACCTCAATGACCGCCTGGCC'] |
| 1534 | NM_000526.4(KRT14): c.1243T > C (p.Tyr415His) | 3861 | KRT14 | ['GCGGCTGGAGCAGGAGATCGCCACCYACCG CCGCCTGCTGGAGGGCGAGGA'] |
| 1535 | NM_153490.2(KRT13): c.356T > C (p.Leu119Pro) | 3860 | KRT13 | ['CTCAACGACCGCCTGGCTTCCTACCYGGAGA AGGTGCGCGCCCTGGAGGAG'] |
| 1536 | NM_002273.3(KRT8): c.160T > C (p.Tyr54His) | 3856 | KRT8 | ['CTTTCGCGGTGGCCTGGGCGGCGGCHATGGT GGGGCCAGCGGCATGGGAGG'] |
| 1537 | NM_000424.3(KRT5): c.1388T > C (p.Leu463Pro) | 3852 | KRT5 | ['GAGCTCATGAACACCAAGCTGGCCCYGGAC GTGGAGATCGCCACTTACCGC'] |
| 1538 | NM_000424.3(KRT5): c.980T > C (p.Met327Thr) | 3852 | KRT5 | ['TCTGACACCTCAGTGGTCCTCTCCAHGGACA ACAACCGCAACCTGGACCTG'] |
| 1539 | NM_000424.3(KRT5): c.20T > C (p.Val7Ala) | 3852 | KRT5 | ['GCCACCATGTCTCGCCAGTCAAGTGYGTCCT TCCGGAGCGGGGCAGTCGT'] |
| 1540 | NM_000424.3(KRT5): c.541T > C (p.Ser181Pro) | 3852 | KRT5 | ['CAAGACCCTCAACAATAAGTTTGCCYCCTTC ATCGACAAGGTGAGCTACGA'] |
| 1541 | NM_000208.2(INSR): c.779T > C (p.Leu260Pro) | 3643 | INSR | ['TGCGTGGCCTGCCGCAACTTCTACCYGGACG GCAGGTGTGTGGAGACCTGC'] |
| 1542 | NM_000208.2(INSR): c.164T > C (p.Val55Ala) | 3643 | INSR | ['TTGCATGAGCTGGAATTGCTCTGYCATCG AAGGACACTTGCAGATACTC'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1543 | NM_002198.2(IRF1): c.31T > C (p.Trp11Arg) | 3659 | IRF1 | ['CATCACTCGGATGCGCATGAGACCCYGGCT AGAGATGCAGATTAATTCCAA'] |
| 1544 | NM_000213.3(ITGB4): c.467T > C (p.Leu156Pro) | 3691 | ITGB4 | ['AACCTCAAGAAGATGGGGCAGAACCYGGGT ACGGCAGGGCCAGAGTGGAGG'] |
| 1545 | NM_000213.3(ITGB4): c.1684T > C (p.Cys562Arg) | 3691 | ITGB4 | ['CCGAGGACGCTGCTCCATGGGCCAGYGTGT GTGTGAGCCTGGTTGGACAGG'] |
| 1546 | NM_000213.3 (ITGB4): c.112T > C (p.Cys38Arg) | 3691 | ITGB4 | ['CTGCAAGAAGGCCCCAGTGAAGAGCYGCAC GGAGTGTGTCCGTGTGGATAA'] |
| 1547 | NM_000454.4(SOD1): c.338T > C (p.Ile113Thr) | 6647 | SOD1 | ['ATCTCACTCTCAGGAGACCATTGCAYCATTG GCCGCACACTGGTGGTAAGT'] |
| 1548 | NM_000454.4(SOD1): c.434T > C (p.Leu145Ser) | 6647 | SOD1 | ['AAGACAGGAAACGCTGGAAGTCGTTYGGCT TGTGGTGTAATTGGGATCGCC'] |
| 1549 | NM_000454.4(SOD1): c.455T > C (p.Ile152Thr) | 6647 | SOD1 | ['CGTTTGGCTTGTGGTGTAATTGGGAYCGCCC AATAAACATTCCCTTGGATG'] |
| 1550 | NM_001025107.2(ADAR): c.1883T > C (p.Leu628Pro) | 103 | ADAR | ['ACCAGACTTTCTTTTTGTAGGTTTCYCTACA GTGAGTTAATGAAATACAAC'] |
| 1551 | NM_001025107.2(ADAR): c.2609T > C (p.Phe870Ser) | 103 | ADAR | ['TCCAAAAAGAACATTTTTCTTCTATYTAAGA AGCTCTGCTCCTTCCGTTAC'] |
| 1552 | NM_002185.3(IL7R): c.197T > C (p.Ile66Thr) | 3575 | UL7R | ['CCATATTTCAAATTCCAGATTGGTGRTGTTG ACATCTGGGTCCTCAAAAGC'] |
| 1553 | NM_033500.2(HK1): c.1550T > C (p.Leu517Ser) | 3098 | HK1 | ['ACTGCAACAGAGAATGGTGACTTCTYGGCC CTGGATCTTGGAGGAACCAAT'] |
| 1554 | NM_000184.2(HBG2): c.-228T > C | 3048 | HBG2 | ['CTTCCCCACACTATCTCAATGCAAAYATCTG TCTGAAACGGTCCCTGGCTA'] |
| 1555 | NM_000184.2(HBG2): c.125T > C (p.Phe42Ser) | 3048 | HBG2 | ['GTTGTCTACCCATGGACCCAGAGGTYCTTTG ACAGCTTTGGCAACCTGTCC'] |
| 1556 | NM_000559.2(HBG1): c.-251T > C | 3047 | HBG1 | ['TAGCAGTATCCTCTTGGGGGCCCCTYCCCCA CACTATCTCAATGCAAATAT'] |
| 1557 | NM_000519.3(HBD): c.-127T > C | 3045 | HBD | ['TCTCACAAACTAATGAAACCCTGCTYATCTT AAACCAACCTGCTCACTGGA'] |
| 1558 | NM_000518.4(HBB): c.257T > C (p.Phe86Ser) | 3043 | HBB | ['CACCTGGACAACCTCAAGGGCACCTYTGCC ACACTGAGTGAGCTGCACTGT'] |
| 1559 | NM_000518.4(HBB): c.128T > C (p.Phe43Ser) | 3043 | HBB | ['GTCTACCCTTGGACCCAGAGGTTCTBTGAGT CCTTTGGGGATCTGTCCACT'] |
| 1560 | NM_000518.4(HBB): c.337T > C (p.Cys113Arg) | 3043 | HBB | ['ACAGCTCCTGGGCAACGTGCTGGTCYGTGTG CTGGCCCATCACTTTGGCAA'] |
| 1561 | NM_000518.4(HBB): c.127T > C (p.Phe43Leu) | 3043 | HBB | ['GGTCTACCCTTGGACCCAGAGGTTCBTTGAG TCCTTTGGGGATCTGTCCAC'] |
| 1562 | NM_000518.4(HBB): c.332T > C (pLeu111Pro) | 3043 | HBB | ['CTCCCACAGCTCCTGGGCAACGTGCYGGTCT GTGTGCTGGCCCATCACTTT'] |
| 1563 | NM_000518.4(HBB): c.92 + 6T > C | 3043 | HBB | ['GGTGGTGAGGCCCTGGGCAGGTTGGHATCA AGGTTACAAGACAGGTTTAAG'] |
| 1564 | NM_000518.4(HBB): c.344T > C (p.Leu115Pro) | 3043 | HBB | ['CTGGGCAACGTGCTGGTCTGTGTGCYGGCCC ATCACTTTGGCAAAGAATTC'] |
| 1565 | NM_000517.4(HBA2): c.427T > C (p.Ter143Gln) | 3040 | HBA2 | ['CACCGTGCTGACCTCCAAATACCGTNAAGCT GGAGCCTCGGTAGCCGTTCC'] |
| 1566 | NM_000517.4(HBA2): c.2T > C (p.Met1Thr) | 3040 | HBA2 | ['CCACAGACTCAGAGAGAACCCACCAYGGTG CTGTCTCCTGCCGACAAGACC'] |

TABLE 6-continued

Diseases/disorders containing T to C Changes. The table includes human gene
mutations that may be corrected by changing a cytosine (C) to a thymine (T). The gene
name, gene symbol, and Gene ID are indicated.

| SEQ ID NO: | Name | Gene ID | Gene Symbol | Flanks |
|---|---|---|---|---|
| 1567 | NM_000517.4(HBA2): c.89T > C (p.Leu30Pro) | 3040 | HBA2 | ['GCTGGCGAGTATGGTGCGGAGGCCCYGGAG AGGTGAGGCTCCCTCCCCTGC'] |
| 1568 | NM_006121.3(KRT1): c.482T > C (p.Leu161Pro) | 3848 | KRT1 | ['CAAGAAGTCACTATCAACCAGAGCCYTCTTC AGCCCCTCAATGTGGAGATT'] |
| 1569 | NM_006121.3(KRT1): c.1436T > C (p.Ile479Thr) | 3848 | KRT1 | ['ACCAAGCTGGCCCTGGATCTGGAGAYTGCC ACCTACAGGACCCTCCTGGAG'] |
| 1570 | NM_006121.3(KRT1): c.1424T > C (p.Leu475Pro) | 3848 | KRT1 | ['GAGCTGATGAACACCAAGCTGGCCCYGGAT CTGGAGATTGCCACCTACAGG'] |
| 1571 | NM_001077488.3(GNAS): c.299T > C (p.Leu100Pro) | 2778 | GNAS | ['AAAGTGCAGGACATCAAAAACAACCYGAAA GAGGCGATTGAAGTACGTGCT'] |
| 1572 | NM_000515.4(GH1): c.291 + 6T > C | 2688 | GH1 | ['AGGAAACACAACAGAAATCCGTGAGYGGAT GCCTTCTCCCCAGGCGGGGAT'] |
| 1573 | NM_002087.3(GRN): c.2T > C (p.Met1Thr) | 2896 | GRN | ['TCCTTGGTACTTTGCAGGCAGACCAYGTGGA CCCTGGTGAGCTGGGTGGCC'] |
| 1574 | NM_021957.3(GYS2): c.1447T > C (p.Ser483Pro) | 2998 | GYS2 | ['GGTGATTTTGCACCCAGAGTTTCTAYCCTCC ACCAGTCCCTTACTACCCAT'] |
| 1575 | NM_001083112.2(GPD2): c.1904T > C (p.Phe635Ser) | 2820 | GPD2 | ['AGGTATAAGAAGAGATTTCATAAGTYTGAT GCAGACCAGAAAGGCTTTATT'] |
| 1576 | NM_000340.1(SLC2A2): c.1166T > C (p.Leu389Pro) | 6514 | SLC2A2 | ['ATCTTCATGTCAGTGGGACTTGTGCBGCTGG TAAGTTTGGTGCCTGCACTG'] |
| 1577 | NM_005271.3(GLUD1): c.1501T > C (p.Ser501Pro) | 2746 | GLUD1 | ['GTGTTCTTTTCCCTAATAGGGTGCAYCTGAG AAAGACATCGTGCACTCTGG'] |
| 1578 | NM_000162.3(GCK): c.391T > C (p.Ser131Pro) | 2645 | GCK | ['CTTCGACTACATCTCTGAGTGCATCYCCGAC TTCCTGGACAAGCATCAGAT'] |
| 1579 | NM_001018077.1(NR3C1): c.1712T > C (p.Val571Ala) | 2908 | NR3C1 | ['CTCAACATGTTAGGAGGGCGGCAAGYGATT GCAGCAGTGAAATGGGCAAAG'] |
| 1580 | NM_001018077.1(NR3C1): c.2318T > C (p.Leu773Pro) | 2908 | NR3C1 | ['TCAAATGGAAATATCAAAAACTTCYGTTTC ATCAAAAGTGACTGCCTTAA'] |
| 1581 | NM_001018077.1(NR3C1): c.2209T > C (p.Phe737Leu) | 2908 | NR3C1 | ['GGTTGAAAATCTCCTTAACTATTGCYTCCAA ACATTTTTGGATAAGACCAT'] |
| 1582 | NM_002055.4(GFAP): c.1055T > C (p.Leu352Pro) | 2670 | GFAP | ['CGCCACTTGCAGGAGTACCAGGACCYGCTC AATGTCAAGCTGGCCCTGGAC'] |
| 1583 | NM_002353.2(TACSTD2): c.557T > C (p.Leu186Pro) | 4070 | TACSTD2 | ['CGGCTCTTCCGCGAGCGCTATCGGCYGCACC CCAAGTTCGTGGCGGCCGTG'] |
| 1584 | NM_000821.6(GGCX): c.896T > C (p.Phe299Ser) | 2677 | GGCX | ['TTTCTCCCTGCTTTCCTAGGTATGYCTCCTA CGTCATGCTGGCCAGCAGC'] |
| 1585 | NM_000145.3(FSHR): c.479T > C (p.Ile160Thr) | 2492 | FSHR | ['CAAGATAACATAAACATCCACACAAYTGAA AGAAATTCTTTCGTGGGGCTG'] |
| 1586 | NM_000145.3(FSHR): c.1634T > C (p.Ile545Thr) | 2492 | FSHR | ['CTCAATGTCCTGGCCTTTGTGGTCAYCTGTG GCTGCTATATCCACATCTAC'] |
| 1587 | NM_182925.4(FLT4): c.3131T > C (p.Leu1044Pro) | 2324 | FLT4 | ['AGAGACCTGGCTGCTCGGAACATTCYGCTGT CGGAAAGCGACGTGGTGAAG'] |
| 1588 | NM_182925.4(FLT4): c.3257T > C (p.Ile1086Thr) | 2324 | FLT4 | ['CTGAAGTGGATGGCCCCTGAAAGCAYCTTC GACAAGGTGTACACCACGCAG'] |
| 1589 | NM_023110.2(FGFR1): c.899T > C (p.Ile300Thr) | 2260 | FGFR1 | ['CACATCGAGGTGAATGGGAGCAAGAYTGGC CCAGACAACCTGCCTTATGTC'] |
| 1590 | NM_023110.2(FGFR1): c.1141T > C (p.Cys381Arg) | 2260 | FGFR1 | ['CCTGTACCTGGAGATCATCATCTATYGCACA GGGGCCTTCCTCATCTCCTG'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1591 | NM_000138.4(FBN1): c.4987T > C (p.Cys1663Arg) | 2200 | FBN1 | ['TCCTGGAATCTGTGGTCCAGGGACAYGTTAC AACACCGTTGGCAACTACAC'] |
| 1592 | NM_000138.4(FBN1): c.3220T > C (p.Cys1074Arg) | 2200 | FBN1 | ['CTGTTTTTGTGCAGACATTGACGAAYGCCGC ATATCTCCTGACCTCTGTGG'] |
| 1593 | NM_000138.4(FBN1): c.3793T > C (p.Cys1265Arg) | 2200 | FBN1 | ['TATCCCTGGAGAGTACAGGTGCTTGYGTTAT GATGGATTCATGGCATCTGA'] |
| 1594 | NM_000043.4(FAS): c.532T > C (p.Cys178Arg) | 355 | FAS | ['ATCCAGATCTAACTTGGGGTGGCTTYGTCTT CTTCTTTTGCCAATTCCACT'] |
| 1595 | NM_000043.4(FAS): c.651 + 2T > C | 355 | FAS | ['CATGAATCTCCAACTTTAAATCCTGHAGGTA TTGAAATAGGTATCAGCTTT'] |
| 1596 | NM_000129.3(F13A1): c.728T > C (p.Met243Thr) | 2162 | F13A1 | ['ATCCTGGACACTTGCCTGTATGTGAYGGACA GAGCACAAATGGACCTCTCT'] |
| 1597 | NM_000186.3(CFH): c.1606T > C (p.Cys536Arg) | 3075 | CFH | ['GCTGAATGACACATTGGACTATGAAYGCCA TGATGGTTATGAAAGCAATAC'] |
| 1598 | NM_000123.3(ERCC5): c.2573T > C (p.Leu858Pro) | -1 | — | ['AAGTTAATAAATTTGGCTTATTTGCYTGGAA GTGATTATACCGAAGGAATA'] |
| 1599 | NM_000122.1(ERCC3): c.296T > C (p.Phe99Ser) | 2071 | ERCC3 | ['CCAGTTTACAAATATGCCCAAGACTYCTTGG TGGCTATTGCAGAGCCAGTG'] |
| 1600 | NM_001113755.2(TYMP): c.854T > C (p.Leu285Pro) | 1890 | TYMP | ['CTGGGTCGCTGCGTGGGCCACGCCCYGGAG GTGGAGGAGGCGCTGCTCTGC'] |
| 1601 | NM_000118.3(ENG): c.2T > C (p.Met1Thr) | 2022 | ENG | ['CGCACAGGCCCCCACGTGGACAGCAYGGAC CGCGGCACGCTCCCTCTGGCT'] |
| 1602 | NM_203342.2(EPB41): c.2T > C (p.Met1Thr) | 2035 | EPB41 | ['AAACCAATCAGAAAACACAGGAACABGCAC TGCAAGGTTTCTTTGTTGGAT'] |
| 1603 | NM_001972.2(ELANE): c.211T > C (p.Cys71Arg) | 1991 | ELANE | ['CAACTTCGTCATGTCGGCCGCGCACYGCGTG GCGAATGTGTGAGTAGCCGG'] |
| 1604 | NM_000400.3(ERCC2): c.1454T > C (p.Leu485Pro) | 2068 | ERCC2 | ['ACCATGGCAACCTTCACCATGACGCYGGCA CGGGTCTGCCTCTGCCCTATG'] |
| 1605 | NM_000281.3(PCBD1): c.244T > C (p.Cys82Arg) | 5092 | PCBD1 | ['CCACATCACGCTGAGCACCCATGAGYGTGC CGGCCTTTCAGAACGGGACAT'] |
| 1606 | NM_001927.3(DES): c.1034T > C (p.Leu345Pro) | 1674 | DES | ['CCCCCTCTCCTGCAGAACGATTCCCYGATGA GGCAGATGCGGGAATTGGAG'] |
| 1607 | NM_001927.3(DES): c.1154T > C (p.Leu385Pro) | 1674 | DES | ['CTCAAGGATGAGATGGCCCGCCATCYGCGC GAGTACCAGGACCTGCTCAAC'] |
| 1608 | NM_000498.3(CYP11B2): c.1157T > C (p.Val386Ala) | -1 | — | ['GTTCTGAAGCACCAAGTCTGAGCTCRCCACT CGCTCCAAAAACAGACCCAC'] |
| 1609 | NM_000498.3(CYP11B2): c.1382T > C (p.Leu461Pro) | -1 | — | ['CGGCGCCTGGCAGAGGCAGAGATGCYGCTG CTGCTGCACCACGTAAGCAGG'] |
| 1610 | NM_001886.2(CRYBA4): c.281T > C (p.Phe94Ser) | 1413 | CRYBA4 | ['TACCCCGCCGAGAGGCTCACCTCCTYCCGGC CTGCGGCCTGTGCTGTAAGT'] |
| 1611 | NM_001886.2(CRYBA4): c.206T > C (p.Leu69Pro) | 1413 | CRYBA4 | ['GGCTTCCAAGGGCAGCAGTACATTCYGGAA CGAGGCGAATATCCAAGCTGG'] |
| 1612 | NM_000762.5(CYP2A6): c.670T > C (p.Ser224Pro) | -1 | — | ['GCAACCCCAGCTCTATGAGATGTTCYCTTCG GTGATGAAACACCTGCCAGG'] |
| 1613 | NM_000165.4(GJA1): c.52T > C (p.Ser18Pro) | 2697 | GJA1 | ['ACTCCTTGACAAGGTTCAAGCCTACYCAACT GCTGGAGGGAAGGTGTGGCT'] |
| 1614 | NM_000165.4(GJA1): c.32T > C (p.Leu11Pro) | 2697 | GJA1 | ['GACTGGAGCGCCTTAGGCAAACTCCYTGAC AAGGTTCAAGCCTACTCAACT'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
| --- | --- | --- | --- | --- |
| 1615 | NM_004004.5(GJB2): c.101T > C (p.Met34Thr) | 2706 | GJB2 | ['CTCCTTTGCAGCCACAACGAGGATCVTAATG CGAAAAATGAAGAGGACGGT'] |
| 1616 | NM_004004.5(GJB2): c.229T > C (p.Trp77Arg) | 2706 | GJB2 | ['CTTCCCCATCTCCCACATCCGGCTAYGGGCC CTGCAGCTGATCTTCGTGTC'] |
| 1617 | NM_004004.5(GJB2): c.269T > C (p.Leu90Pro) | 2706 | GJB2 | ['ATCTTCGTGTCCACGCCAGCGCTCCYAGTGG CCATGCACGTGGCCTACCGG'] |
| 1618 | NM_005215.3(DCC): c.503T > C (p.Met168Thr) | 1630 | DCC | ['AAGTGTGAAGTCATTGGGGAGCCCAYGCCA ACAATCCACTGGCAGAAGAAC'] |
| 1619 | NM_001849.3(COL6A2): c.2329T > C (p.Cys777Arg) | 1292 | COL6A2 | ['GAGTGAAAACCTCTACTCCATCGCCYGCGA CAAGCCACAGCAGGTGCGCAA'] |
| 1620 | NM_000090.3(COL3A1): c.582 + 6T > C | 1281 | COL3A1 | ['CTGGTCATCCTGGTTCCCCTGTAAGHATAGC CATTGGTGGTGTTTTCTTCC'] |
| 1621 | NM_000089.3(COL1A2): c.279 + 2T > C | 1278 | COL1A2 | ['GTTGGACTTGGCCCTGGACCAATGGYATGCT TATCTGTTTATCTTAGCCAA'] |
| 1622 | NM_000089.3(COL1A2): c.3105 + 2T > C | 1278 | COL1A2 | ['TTGCAAGGTCTGCCTGGTATCGCTGYAAGTA AACTGTAGCCATCTCGCACA'] |
| 1623 | NM_000088.3(COL1A1): c.4391T > C (p.Leu1464Pro) | 1277 | COL1A1 | ['TTCGACGTTGGCCCTGTCTGCTTCCYGTAAA CTCCCTCCATCCCAACCTGG'] |
| 1624 | NM_000493.3 (COL10A1): c.1841T > C (p.Leu614Pro) | -1 | — | ['AAAGGGACTCATGTTTGGGTAGGCCYGTAT AAGAATGGCACCCCTGTAATG'] |
| 1625 | NM_000493.3(COL10A1): c.1771T > C (p.Cys591Arg) | -1 | — | ['TGACCCAAGGACTGGAATCTTTACTYGTCAG ATACCAGGAATATACTATTT'] |
| 1626 | NM_000493.3(COL10A1): c.1951T > C (p.Trp651Arg) | -1 | — | ['CGATCTCACAGAAAATGACCAGGTGYGGCT CCAGCTTCCCAATGCCGAGTC'] |
| 1627 | NM_000493.3(COL10A1): c.2011T > C (p.Ser671Pro) | -1 | — | ['ATACTCCTCTGAGTATGTCCACTCCYCTTTCT CAGGATTCCTAGTGGCTCC'] |
| 1628 | NM_000493.3(COL10A1): c.1798T > C (p.Ser600Pro) | -1 | — | [TCAGATACCAGGAATATACTATTTTYCATAC CACGTGCATGTGAAAGGGAC'] |
| 1629 | NM_020549.4(CHAT): c.629T > C (p.Leu210Pro) | 1103 | CHAT | ['ATGTATCTCAACAACCGCCTGGCCCYGCCTG TCAACTCCAGCCCTGCCGTG'] |
| 1630 | NM_020549.4(CHAT): c.914T > C (p.Ile305Thr) | 1103 | CHAT | ['ATCATGCCGGAGCCTGAGCACGTCABCGTA GCCTGCTGCAATCAGGTAAGC'] |
| 1631 | NM_020549.4(CHAT): c.1007T > C (p.Ile336Thr) | 1103 | CHAT | ['GATCTGTTCACTCAGTTGAGAAAGAYAGTC AAAATGGCTTCCAACGAGGAC'] |
| 1632 | NM_001822.5(CHN1): c.427T > C (p.Tyr143His) | 1123 | CHN1 | ['TGCCAAGATGACGATAAACCCAATTYATGA GCACGTAGGATACACAACCTT'] |
| 1633 | NM_001904.3(CTNNB1): c.133T > C (p.Ser45Pro) | 1499 | CTNNB1 | ['TTCTGGTGCCACTACCACAGCTCCTBCTCTG AGTGGTAAAGGCAATCCTGA'] |
| 1634 | NM_004056.4(CA8): c.298T > C (p.Ser100Pro) | 767 | CA8 | ['ACATATATTTTCTTTTTCAGTTCTTYCGGGAG GACCATTGCCTCAAGGGCA'] |
| 1635 | NM_016124.4(RHD): c.329T > C (p.Leu110Pro) | 6007 | RHD | ['CCTTCTGGGAAGGTGGTCATCACACYGTTCA GGTATTGGGATGGTGGCTGG'] |
| 1636 | NM_015865.6(SLC14A1): c.871T > C (p.Ser291Pro) | 6563 | SLC14A1 | ['CTTTGGACTCTGGGGTTTCAACAGCYCTCTG GCCTGCATTGCAATGGGAGG'] |
| 1637 | NM_001250.5(CD40): c.247T > C (p.Cys83Arg) | 958 | CD40 | ['GACACACTGCCACCAGCACAAATACGCGA CCCCAGTGCGTGCGCTGTTGG'] |
| 1638 | NM_000342.3(SLC4A1): c.2317T > C (p.Ser773Pro) | 6521 | SLC4A1 | ['AGTGTGCGGCTCCCCCACAGGCCTGYCCATC CTCATGGAGCCCATCCTGTC'] |

TABLE 6-continued

Diseases/disorders containging T to C Changes.The table includes human gene mutations that may be corrected by changing a cytosine (C) to a thymine (T). The gene name, gene symbol,and Gene ID are indicated.

| SEQ ID NO: | Name | Gene ID | Gene Symbol | Flanks |
|---|---|---|---|---|
| 1639 | NM_001681.3(ATP2A2): c.1678T > C (p.Cys560Arg) | 488 | ATP2A2 | ['GGGTAGTGGCAGCGACACACTGCGAYGCCTGGCCCTGGCCACTCATGACAA'] |
| 1640 | NM_001082971.1(DDC): c.925T > C (p.Phe309Leu) | 1644 | DDC | [TCCCCACAAATGGCTATTGGTGAATYTTGACTGTTCTGCCATGTGGTAAGT'] |
| 1641 | NM_031226.2(CYP19A1): c.743 + 2T > C | -1 | — | ['ATACAAAAGTATGAGAAGTCTGTGYAAGTAATACAACTTTGGAAGATTTA'] |
| 1642 | NM_000486.5(AQP2): c.646T > C (p.Ser216Pro) | -1 | — | ['ACCCCTGGTGGGCGCCATCCTGGGCYCCCTCCTCTACAACTACGTGCTGTT'] |
| 1643 | NM_000041.3(APOE): c.388T > C (p.Cys130Arg) | 348 | APOE | ['GCTGGGCGCGGACATGGAGGACGTGYGCGGCCGCCTGGTGCAGTACCGCGG'] |
| 1644 | NM_000041.3(APOE): c.137T > C (p.Leu46Pro) | 348 | APOE | ['TGGCAGAGCGGCCAGCGCTGGGAACYGGCACTGGGTCGCTTTTGGGATTAC'] |
| 1645 | NM_000039.1(APOA1): c.220T > C (p.Trp74Arg) | -1 | — | ['CTCCAGCCTAAAGCTCCTTGACAACYGGGACAGCGTGACCTCCACCTTCAG'] |
| 1646 | NM_000039.1(APOA1): c.341T > C (p.Leu114Pro) | -1 | — | ['CTGAGGCAGGAGATGAGCAAGGATCYGGAGGAGGTGAAGGCCAAGGTGCAG'] |
| 1647 | NM_000039.1(APOA1): c.593T > C (p.Leu198Ser) | 335 | APOA1 | ['TACAGCGACGAGCTGCGCCAGCGCTYGGCCGCGCGCCTTGAGGCTCTCAAG'] |
| 1648 | NM_000416.2(IFNGR1): c.260T > C (p.Ile87Thr) | 3459 | IFNGR1 | ['AATATTTCTCATCATTATTGTAATAYTTCTGATCATGTTGGTGATCCATCA'] |
| 1649 | NM_000488.3(SERPINC1): c.1141T > C (p.Ser381Pro) | 462 | SERPINC1 | ['TGTCGATCTGTTCAGCCCTGAAAAGYCCAAACTCCCAGGTTTGTCTAGGAA'] |
| 1650 | NM_000488.3(SERPINC1): c.442T > C (p.Ser148Pro) | 462 | SERPINC1 | ['GTTTGACACCATATCTGAGAAAACAYCTGATCAGATCCACTTCTTCTTTGC'] |
| 1651 | NM_000488.3(SERPINC1): c.68T > C (p.Leu23Pro) | 462 | SERPINC1 | ['AAGGTTTATCTTTTGTCCTTGCTGCYCATTGGCTTCTGGGACTGCGTGACC'] |
| 1652 | NM_000488.3(SERPINC1): c.667T > C (p.Ser223Pro) | 462 | SERPINC1 | ['CAGAGCGGCCATCAACAAATGGGTGYCCAATAAGACCGAAGGCCGAATCAC'] |
| 1653 | NM_000488.3(SERPINC1): c.379T > C (p.Cys127Arg) | 462 | SERPINC1 | ['TTTTGCTATGACCAAGCTGGGTGCCYGTAATGACACCCTCCAGCAACTGAT'] |
| 1654 | NM_001085.4(SERPINA3): c.233T > C (p.Leu78Pro) | 12 | SERPINA3 | ['GATAAGAATGTCATCTTCTCCCCACYGAGCATCTCCACCGCCTTGGCCTTC'] |
| 1655 | NM_000341.3(SLC3A1): c.1400T > C (p.Met467Thr) | 6519 | SLC3A1 | ['AATCAGTATGTCAACGTGATGAACAHGCTTCTTTTCACACTCCCTGGAACT'] |
| 1656 | NM_000341.3(SLC3A1): c.2033T > C (p.Leu678Pro) | -1 | — | ['AATCGAGCATGCTATTCCAGTGTACYGAACATACTGTATACCTCGTGTTAG'] |
| 1657 | NM_000021.3(PSEN1): c.749T > C (p.Leu250Ser) | 5663 | PSEN1 | ['CCTGAATGGACTGCGTGGCTCATCTYGGCTGTGATTTCAGTATATGGTAAA'] |
| 1658 | NM_000021.3(PSEN1): c.338T > C (p.Leu113Pro) | 5663 | PSEN1 | ['TTTTATACCCGGAAGGATGGGCAGCYGTACGTATGAGTTTTGTTTTATTAT'] |
| 1659 | NM_000021.3(PSEN1): c.497T > C (p.Leu166Pro) | 5663 | PSEN1 | ['CTTTTCTAGGTCATCCATGCCTGGCBTATTATATCATCTCTATTGTTGCTG'] |
| 1660 | NM_000021.3(PSEN1): c.254T > C (p.Leu85Pro) | 5663 | PSEN1 | ['TATGGCGCCAAGCATGTGATCATGCYCTTTGTCCCTGTGACTCTCTGCATG'] |
| 1661 | NM_001151.3(SLC25A4): c.293T > C (p.Leu98Pro) | 291 | SLC25A4 | ['GCCTTCAAGGACAAGTACAAGCAGCYCTTCTTAGGGGGTGTGGATCGGCAT'] |
| 1662 | NM_001100.3(ACTA1): c.287T > C (p.Leu96Pro) | 58 | ACTA1 | ['TGGCACCACACCTTCTACAACGAGCYTCGCGTGGCTCCCGAGGAGCACCCC'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1663 | NM_001100.3(ACTA1): c.668T > C (p.Leu223Pro) | 58 | ACTA1 | ['AAGGAGAAGCTGTGCTACGTGGCCCYGGAC TTCGAGAACGAGATGGCGACG'] |
| 1664 | NM_000485.2(APRT): c.407T > C (p.Met136Thr) | 353 | APRT | ['CTCACCCTCCCATCCCCAGGAACCAYGAAC GCTGCCTGTGAGCTGCTGGGC'] |
| 1665 | NM_000485.2(APRT): c.329T > C (p.Leu110Pro) | 353 | APRT | ['CACCACTTCCCACTCCAGGCTGAGCYGGAG ATTCAGAAAGACGCCCTGGAG'] |
| 1666 | NM_001614.3(ACTG1): c.1109T > C (p.Val370Ala) | 71 | ACTG1 | ['TACGACGAGTCGGGCCCCTCCATCGYCCACC GCAAATGCTTCTAAACGGAC'] |
| 1667 | NM_000751.2(CHRND): c.283T > C (p.Phe95Leu) | 1144 | CHRND | ['CCGGCTGAAGTGGAATGCTGAAGAAYTTGG AAACATCAGTGTCCTGCGCCT'] |
| 1668 | NM_000751.2(CHRND): c.188T > C (p.Leu63Pro) | 1144 | CHRND | ['GCCCTGGCCCTCACACTCTCCAACCYCATCT CCCTGGTGAGAGGCCCTCCG'] |
| 1669 | NM_001039523.2(CHRNA1): c.901T > C (p.Phe301Leu) | 1134 | CHRNA1 | ['CTCTGTCTTACTGTCTTTGACTGTGYTCCTTC TGGTCATCGTGGAGCTGAT'] |
| 1670 | NM_001004127.2(ALG11): c.257T > C (p.Leu86Ser) | 440138 | ALG11 | ['GGAGAAAGAGTTTTATGGTGTGCTTYAAGA GCCCTGCAGAAAAAGTAGGTA'] |
| 1671 - 1674 | NM_002036.3(ACKR1): c.-67T > C | 2532 | ACKR1 | ['AGAGGGAGCTAGGAGGCTAGCATAGRAAGG AGARAAGGAAAAAGACTTTGA', 'TATAAAGACTGAGGGGCAAACAGCASGGGA AATGAGGGGCATAGGGATAAG', 'CGCAGACAGAAGGGCTGGGACGGCTRTCAG CGCCTGTGCTTCCAAGRTAAG', 'ATCAGGAAGCCTTACCCCACGCCCAYTGCCT GCACAAGCCTCAGGCCTATG'] |
| 1675 | NM_014053.3(FLVCR1): c.574T > C (p.Cys192Arg) | 28982 | FLVCR1 | ['CAACTGCCTGGGTGCCTGGATCAAGYGCGG CAGTGTGCAGCAGCATCTCTT'] |
| 1676 | NM_004268.4(MED17): c.1112T > C (p.Leu371Pro) | 9440 | MED17 | ['TGTCCGGAGGACCACCTTTATGTCCYAGAGC ATAATTTGCATCTACTGATT'] |
| 1677 | NM_024411.4(PDYN): c.632T > C (p.Leu211Ser) | 5173 | PDYN | ['CTGTACAAACGCTATGGGGGCTTCTYGCGGC GCATTCGTCCCAAGCTCAAG'] |
| 1678 | NM_000018.3(ACADVL): c.848T > C (p.Val283Ala) | 37 | ACADVL | ['GTGAAGGAGAAGATCACAGCTTTTGYGGTG GAGAGGGGCTTCGGGGGCATT'] |
| 1679 | NM_000021.3(PSEN1): c.1175T > C (p.Leu392Pro) | 5663 | PSEN1 | ['GGAGATTTCATTTTCTACAGTGTTCYGGTTG GTAAAGCCTCAGCAACAGCC'] |
| 1680 | NM_000083.2(CLCN1): c.857T > C (p.Val286Ala) | 1180 | CLCN1 | ['CCACACTTCTGTGCCCCTGCAGGAGYGCTAT TTAGCATCGAGGTCACCTCC'] |
| 1681 | NM_000083.2(CLCN1): c.920T > C (p.Phe307Ser) | 1180 | CLCN1 | ['GTTCGGAACTACTGGAGAGGATTCTYTGCA GCCACGTTCAGCGCCTTTGTG'] |
| 1682 | NM_000157.3(GBA): c.703T > C (p.Ser235Pro) | 2629 | GBA | ['CAATGGAGCGGTGAATGGGAAGGGGYCACT CAAGGGACAGCCCGGAGACAT'] |
| 1683 | NM_000166.5(GJB1): c.145T > C (p.Ser49Pro) | 2705 | GJB1 | ['AGAGAGTGTGTGGGGTGATGAGAAAYCTTC CTTCATCTGCAACACACTCCA'] |
| 1684 - 1686 | NM_000186.3(CFH): c.3590T > C (p.Val1197Ala) | 3075 | CFH | ['ATATCCCGTTTACACACAAATTCARCTGAT TCACCTGTTCTCGAATAAAG', 'GAACTTATCATTGCTGCTTTTGATTaagatat tggtcaaagagtacaaact', 'ttcagctataatatgaataagaacttggaatc aaacatagagatctagtga] |
| 1687 | NM_000195.4(HPS1): c.2003T > C (p.Leu668Pro) | 3257 | HPS1 | ['GGGGATGACAGACAGGTGCAGGGCCRGCAG CTCGTAGCACCTGACAGCCTC'] |
| 1688 | NM_000195.4(HPS1): c.716T > C (p.Leu239Pro) | 3257 | HPS1 | ['GCTGGGGTAGAGGTCCTGAACCAGGRGGAT GAGGGCAAGCAGGTCGGCCGG'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1689 | NM_000334.4(SCN4A): c.4468T > C (p.Phe1490Leu) | 6329 | SCN4A | ['CCTCTTCAACATCGGCCTCCTCCTCYTCCTG GTCATGTTCATCTACTCCAT'] |
| 1690 | NM_000352.4(ABCC8): c.257T > C (p.Val86Ala) | 6833 | ABCC8 | ['ACCTTCATGCTGCTCTTCGTCCTGGBGTGTG AGATTGCAGAGGGCATCCTG'] |
| 1691 | NM_000352.4(ABCC8): c.404T > C (p.Leu135Pro) | 6833 | ABCC8 | ['ATCGAGACTTCCAACTTCCCCAAGCYGCTAA TTGGTAGGTGAGGTGTAGGA'] |
| 1692 | NM_000352.4(ABCC8): c.674T > C (p.Leu225Pro) | 6833 | ABCC8 | ['TTCCTGCAGCCCTTCGTGAATCTGCYGTCCA AAGGCACCTACTGGTGGATG'] |
| 1693 | NM_000430.3(PAFAH1B1): c.569 − 10T > C | 5048 | PAFAH1B1 | ['ATTACTTCATAATATATTGCTGTTAYGTGTTT TAGGCCATGACCACAATGT'] |
| 1694 | NM_000525.3(KCNJ11): c.103T > C (p.Phe35Leu) | 3767 | KCNJ11 | ['CCGTGCCCGCCAGCGGAGGGCCCGCBTTGT GTCCAAGAAAGGCAACTGCAA'] |
| 1695 | NM_000525.3(KCNJ11): c.755T > C (p.Val252Ala) | 3767 | KCNJ11 | ['GTGGGTGGCAACAGCATCTTCCTGGYGGCC CCGCTGATCATCTACCATGTC'] |
| 1696 | NM_000528.3(MAN2B1): c.2426T > C (p.Leu809Pro) | 4125 | MAN2B1 | ['GGCAGCAGCCTGAGAGATGGCTCGCYGGAG CTCATGGTGAGTGGGTCAGAG'] |
| 1697 | NM_001034850.2(FAM134B): c. 873 + 2T > C | 54463 | FAM134B | ['GACTTTTCAGCTCTTTGTCCTAAGGYATTTTT TGTTTAGTTTTCAATTTGT'] |
| 1698 | NM_001457.3(FLNB): c.4804T > C (p.Ser1602Pro) | 2317 | FLNB | ['CTACGGGGGTGACGACATCCCACTTYCTCCT TATCGCATCCGAGCCACACA'] |
| 1699 | NM_002863.4(PYGL): c.2461T > C (p.Tyr821His) | 5836 | PYGL | ['CTCCAGTGACCGAACAATTAAAGAAYATGC CCAAAACATCTGGAACGTGGA'] |
| 1700 | NM_003002.3(SDHD): c.284T > C (p.Leu95Pro) | 6392 | SDHD | ['CCTTGCTCTGCGATGGACTATTCCCYGGCTG CAGCCCTCACTCTTCATGGT'] |
| 1701 | NM_004385.4(VCAN): c.4004 − 5T > C | 1462 | VCAN | ['TAAGTATTGTGAAAACTCTGTTTTTHTCAGG TCGAATGAGTGATTTGAGTG'] |
| 1702 | NM_004519.3(KCNQ3): c.925T > C (p.Trp309Arg) | 3786 | KCNQ3 | ['TGAGACCTATGCAGATGCCCTGTGGYGGGG CCTGGTGAGTCACTACCTTGG'] |
| 1703 | NM_004937.2(CTNS): c.473T > C (p.Leu158Pro) | 1497 | CTNS | ['TCCACCCCTGCAGTGTCATTGGTCYGAGCT TCGACTTCGTGGCTCTGAAC'] |
| 1704 | NM_006329.3(FBLN5): c.649T > C (p.Cys217Arg) | 10516 | FBLN5 | ['GAACGAGTGTGCCACCGAGAACCCCYGCGT GCAAACCTGCGTCAACACCTA'] |
| 1705 | NM_006432.3(NPC2): c.295T > C (p.Cys99Arg) | 10577 | NPC2 | ['TGATGGTTGTAAGAGTGGAATTAACYGCCCT ATCCAAAAAGACAAGACCTA'] |
| 1706 | NM_007375.3(TARDBP): c.*83T > C | 23435 | TARDBP | ['CATGGTAAGTATATTGTAAAATACAYATGTA CTAAGAATTTTCAAAATTGG'] |
| 1707 | NM_013246.2(CLCF1): c.46T > C (p.Cys16Arg) | −1 | — | ['CTCGTGGGGATGTTAGCGTGCCTGYGCAC GGTGCTCTGGCACCTCCCTGC'] |
| 1708 | NM_013246.2(CLCF1): c.676T > C (p.Ter226Arg) | −1 | — | ['CCTGCACCTGGGGGCTCATGGCTTCYGACTT CTGACCTTCTCCTCTTCGCT'] |
| 1709 | NM_024577.3(SH3TC2): c.1982T > C (p.Leu661Pro) | 79628 | SH3TC2 | ['CTGCCCTTTGCCGAGCGCCTGCAGCYCCTCT CTGGACACCCTCCTGCCTCT'] |
| 1710 | NM_172107.2(KCNQ2): c.2T > C (p.Met1Thr) | 3785 | KCNQ2 | ['CCGGGGCGCCTCCCGCCAGGCACCAYGGTG CAGAAGTCGCGCAACGGCGGC'] |
| 1711 | NM_004304.4(ALK): c.3749T > C (p.Ile1250Thr) | 238 | ALK | ['TGCATTTCCTTTCTTCCCAGAGACAYTGCTG CCAGAAACTGCCTCTTGACC'] |
| 1712 | NM_000495.4(COL4A5): c.4690T > C (p.Cys1564Arg) | 1287 | COL4A5 | ['TTCCTTCTCCTTTTCCTTTACCAGAYGTGCAG TATGTGAAGCTCCAGCTGT'] |

TABLE 6-continued

Diseases/disorders containging T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1713 | NM_000495.4(COL4A5): c.4699T > C (p.Cys1567Arg) | 1287 | COL4A5 | ['CTTTTCCTTTACCAGATGTGCAGTAYGTGAA GCTCCAGCTGTGGTGATCGC'] |
| 1714 | NM_000495.4(COL4A5): c.4756T > C (p.Cys1586Arg) | 1287 | COL4A5 | ['CAGTCAGACGATCCAGATTCCCCATYGTCCT CAGGGATGGGATTCTCTGTG'] |
| 1715 | NM_000495.4(COL4A5): c.4803 + 121T > C | 1287 | COL4A5 | ['TAAGAAGCTTAAACTTCAAACAGCTYCTATC CAAGCACTGTGTTCCCCCTC'] |
| 1716 | NM_000495.4(COL4A5): c.5032T > C (p.Cys1678Arg) | 1287 | COL4A5 | ['AGACTTGAGGACACGAATTAGCCGAYGTCA AGTGTGCATGAAGAGGACATA'] |
| 1717 | NM_005359.5(SMAD4): c.970T > C (p.Cys324Arg) | 4089 | SMAD4 | ['ATTTCCTATAGCTCCTGAGTATTGGYGTTCC ATTGCTTACTTTGAAATGGA'] |
| 1718 | NM_005359.5(SMAD4): c.1087T > C (p.Cys363Arg) | 4089 | SMAD4 | ['GGACCCTTCTGGAGGAGATCGCTTTYGTTTG GGTCAACTCTCCAATGTCCA'] |
| 1719 | NM_005359.5(SMAD4): c.1598T > C (p.Leu533Pro) | 4089 | SMAD4 | ['ATTGAAATTCACTTACACCGGGCCCBCCAGC TCCTAGACGAAGTACTTCAT'] |
| 1720 | NM_020630.4(RET): c.1831T > C (p.Cys611Arg) | 5979 | RET | ['TAAAGCTGGCTATGGCACCTGCAACNGCTTC CCTGAGGAGGAGAAGTGCTT'] |
| 1721 | NM_020630.4(RET): c.1888T > C (p.Cys630Arg) | 5979 | RET | ['ACCACCCCCACCCACAGATCCACTGYGCGA CGAGCTGTGCCGCACGGTGAT'] |
| 1722 | NM_000060.3(BTD): c.248T > C (p.Leu83Ser) | 686 | BTD | ['GCTCTCATCAGCCGCCAAGAGGCCTYGGAG CTCATGAACCAGAACCTTGAC'] |
| 1723 | NM_000060.3(BTD): c.445T > C (p.Phe149Leu) | 686 | BTD | ['GAACCCATGCCTGGAGCCTCACCGCYTCAAT GACACAGAGGTGATTCCTGC'] |
| 1724 | NM_000060.3(BTD): c.743T > C (p.Ile248Thr) | 686 | BTD | ['TTTGGCATCTTCACATGCTTTGATAYATTGTT CTTTGACCCTGCCATCAGA'] |
| 1725 | NM_000060.3(BTD): c.764T > C (p.Ile255Thr) | 686 | BTD | ['GATATATTGTTCTTTGACCCTGCCAYCAGAG TCCTCAGAGACTACAAGGTG'] |
| 1726 | NM_000060.3(BTD): c.833T > C (p.Leu278Pro) | 686 | BTD | ['ACTGCCTGGATGAACCAGCTCCCACYCTTGG CAGCAATTGAGATTCAGAAA'] |
| 1727 | NM_000060.3(BTD): c.1096T > C (p.Ser366Pro) | 686 | BTD | ['CCATAGTAAGTTTTTAAAAATTTTGYCAGGC GATCCGTACTGTGAGAAGGA'] |
| 1728 | NM_000060.3(BTD): c.1214T > C (p.Leu405Pro) | 686 | BTD | ['GAGATGATGTATGACAATTTCACCCYGGTCC CTGTCTGGGGAAAGGAAGGC'] |
| 1729 | NM_000060.3(BTD): c.1252T > C (p.Cys418Arg) | 686 | BTD | ['GGGAAAGGAAGGCTATCTCCACGTCYGTTC CAATGGCCTCTGCTGTTATTT'] |
| 1730 | NM_000060.3(BTD): c.1267T > C (p.Cys423Arg) | 686 | BTD | ['TCTCCACGTCTGTTCCAATGGCCTCYGCTGT TATTTACTTTACGAGAGGCC'] |
| 1731 | NM_000060.3(BTD): c.1459T > C (p.Trp487Arg) | 686 | BTD | ['CACGGGGATATTTGAGTTTCACCTGYGGGGC AACTTCAGTACTTCCTATAT'] |
| 1732 | NM_000155.3(GALT): c.265T > C (p.Tyr89His) | 2592 | GALT | ['TCCTTGTCGGTAGGTGAATCCCCAGBACGAT AGCACCTTCCTGTTTGACAA'] |
| 1733 | NM_000155.3 (GALT): c.328 + 2T > C | 2592 | GALT | ['TGCAGCCTGATGCCCCAGTCCAGGYAACCT GGCTCCAACTGCTGCTGGGG'] |
| 1734 | NM_000155.3(GALT): c.336T > C (p.Ser112=) | 2592 | GALT | ['GATACTCCTTTACCTCAGGACCCAGYGATCA TCCCCTTTTCCAAGCAAAGT'] |
| 1735 | NM_000155.3(GALT): c.350T > C (p.Phe117Ser) | 2592 | GALT | [TCAGGACCCAGTGATCATCCCCTTTYCCAAG CAAAGTCTGCTCGAGGAGTC'] |
| 1736 | NM_000155.3(GALT): c.374T > C (p.Val125Ala) | 2592 | GALT | ['TTCCAAGCAAAGTCTGCTCGAGGAGYCTGG TAACTATGGATTTCCCCTCTT'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1737 | NM_000155.3(GALT): c.425T > C (p.Met142Thr) | 2592 | GALT | ['TGGTCGGATGTAACGCTGCCACTCAHGTCGG TCCCTGAGATCCGGGCTGTT'] |
| 1738 | NM_000155.3(GALT): c.452T > C (p.Val151Ala) | 2592 | GALT | ['TCGGTCCCTGAGATCCGGGCTGTTGYTGATG CATGGGCCTCAGTCACAGAG'] |
| 1739 | NM_000155.3(GALT): c.460T > C (p.Trp154Arg) | 2592 | GALT | ['TGAGATCCGGGCTGTTGTTGATGCABGGGCC TCAGTCACAGAGGAGCTGGG'] |
| 1740 | NM_000155.3(GALT): c.482T > C (p.Leu161Pro) | 2592 | GALT | ['GCATGGGCCTCAGTCACAGAGGAGCYGGGT GCCCAGTACCCTTGGGTGCAG'] |
| 1741 | NM_000155.3(GALT): c.499T > C (p.Trp167Arg) | 2592 | GALT | ['AGAGGAGCTGGGTGCCCAGTACCCTYGGGT GCAGGTTTGTGAGGTCGCCCC'] |
| 1742 | NM_000155.3 (GALT): c.507 + 2T > C | 2592 | GALT | ['GGTGCCCAGTACCCTTGGGTGCAGGYTTGTG AGGTCGCCCCTTCCCCTGGA'] |
| 1743 | NM_000155.3(GALT): c.509T > C (p.Ile170Thr) | 2592 | GALT | ['GAGCTCCGTATCCCTATCTGATAGAHCTTTG AAAACAAAGGTGCCATGATG'] |
| 1744 | NM_000155.3(GALT): c.584T > C (p.Leu195Pro) | 2592 | GALT | ['TGACAGGTATGGGCCAGCAGTTTCCYGCCA GATATTGCCCAGCGTGAGGAG'] |
| 1745 | NM_000155.3(GALT): c.650T > C (p.Leu217Pro) | 2592 | GALT | ['TATAAGAGTCAGCATGGAGAGCCCCYGCTA ATGGAGTACAGCCGCCAGGAG'] |
| 1746 | NM_000155.3(GALT): c.677T > C (p.Leu226Pro) | 2592 | GALT | ['CTAATGGAGTACAGCCGCCAGGAGCYACTC AGGAAGGTGGGAGAGAGCCAA'] |
| 1747 | NM_000155.3(GALT): c.687 + 2T > C | 2592 | GALT | ['AGCCGCCAGGAGCTACTCAGGAAGGYGGGA GAGAGCCAAGCCCTGTGTCCC'] |
| 1748 | NM_000155.3(GALT): c.745T > C (p.Trp249Arg) | 2592 | GALT | ['AGTACTGGTCCCCTTCTGGGCAACAYGGCCC TACCAGACACTGCTGCTGCC'] |
| 1749 | NM_000155.3(GALT): c.967T > C (p.Tyr323His) | 2592 | GALT | ['CCATTGGCAGCTGCACGCTCATTACBACCCT CCGCTCCTGCGCTCTGCCAC'] |
| 1750 | NM_000155.3(GALT): c.980T > C (p.Leu327Pro) | 2592 | GALT | ['CACGCTCATTACTACCCTCCGCTCCYGCGCT CTGCCACTGTCCGGAAATTC'] |
| 1751 | NM_000155.3(GALT): c.1138 > C (p.Ter380Arg) | 2592 | GALT | ['GGACAGGGAGACAGCAACCATCGCCYGACC ACGCCGACCACAGGGCCTTGA'] |
| 1752 | NM_207346.2(TSEN54): c.277T > C (p.Ser93Pro) | 283989 | TSEN54 | ['AGAAGAGGGCTTCGTGGAGTTGAAGYCTCC CGCGGTGAGCGGCGGGCTCGG'] |
| 1753 | NM_016269.4(LEF1): c.181T > C (p.Ser61Pro) | -1 | — | ['CATCAAGTCTTCCTTGGTGAACGAGYCTGAA ATCATCCCGGCCAGCAACGG'] |
| 1754 | NM_001928.2(CFD): c.640T > C (p.Cys214Arg) | 1675 | CFD | ['GGGTGACTCCGGGGGCCCGCTGGTGYGCGG GGGCGTGCTCGAGGGCGTGGT'] |
| 1755 | NM_001458.4(FLNC): c.752T > C (p.Met251Thr) | 2318 | FLNC | ['CCCAACGTGGATGAGCATTCTGTTAYGACCT ACCTGTCCCAGTTCCCCAAG'] |
| 1756 | NM_000781.2(CYP11A1): c.665T > C (p.Leu222Pro) | 1583 | CYP11A1 | ['ATTTTTGGGGAGCGCCAGGGGATGCYGGAG GAAGTAGTGAACCCCGAGGCC'] |
| 1757 – 1761 | NM_000782.4(CYP24A1): c.1226T > C (p.Leu409Ser) | 1591 | CYP24A1 | [ATAATAATGATGGTTGccaacatgcgctgagt gcttaaaatgtgccaggta', 'ataaataggtaaagggctttagaattgtgcac catactcacaaccaccctg', 'cgcagcagattctgttattaaacccchttaca gacgaagtttgaggctcac', 'agagattatgtaactcactcaagacaacacag ataaaagatgaaactgaat', 'ACAAATTCTACTTACTCCTTTGGGTRAAGCAT ATTCACCCAGAACTGTTGC'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1762 | NM_001145661.1(GATA2): c.1117T > C (p.Cys373Arg) | 2624 | GATA2 | ['CAACGGGGACCCTGTCTGCAACGCCYGTGG CCTCTACTACAAGCTGCACAA'] |
| 1763 | NM_004523.3(KIF11): c.2547 + 2T > C | 3832 | KIF11 | ['CAGGAACTTCACAACTTATTGGAGGYAATA ACTTTGTAAGTGGAACTTACT'] |
| 1764 | NM_000238.3(KCNH2): c.1831T > C (p.Tyr611His) | 3757 | KCNH2 | ['GGGCGGCCCCTCCATCAAGGACAAGBATGT GACGGCGCTCTACTTCACCTT'] |
| 1765 | NM_002465.3(MYBPC1): c.706T > C (p.Trp236Arg) | 4604 | MYBPC1 | ['GGAGGAAGAACCCCAGGTGGACGTAYGGGA GTTGCTGAAGAACGCGAAACC'] |
| 1766 | NM_002465.3(MYBPC1): c.2566T > C (p.Tyr856His) | 4604 | MYBPC1 | ['CATTCCAAGACACCTGAAGCAAACCYATAT CCGCAGAGTTGGAGAAGCTGT'] |
| 1767 | NM_005211.3(CSF1R): c.2624T > C (p.Met875Thr) | 1436 | CSF1R | ['AAACTGGTGAAGGATGGATACCAAAYGGCC CAGCCTGCATTTGCCCCAAAG'] |
| 1768 | NM_005211.3(CSF1R): c.2381T > C (p.Ile794Thr) | 1436 | CSF1R | ['TTGACCAATGGTCATGTGGCCAAGAYTGGG GACTTCGGGCTGGCTAGGGAC'] |
| 1769 | NM_003392.4(WNT5A): c.544T > C (p.Cys182Arg) | 7474 | WNT5A | ['GCCGCGGGACTGGCTCTGGGGCGGCYGCGG CGACAACATCGACTATGGCTA'] |
| 1770 | NM_005188.3(CBL): c.1150T > C (p.Cys384Arg) | 867 | CBL | ['CTCCACATTCCAACTATGTAAAATABGTGCT GAAAATGATAAGGATGTAAA'] |
| 1771 | NM_005188.3(CBL): c.1186T > C (p.Cys396Arg) | 867 | CBL | ['TGATAAGGATGTAAAGATTGAGCCCYGTGG ACACCTCATGTGCACATCCTG'] |
| 1772 | NM_006902.4(PRRX1): c.338T > C (p.Phe113Ser) | 5396 | PRRX1 | ['CAGCTGCAGGCTTTGGAGCGTGTCTYTGAGC GGACACACTATCCTGATGCT'] |
| 1773 | NM_001111035.1(ACP5): c.602T > C (p.Leu201Pro) | -1 | — | ['GCGGCGGCCAGGGAGGACTACGTGCYGGTG GCTGGCCACTACCCCGTGTGG'] |
| 1774 | NM_000329.2(RPE65): c.1102T > C (p.Tyr368His) | 6121 | RPE65 | ['GGCTCCCCAACCTGAAGTTAGGAGAYATGT ACTTCCTTTGAATATTGACAA'] |
| 1775 | NM_003172.3(SURF1): c.679T > C (p.Trp227Arg) | 6834 | SURF1 | ['TGAGAACAATCCAGAAAGGAACCACYGGCA TTATCGAGACCTGGAAGCTAT'] |
| 1776 | NM_002734.4(PRKAR1A): c.1117T > C (p.Tyr373His) | 5573 | PRKAR1A | ['CATCCTCAAACGAAACATCCAGCAGYACAA CAGTTTTGTGTCACTGTCTGT'] |
| 1777 | NM_002734.4(PRKAR1A): c.980T > C (p.Ile327Thr) | 5573 | PRKAR1A | ['CCATCTTTGCTTTCTCCAGGTGAAAYTGCAC TACTGATGAATCGTCCTCGT'] |
| 1778 | NM_003491.3(NAA10): c.109T > C (p.Ser37Pro) | 8260 | NAA10 | [GAAATACTACTTCTACCATGGCCTTYCCTGG CCCCAGGTGGGCAGCTTCTG'] |
| 1779 | NM_006306.3(SMC1A): c.2351T > C (p.Ile784Thr) | 8243 | SMC1A | ['GTGTTTGAAGAGTTTTGTCGGGAGAYTGGTG TGCGCAACATCCGGGAGTTT'] |
| 1780 | NM_000377.2(WAS): c.814T > C (p.Ser272Pro) | 7454 | WAS | ['CGACCCAGATCTGCGGAGTCTGTTCYCCAGG GCAGGAATCAGCGAGGCCCA'] |
| 1781 | NM_000377.2(WAS): c.881T > C (p.Ile294Thr) | 7454 | WAS | ['ACCTCTAAACTTATCTACGACTTCAYTGAGG ACCAGGGTGGGCTGGAGGCT'] |
| 1782 | m.12338T > C | 4540 | MT-ND5 | ['TTGGTGCAACTCCAAATAAAAGTAAYAACC ATGCACACTACTATAACCACC'] |
| 1783 | m.5814T > C | 4511 | MT-TC | ['TCGAATTTGCAATTCAATATGAAAAYCACCT CGGAGCTGGTAAAAAGAGGC'] |
| 1784 | m.12201T > C | 4564 | MT-TH | ['GACAACAGAGGCTTACGACCCCTTAYTTACC GAGAAAGCTCACAAGAACTG'] |
| 1785 | NM_001165899.1(PDE4D): c.494T > C (p.Phe165Ser) | 5144 | PDE4D | ['GGAGATGACTTGATTGTGACTCCATBGCTC AGGTAAGCACAGCTTGGTGA'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1786 | NM_139125.3(MASP1): c.1888T > C (p.Cys630Arg) | 5648 | MASP1 | ['GTTACCCGTGGTGCCTCACGCTGAGYGCAA AACTAGCTATGAGTCCCGCTC'] |
| 1787 | NM_007315.3(STAT1): c.520T > C (p.Cys174Arg) | 6772 | STAT1 | ['TTTACAAGATGAATATGACTTCAAAYGCAA AACCTTGCAGAACAGAGGTAA'] |
| 1788 | NM_053025.3(MYLK): c.5275T > C (p.Ser1759Pro) | -1 | — | ['TGCTGTGAGAGCCATTGGAAGACTGYCCTCT ATGGCAATGATCTCAGGGCT'] |
| 1789 | NM_001235.3(SERPINH1): c.233T > C (p.Leu78Pro) | 871 | SERPINH1 | ['TCACCCGTGGTGGTGGCCTCGTCGCYAGGGC TCGTGTCGCTGGGCGGCAAG'] |
| 1790 | NM_005921.1(MAP3K1): c.566T > C (p.Leu189Pro) | 4214 | MAP3K1 | ['GAGGAACGAATGATCAGGGAGAAACBGAA GGCAACCTGTATGCCAGCCTGG'] |
| 1791 | NM_005359.5(SMAD4): c.1499T > C (p.Ile500Thr) | 4089 | SMAD4 | ['GTTGATGACCTTCGTCGCTTATGCAYACTCA GGATGAGTTTTGTGAAAGGC'] |
| 1792 | NM_000287.3(PEX6): c.1601T > C (p.Leu534Pro) | 5190 | PEX6 | ['CTGTTGCTCACAGCTGTGGACCTTCYGGGCC GGGACCGTGATGGGCTGGGT'] |
| 1793 | NM_004153.3(ORC1): c.266T > C (p.Phe89Ser) | 4998 | ORC1 | ['AAGAAACGTGCTCGAGTACAGTGGTYTGTC CGATTCTGTGAAGTCCCTGCC'] |
| 1794 | NM_006225.3(PLCD1): c.562T > C (p.Cys188Arg) | 5333 | PLCD1 | ['CTCGGCTGTCCTGGCTCTGCAGGAGYGTGAC CACTCCCAGACAGACTCCCT'] |
| 1795 | NM_021252.4(RAB18): c.619T > C (p.Ter207Gln) | 22931 | RAB 18 | ['CTGTGGTGGTTATTGCTCTGTGTTAYAAACT CTGGGAAATTCCATCTCTTG'] |
| 1796 | NM_002242.4(KCNJ13): c.722T > C (p.Leu241Pro) | -1 | — | ['TGGTGTAATGGAGTGATAGTACGTTDGTGG AAAGATGAAGAATGGACATTC'] |
| 1797 | NM_003072.3(SMARCA4): c.3032T > C (p.Met1011Thr) | 6597 | SMARCA4 | ['CTGCAGCGAGTGCTCTACCGCCACAYGCAG GCCAAGGGCGTGCTGCTGACT'] |
| 1798 | NM_013339.3 (AL G6): c.391T > C (p.Tyr131His) | 29929 | ALG6 | ['GAGATTTCTTTTAAGCAACAACAGTRCAAAA CCACTGCAGGTATGTAAATC'] |
| 1799 | NM_019885.3(CYP26B1): c.436T > C (p.Ser146Pro) | 56603 | CYP26B1 | ['TTGCCTCTCTGCCTTCCAGGTCTTCYCCAAG ATCTTCAGCCACGAGGCCCT'] |
| 1800 | NM_020433.4(JPH2): c.421T > C (p.Tyr141His) | 57158 | JPH2 | ['GTTCACCAACGGCATGCGCCATGGCYACGG AGTACGCCAGAGCGTGCCCTA'] |
| 1801 | NM_000199.3(SGSH): c.892T > C (p.Ser298Pro) | 6448 | SGSH | ['CCCCAGCGTTTGGGTGCTCCGGGGRTGACA CCAGTAAGGGTTCAGCAGTG'] |
| 1802 | NM_173170.1(IL36RN): c.80T > C (p.Leu27Pro) | 26525 | IL36RN | ['CTTTATCTGCATAATAACCAGCTTCYAGCTG GAGGGCTGCATGCAGGGAAG'] |
| 1803 | NM_016599.4(MYOZ2): c.142T > C (p.Ser48Pro) | 51778 | MYOZ2 | ['CAGAGACATCATGTTGGAAGAATTAYCCCA TCTCAGTAACCGTGGTGCCAG'] |
| 1804 | NM_020191.2(MRPS22): c.644T > C (p.Leu215Pro) | 56945 | MRPS22 | ['CCAATAATTTTCAAGGAAGAAAATCYTAGG GTAAGGTGACTTAGGTTTTAT'] |
| 1805 | NM_004278.3(PIGL): c.500T > C (p.Leu167Pro) | 9487 | PIGL | ['TTGTCCTATCCCTCCTCCAGGGCCCYGCACT CAGAAGGGAAGTTACCTAAA'] |
| 1806 | NM_022445.3(TPK1): c.119T > C (p.Leu40Pro) | 27010 | TPK1 | ['ATTTTGTTCTTTCTATTTGAAGCTCYTTTAAG AGCCTGTGCCGATGGAGGT'] |
| 1807 | NM_020634.1(GDF3): c.914T > C (pLeu305Pro) | 9573 | GDF3 | ['TGTCCCTTCTCACTGACCATCTCTCYCAACA GCTCCAATTATGCTTTCATG'] |
| 1808 | NM_017882.2(CLN6): c.200T > C (p.Leu67Pro) | 54982 | CLN6 | ['CCCATTCTTCCATTTGCTCCGCAGCYGGTAT TCCCTCTCGAGTGGTTTCCA'] |
| 1809 | NM_024513.3(FYCO1): c.4127T > C (p.Leu1376Pro) | 79443 | FYCO1 | ['TTTGTGAGGTCCAGCACCTACAGCCYGATCC CCATCACTGTGGCCGAGGCA'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1810 | NM_006147.3(IRF6): c.65T > C (p.Leu22Pro) | 3664 | IRF6 | ['CTGGTGGCCCAGGTGGATAGTGGCCYCTAC CCTGGGCTCATCTGGCTACAC'] |
| 1811 | NM_025132.3(WDR19): c.2129T > C (p.Leu710Ser) | 57728 | WDR19 | ['GGAAATGTTGGCATAGTGATGTCCTYGGAA CAAATAAAGGTAAACAGCATG'] |
| 1812 | NM_025132.3(WDR19): c.20T > C (p.Leu7Pro) | 57728 | WDR19 | ['TTTATTTTTAGCGTATTTCTCACYGCTAGA AAAGACTTGGCTTGGCGCA'] |
| 1813 | NM_153026.2(PRICKLE1): c.1414T > C (p.Tyr472His) | 144165 | PRICKLE1 | ['AAGTAAAAAATACCAGTCTGATATGYACTG GGCACAGTCACAAGATGGACT'] |
| 1814 | NM_014874.3(MFN2): c.1392 + 2T > C | 9927 | MFN2 | ['GTAGTCCTCAAGGTTTATAAGAATGWGAGT CATGGAGCAACAGGTCCTCTT'] |
| 1815 | NM_014874.3(MFN2): c.647T > C (p.Phe216Ser) | 9927 | MFN2 | ['GAGCTGGACAGCTGGATTGACAAGTYTTGT CTGGATGCTGATGTGTTTGTG'] |
| 1816 | NM_016097.4(IER3IP1): c.233T > C (p.Leu78Pro) | 51124 | IER3IP1 | ['GTAAACTCAATTGCAATTGTGTTACYTTTAT TATTTGGATGAATATCAGTG'] |
| 1817 | NM_018718.2(CEP41): c.107T > C (p.Met36Thr) | 95681 | CEP41 | ['TTCGAGCTTCTCAGTATATTTAGTCRTACTGT TACCTAAAAAGAAAATAAG'] |
| 1818 | NM_022489.3(INF2): c.310T > C (p.Cys104Arg) | 64423 | INF2 | ['CCTGCTGCAGCTCACCTGCGTCAGCYGCGTG CGCGCCGTCATGAACTCGCG'] |
| 1819 | NM_022489.3(INF2): c.383T > C (p.Leu128Pro) | 64423 | INF2 | ['AGCAACCAGGGCTACGTGCGCCAGCYCTCC CAGGGTGAGCCGCAGTGTGGG'] |
| 1820 | NM_018713.2(SLC30A10): c.266T > C (p.Leu89Pro) | 55532 | SLC30A10 | ['GGCGCGCTGAGCAACGCGGTCTTCCYCACC GCGCTCTGCTTCACCATCTTC'] |
| 1821 | NM_058246.3(DNAJB6): c.277T > C (p.Phe93Leu) | 10049 | DNAJB6 | ['CAGTCCATTTGAATTTGGCTTCACAYTCCGT AACCCAGATGATGTCTTCAG'] |
| 1822 | NM_024753.4(TTC21B): c.2384T > C (p.Leu795Pro) | 79809 | TTC21B | ['CAAAAGAATTATCTTTGCTATGACCYGGCTG AGCTCTTATTAAAATTGAAA'] |
| 1823 | NM_032446.2(MEGF10): c.2320T > C (p.Cys774Arg) | 84466 | MEGF10 | ['TGACTGCGACCACATTTCTGGGCAGYGTACT TGCCGCACTGGATTCATGGG'] |
| 1824 | NM_032446.2(MEGF10): c.976T > C (p.Cys326Arg) | 84466 | MEGF10 | ['CGTTCTCTGTGCTGAGACCTGCCAGYGTGTC AACGGAGGGAAGTGTTACCA'] |
| 1825 | NM_024027.4(COLEC11): c.505T > C (p.Ser169Pro) | 78989 | COLEC11 | ['GAAGCGCTACGCGGACGCCCAGCTGYCCTG CCAGGGCCGCGGGGGCACGCT'] |
| 1826 | NM_000035.3(ALDOB): c.1027T > C (p.Tyr343His) | 229 | ALDOB | ['GCCCCAGAAGAACCCGTGTGAACATRCTGT CCTTTGGCCGCCTGGCAGTTA'] |
| 1827 | NM_012338.3(TSPAN12): c.734T > C (p.Leu245Pro) | 23554 | TSPAN12 | ['CCTTCTATCATAATACAGAGCCCAGRGCAGA GTAATGGTGAGAATCATGGC'] |
| 1828 | NM_001159772.1(CANT1): c.671T > C (p.Leu224Pro) | 124583 | CANT1 | ['CTCCTTGCCCAGGCCGCCCACGTACRGACGC TCGTCCTTCACTGCCAGCCA'] |
| 1829 | NM_001006657.1(WDR35): c.781T > C (p.Trp261Arg) | 57539 | WDR35 | ['TGGCATGTACGTAGTAGGCATCCAGYGGAA CCACATGGGCAGCGTGTTAGC'] |
| 1830 | NM_000420.2(KEL): c.1790T > C (p.Leu597Pro) | 3792 | KEL | ['TCAACAGTACTGCCTGGGGCTGCCYCGCCT GTGACAACCATGCCCTCCAG'] |
| 1831 | NM_001243473.1(B9D1): c.400 + 2T > C | 27077 | B9D1 | ['AGGGCCCAGGTCAGAATGAGGACCTRCCGG CCAGGTGAGAAGGGCACGTGC'] |
| 1832 | NM_015175.2(NBEAL2): c.1163T > C (p.Leu388Pro) | 23218 | NBEAL2 | ['ATTGCAGTCCATGTAGTCAGAGTGCYGACCT GCATCATGAGTGACTCCCCC'] |
| 1833 | NM_000196.3(HSD11B2): c.1012T > C (p.Tyr338His) | 3291 | HSD11B2 | ['GCTGGCAGCTCGGCCCCGCCGCCGCYATTAC CCCGGCCAGGGCCTGGGGCT'] |

TABLE 6-continued

Diseases/disorders containging T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1834 | NM_024599.5(RHBDF2): c.557T > C (p.Ile186Thr) | 79651 | RHBDF2 | ['GCTTACCGCCCCCTCCCTTCCAGAYTGTGG ATCCGCTGGCCCGGGGCCGG'] |
| 1835 | NM_001256714.1(DNAAF3): c.386T > C (p.Leu129Pro) | 352909 | DNAAF3 | ['GGCTCTGTGGATGGACGGCACCTGCYGCGG ACCCTGTCCCGAGCGAAGTTC'] |
| 1836 | NM_020894.2(UVSSA): c.94T > C (p.Cys32Arg) | 57654 | UVSSA | ['GAAAATGAAGGAACTGAAGAAAATTYGCAA GTATGTCTTAGGGTTCAGTAA] |
| 1837 | NM_004453.3(ETFDH): c.1130T > C (p.Leu377Pro) | 2110 | ETFDH | ['TTGTTTCCTCAGTCTATACCAAAACYCACCT TTCCTGGTGGTTTACTAATT'] |
| 1838 | NM_024306.4(FA2H): c.707T > C (p.Phe236Ser) | 79152 | FA2H | ['CTCATCGAGTACCTCATCCACCGCTYCCTGT TCCACATGAAGCCCCCAGC'] |
| 1839 | NM_001004127.2(ALG11): c.1142T > C (p.Leu381Ser) | -1 | — | ['AAAATAAACATTCCATTTGATGAATYAAAG AATTATTTGTCTGAAGCAACA] |
| 1840 | NM_021167.4(GATAD1): c.304T > C (p.Ser102Pro) | 57798 | GATAD1 | ['TCGGCTCAGAAACACTAAATACAAAYCTGC TCCGGCTGCTGAAAAGAAAGT'] |
| 1841 | NM_016042.3(EXOSC3): c.712T > C (p.Trp238Arg) | 51010 | EXOSC3 | ['AGTATTTGGAATGAATGGAAGAATAYGGGT TAAGGCAAAAACCATCCAGCA'] |
| 1842 | NM_001018005.1(TPM1): c.515T > C (p.Ile172Thr) | 7168 | TPM1 | ['CAGGTGGCCCGTAAGCTGGTCATCAYTGAG AGCGACCTGGAACGTGCAGAG'] |
| 1843 | NM_001018005.1(TPM1): c.842T > C (p.Met281Thr) | 7168 | TPM1 | ['GAGCTGGACCACGCTCTCAACGATAYGACT TCCATGTAAACGTTCATCCAC'] |
| 1844 | NM_033360.3(KRAS): c.211T > C (p.Tyr71His) | 3845 | KRAS | ['GGAGTACAGTGCAATGAGGGACCAGYACAT GAGGACTGGGGAGGGCTTTCT'] |
| 1845 | NM_006218.2(PEK3CA): c.1258T > C (p.Cys420Arg) | 5290 | PIK3CA | ['TTTTTCTTTGTTTTTTAAGGAACACYGTCCAT TGGCATGGGGAAATATAAA'] |
| 1846 | NM_006265.2(RAD21): c.1753T > C (p.Cys585Arg) | -1 | — | ['TGAATCTATCAGTTTGCTTGAGTTAYGTCGA AATACGAACAGAAAACAAGC'] |
| 1847 | NM_000222.2(KIT): c.1859T > C (p.Val620Ala) | 3815 | KIT | ['ATTAAGTCAGATGCGGCCATGACTGYCGCT GTAAAGATGCTCAAGCGTAAG'] |
| 1848 | NM_000076.2(CDKN1C): c.827T > C (p.Phe276Ser) | 1028 | CDKN1C | ['CGCGCGCTGTCGCCCGCAGATTTCTYCGCCA AGCGCAAGAGATCAGCGCCT'] |
| 1849 | NM_005691.3(ABCC9): c.3058T > C (p.Ser1020Pro) | 10060 | ABCC9 | ['AGACTATTGGCTGGCCACATGGACAYCGGA GTACAGTATAAACAATACTGG'] |
| 1850 | NM_012343.3(NNT): c.2930T > C (p.Leu977Pro) | 23530 | NNT | ['ATGCCTGGTCAGCTTAATGTGCTGCYGGCTG AGGCTGGTGTGCCATATGAC'] |
| 1851 | NM_024110.4(CARD14): c.467T > C (p.Leu156Pro) | 79092 | CARD14 | ['GTGCTGCTGCGGCGGTGCCAGCAGCYGCAG GAGCACCTGGGCCTGGCCGAG'] |
| 1852 | NM_000492.3(CFTR): c.1400T > C (p.Leu467Pro) | 1080 | CFTR | ['GATGGGTTTTATTTCCAGACTTCACYTCTAA TGGTGATTATGGGAGAACTG'] |
| 1853 | NM_000518.4(HBB): c.2T > C (p.Met1Thr) | 3043 | HBB | ['CACTAGCAACCTCAAACAGACACCANGGTG CATCTGACTCCTGAGGAGAAG'] |
| 1854 | NM_000518.4(HBB): c.*110T > C | 3043 | HBB | ['CCTTGAGCATCTGGATTCTGCCTAAHAAAAA ACATTTATTTTCATTGCAAT'] |
| 1855 | NM_000518.4(HBB): c.92 + 2T > C | 3043 | HBB | ['AGTTGGTGGTGAGGCCCTGGGCAGGNTGGT ATCAAGGTTACAAGACAGGTT'] |
| 1856 | NM_000206.2(IL2RG): c.455T > C (p.Val152Ala) | 3561 | IL2RG | ['ACCACATATGCACACATATCTCCAGYGATCC CCTGGGCTCCAGAGAACCTA'] |
| 1857 | NM_000244.3(MEN1): c.518T > C (p.Leu173Pro) | 4221 | MEN1 | ['GCTGTGGTTGGGGCCTGCCAGGCCCYGGGT CTCCGGGATGTCCACCTCGCC'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1858 | NM_000256.3(MYBPC3):c.2374T>C (p.Trp792Arg) | 4607 | MYBPC3 | ['CCGCCATCGTAGGCAGGCGGCTCCCVCTGTA CTGTGCAGGAGTCCTCTCCC'] |
| 1859 | NM_002501.3(NFIX):c.179T>C (p.Leu60Pro) | 4784 | NFIX | ['GAGGAGCGGGCGGTGAAGGACGAGCYGCTG GGCGAGAAGCCCGAGATCAAG'] |
| 1860 | NM_005022.3(PFN1):c.341T>C (p.Met114Thr) | 5216 | PFN1 | ['CCTCCTCCAGCGCTAGTCCTGCTGAYGGGCA AGAAGGTGTCCACGGTGGT'] |
| 1861 | NM_001172567.1(MYD88):c.818T>C (p.Leu273Pro) | 4615 | MYD88 | ['CTTGCAGGTGCCCATCAGAAGCGACYGATC CCCATCAAGTACAAGGCAATG'] |
| 1862 | NM_001161581.1(POC1A):c.398T>C (p.Leu133Pro) | 25886 | POC1A | ['GCCAGTGATGACAAGACTGTTAAGCYGTGG GACAAGAGCAGCCGGGAATGT'] |
| 1863 | NM_005270.4(GLI2):c.4663T>C (p.Ser1555Pro) | 2736 | GLI2 | ['CCCCCGAAACTCCTTGACCCTGCCCYCCATC CCGCAGGCATCAGCAACAT'] |
| 1864 | NM_152296.4(ATP1A3):c.2431T>C (p.Ser811Pro) | 478 | ATP1A3 | ['CTCCTCCGCCTAGGTCCCTGCCATCYCACTG GCGTACGAGGCTGCCGAAAG'] |
| 1865 | NM_022787.3(NMNAT1):c.838T>C (p.Ter280Gln) | 64802 | NMNAT1 | ['GAGAAACACTGCAGAAGCTAAGACAYAGGA ATTCTACAGCATGATATTTCA'] |
| 1866 | NM_005340.6(HINT1):c.250T>C (p.Cys84Arg) | 3094 | HINT1 | ['ACACTTAATGATTGTTGGCAAGAAAYGTGCT GCTGATCTGGGCCTGAATAA'] |
| 1867 | NM_000155.3(GALT):c.416T>C (p.Leu139Pro) | 2592 | GALT | ['TTCCACCCCTGGTCGGATGTAACGCYGCCAC TCATGTCGGTCCCTGAGATC'] |
| 1868 | NM_000155.3(GALT):c.386T>C (p.Met129Thr) | 2592 | GALT | ['CTCCCGTCACCACCCAGTAAGGTCAYGTGCT TCCACCCCTGGTCGGATGTA'] |
| 1869 | NM_000155.3(GALT):c.680T>C (p.Leu227Pro) | 2592 | GALT | ['ATGGAGTACAGCCGCCAGGAGCTACYCAGG AAGGTGGGAGAGAGCCAAGCC'] |
| 1870 | NM_007294.3(BRCA1):c.4986+6T>C | 672 | BRCA1 | ['GCCTGACCCCAGAAGAATTTGTGAGBGTATC CATATGTATCTCCCTAATGA'] |
| 1871 | NM_007294.3(BRCA1):c.5074+2T>C | 672 | BRCA1 | ['CTACTCATGTTGTTATGAAAACAGGYATACC AAGAACCTTTACAGAATACC'] |
| 1872 | NM_007294.3(BRCA1):c.5207T>C (p.Val1736Ala) | 672 | BRCA1 | ['GGTTTCTTTCAGCATGATTTTGAAGBCAGAG GAGATGTGGTCAATGGAAGA'] |
| 1873 | NM_002437.4(MPV17):c.186+2T>C | 4358 | MPV17 | ['TGAAGCCCTGTTGAGGGGAGAACTTRCCAC AAAGCCACAGCCCAGGGACAC'] |
| 1874 | NM_002769.4(PRSS1):c.116T>C (p.Val39Ala) | -1 | — | ['GAGGAGAATTCTGTCCCCTACCAGGYGTCCC TGAATTCTGGCTACCACTTC'] |
| 1875 | NM_004211.3(SLC6A5):c.1444T>C (p.Trp82Arg) | 9152 | SLC6A5 | ['GATTTTCTTCTCTTTATCTGCTGCAYGGGGA GGCTGATCACTCTCTCTTC'] |
| 1876 | NM_005211.3(CSF1R):c.2297T>C (p.Met766Thr) | 1436 | CSF1R | ['TTCTCCAGCCAAGTAGCCCAGGGCAYGGCC TTCCTCGCTTCCAAGAATGTG'] |
| 1877 | NM_005211.3(CSF1R):c.2546T>C (p.Phe849Ser) | 1436 | CSF1R | [TATGGCATCCTCCTCTGGGAGATCTYCTCAC TTGGTGAGCCACTGGGCCCA'] |
| 1878 | NM_005211.3(CSF1R):c.2603T>C (p.Leu868Pro) | 1436 | CSF1R | ['CTGGTGAACAGCAAGTTCTATAAACBGGTG AAGGATGGATACCAAATGGCC'] |
| 1879 | NM_006796.2(AFG3L2):c.1997T>C (p.Met666Thr) | 10939 | AFG3L2 | ['ATTTTTCAGATTGTTCAGTTTGGCABGAATG AAAAGGTTGGGCAAATCTCC'] |
| 1880 | NM_018713.2(SLC30A10):c.1046T>C (p.Leu349Pro) | 55532 | SLC30A10 | ['GTAAGTGGAAAGATTATTGCCACCCYGCAC ATCAAGTATCCTAAGGACAGG'] |
| 1881 | NM_018713.2(SLC30A10):c.500T>C (p.Phe167Ser) | 55532 | SLC30A10 | ['GCGGAGGGCTGTGTCCCCGGCGCTTYCGGG GGGCCTCAGGGCGCGGAGGAC'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1882 | NM_000060.3(BTD): c.212T > C (p.Leu71Pro) | 686 | BTD | ['TATGAGCATCCATCCATCCTGAGTCYGAACC CTCTGGCTCTCATCAGCCGC'] |
| 1883 | NM_000495.4(COL4A5): c.438 + 2T > C | 1287 | COL4A5 | ['TTTCCTGGTTTACAGGGTCCTCCAGYAAGTT ATAAAATTTGGGATTATGAT'] |
| 1884 | NM_000282.3(PCCA): c.491T > C (p.Ile164Thr) | 5095 | PCCA | ['CAGGCAGCAGAAGATGTCGTTTTCAYTGGA CCTGACACACATGCTATTCAA'] |
| 1885 | NM_000532.4(PCCB): c.1556T > C (p.Leu519Pro) | 5096 | PCCB | ['ACACGTGCCCGAATCTGCTGTGACCYGGAT GTCTTGGCCAGCAAGAAGGTA'] |
| 1886 | NM_001099274.1(TINF2): c.860T > C (p.Leu287Pro) | 26277 | TINF2 | ['CATAAGGAGCGCCCCACAGTCATGCYGTTTC CCTTTAGGAATCTCGGCTCA'] |
| 1887 | NM_001099274.1(TINF2): c.862T > C (p.Phe288Leu) | 26277 | TINF2 | ['TAAGGAGCGCCCCACAGTCATGCTGYTTCCC TTTAGGAATCTCGGCTCACC'] |
| 1888 | NM_001363.4(DKC1): c.1049T > C (p.Met350Thr) | 1736 | DKC1 | ['TCAATGCCTGTAGCTATTGCATTAAYGACCA CAGCGGTCATCTCTACCTGC'] |
| 1889 | NM_001363.4(DKC1): c.1193T > C (p.Leu398Pro) | 1736 | DKC1 | ['AAGCTGATGATCAAGCAGGGCCTTCYGGAC AAGCATGGGAAGCCCACAGAC'] |
| 1890 | NM_004614.4(TK2): c.156 + 2T > C | 7084 | TK2 | ['CAGGAAAAAGAGAAAAAATCAGTGGYAAG TCCCTCTTTTATGTGTACTCTC'] |
| 1891 | NM_004614.4(TK2): c.644T > C (p.Leu215Pro) | 7084 | TK2 | ['GAATACCTGGAAGCAATTCACCATCYCCAT GAGGAGTGGCTCATCAAAGGC'] |
| 1892 | NM_024312.4(GNPTAB): c.1208T > C (p.Ile403Thr) | 79158 | GNPTAB | ['ATCGAAGGGCTGTCCCAGAAGTTTAYTTACC TAAATGATGATGTCATGTTT'] |
| 1893 | NM_024312.4(GNPTAB): c.3002T > C (p.Leu1001Pro) | 79158 | GNPTAB | ['TTTGCCTTCTCTTATTTTTATTATCYCATGAG TGCAGTGCAGCCACTGAAT'] |
| 1894 | NM_198253.2(TERT): c.3043T > C (p.Cys1015Arg) | 7015 | TERT | ['CCGCCATCCTCTCAGGTTTCACGCAYGTGTG CTGCAGCTCCCATTTCATCA'] |
| 1895 | NM_207352.3(CYP4V2): c.1021T > C (p.Ser341Pro) | 285440 | CYP4V2 | ['TACAACTGCAGCTGCAATAAACTGGYCCTTA TACCTGTTGGGTTCTAACCC'] |
| 1896 | NM_207352.3(CYP4V2): c.655T > C (p.Tyr219His) | 285440 | CYP4V2 | ['TGCTCAAAGTAATGATGATTCCGAGYATGTC CGTGCAGTTTATAGGTAAAT'] |
| 1897 | NM_000335.4(SCN5A): c.5504T > C (p.Ile1835Thr) | 6331 | SCN5A | ['GCCAAGCCCAACCAGATAAGCCTCAYCAAC ATGGACCTGCCCATGGTGAGT'] |
| 1898 | NM_001111.4(ADAR): c.2615T > C (p.Ile872Thr) | 103 | ADAR | ['CTCGGCCGCAAGATTCTGGCCGCCAYCATTA TGAAAAAGACTCTGAGGAC'] |
| 1899 | NM_004281.3(BAG3): c.1385T > C (p.Leu462Pro) | 9531 | BAG3 | ['ATCGAAGAGTATTTGACCAAAGAGCYGCTG GCCCTGGATTCAGTGGACCCC'] |
| 1900 | NM_183075.2(CYP2U1): c.784T > C (p.Cys262Arg) | 113612 | CYP2U1 | ['TTTTATGTCACGAGGCCTAGAAATCYGTCTG AACAGTCAAGTCCTCCTGGT'] |
| 1901 | NM_006177.3(NRL): c.287T > C (p.Met96Thr) | 4901 | NRL | ['TTGGGGCTGAGTCCTGAAGAGGCCAYGGAG CTGCTGCAGGGTCAGGGCCCA'] |
| 1902 | NM_000344.3(SMN1): c.388T > C (p.Tyr130His) | 6606 | SMN1 | ['AACCTGTGTTGTGGTTTACACTGGAYATGGA AATAGAGAGGAGCAAAATCT'] |
| 1903 | NM_152692.4(C1GALT1C1): c.577T > C (p.Ser193Pro) | 29071 | C1GALT1C1 | ['AGGAGGAATTGTCTTAAGTGTAGAAYCAAT GAAAAGACTTAACAGCCTTCT'] |
| 1904 | NM_024531.4(SLC52A2): c.368T > C (p.Leu123Pro) | 79581 | SLC52A2 | ['TTAGCACTGGCCTTTGTGCTGGCACYGGCAT GCTGTGCCTCGAATGTCACT'] |
| 1905 | NM_001253816.1(SLC52A2): c.1016T > C (p.Leu339Pro) | 79581 | SLC52A2 | ['GCTCACTGCAGGTCCTTGGCAGGGCYGGGC GGCCTCTCTCTGCTGGGCGTG'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1906 | NM_002609.3(PDGFRB): c.1973T > C (p.Leu658Pro) | 5159 | PDGFRB | ['TCGGAGCTGAAGATCATGAGTCACCYTGGG CCCCACCTGAACGTGGTCAAC'] |
| 1907 | NM_020822.2(KCNT1): c.2386T > C (p.Tyr796His) | 57582 | KCNT1 | ['CAACAGCTATGAAGACGCCAAGGCCYACGG GTTCAAGAACAAGCTGATCAT'] |
| 1908 | NM_001369.2(DNAH5): c.1121T > C (p.Ile374Thr) | 1767 | DNAH5 | ['ACTATAGATCATTTTAATTGCATTRTAAGT GTAGGAATAGCATCCATCAT'] |
| 1909 | NM_017802.3(DNAAF5): c.2384T > C (p.Leu795Pro) | 54919 | DNAAF5 | ['GTCCAGTACCTGTACCGAGAGTTGCYGGTTC ACCTTGACGATCCAGAGAGG'] |
| 1910 | NM_006383.3(CIB2): c.272T > C (p.Phe91Ser) | 10518 | CIB2 | ['GAGGGGAACCTCACTTTCAACGACTYTGTG GACATGTTTTCCGTGCTCTGC'] |
| 1911 | NM_006383.3(CIB2): c.368T > C (p.Ile123Thr) | 10518 | CIB2 | ['ACAGACTTCAACACTGACAACTTCAYCTGCA AGGAGGACCTGGAGCTGACG'] |
| 1912 | NM_005334.2(HCFC1): c.-970T > C | 3054 | HCFC1 | ['TTAGTTGTTACTTCTTCACACAAGAYGGCGG CTCCCAGGGAGGAGGCATGA'] |
| 1913 | NM_178012.4(TUBB2B): c.350T > C (p.Leu117Pro) | 347733 | TUBB2B | ['GGAGCCGAGCTGGTCGACTCGGTCCYGGAT GTGGTGAGGAAGGAGTCAGAG'] |
| 1914 | NM_000431.3(MVK): c.764T > C (p.Leu255Pro) | 4598 | MVK | ['GTGGCTGGCGTCAGAAACAGGCTGCYCAAG GTGACTCTTGTTCCCTTCTTG'] |
| 1915 | NM_000431.3(MVK): c.122T > C (p.Leu41Pro) | 4598 | MVK | ['TTGAACTTGAGAACATTCCTCCGGCYTCAAC CCCACAGCAATGGGAAAGTG'] |
| 1916 | NM_000431.3(MVK): c.1039 + 2T > C | 4598 | MVK | ['GTGGCATCACACTCCTCAAGCCAGGYATCCC GGGGGTAGGTGGGCCAGGCT'] |
| 1917 | NM_000431.3(MVK): c.1094T > C (p.Phe365Ser) | 4598 | MVK | ['AAGCAGGCCCTGACCAGCTGTGGCTYTGAC TGCTTGGAAACCAGCATCGGT'] |
| 1918 | NM_004055.4(CAPN5): c.731T > C (p.Leu244Pro) | 726 | CAPN5 | ['ACAGCAGCTGACATGGAGGCCCGCCYGGCG TGCGGCCTGGTAAAGGGCCAC'] |
| 1919 | NM_133497.3(KCNV2): c.491T > C (p.Phe164Ser) | 169522 | KCNV2 | [GCCGTCTTCCAGCTGGTCTACAATTYCTACC TGTCCGGGGTGCTGCTGGTG'] |
| 1920 | NM_006567.3(FARS2): c.986T > C (p.Ile329Thr) | 10667 | FARS2 | ['ATGATCCTCTACGACATCCCTGATAYCCGTC TCTTCTGGTGTGAGGACGAG'] |
| 1921 | NM_020376.3(PNPLA2): c.757 + 2T > C | 57104 | PNPLA2 | ['GCCTGCGCTTTCTGCAGCGGAACGGYGCGC GGACCCGGGCGGGAGAGGGCG'] |
| 1922 | NM_018344.5(SLC29A3): c.607T > C (p.Ser203Pro) | 55315 | SLC29A3 | ['TATGAGGAACTCCCAGGCACTGATAYCAGG TGAGAGCCAGGGTCCGGGCAG'] |
| 1923 | NM_012275.2(IL36RN): c.115 + 6T > C | 26525 | IL36RN | ['TGCAGGGAAGGTCATTAAAGGTTGGYGATG AAACATGACCCACTTTCCTTG'] |
| 1924 | m.9191T > C | 4508 | MT-ATP6 | ['TTCACACTTCTAGTAAGCCTCTACCYGCACG ACAACACATAATGACCCACC'] |
| 1925 | NM_000108.4(DLD): c.140T > C (p.Ile47Thr) | 1738 | DLD | ['GTAGTTGATGCTGATGTAACAGTTAYAGGTT CTGGTCCTGGAGGATATGTT'] |
| 1926 | NM_000080.3(CHRNE): c.223T > C (p.Trp75Arg) | -1 | — | ['AGAGGAGACTCTCACCACTAGCGTCYGGAT TGGAATCGTGAGTCAAATCTG'] |
| 1927 | NM_004376.5(COX15): c.1030T > C (p.Ser344Pro) | 1355 | COX15 | ['TGCCATTACAGTGCTCTACTTCCTCBCTCGG AGAATTCCCCTTCCTAGAAG'] |
| 1928 | NM_004333.4(BRAF): c.1403T > C (p.Phe468Ser) | 673 | BRAF | ['GGACAAAGAATTGGATCTGGATCATYTGGA ACAGTCTACAAGGGAAAGTGG'] |
| 1929 | NM_004333.4(BRAF): c.1454T > C (p.Leu485Ser) | 673 | BRAF | [TTAGGTGATGTGGCAGTGAAAATGTYGAAT GTGACAGCACCTACACCTCAG'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1930 | NM_005188.3(CBL): c.1201T > C (p.Cys401Arg) | 867 | CBL | ['GATTGAGCCCTGTGGACACCTCATGYGCAC ATCCTGTCTTACATCCTGGCA'] |
| 1931 | NM_002834.3(PTPN11): c.211T > C (p.Phe71Leu) | 5781 | PTPN11 | ['CTATGACCTGTATGGAGGGGAGAAABTTGC CACTTTGGCTGAGTTGGTCCA'] |
| 1932 | NM_002834.3(PTPN11): c.853T > C (p.Phe285Leu) | 5781 | PTPN11 | ['AAATAGATATAAAAACATCCTGCCCBGTAA GTATCAATATTCCGCTCAGTA'] |
| 1933 | NM_002880.3(RAF1): c.769T > C (p.Ser257Pro) | 5894 | RAF1 | ['AGGTTCCCTCTCCCAGAGGCAGAGGYCGAC ATCCACACCTAATGTCCACAT'] |
| 1934 | NM_002880.3(RAF1): c.1423T > C (p.Phe475Leu) | 5894 | RAF1 | ['AGTCCTTAACAAGCATTGAGATATAYTTCTC CATGAAGGCTTAACAGTGAA'] |
| 1935 | NM_005633.3(SOS1): c.806T > C (p.Met269Thr) | 6654 | SOS1 | ['GGCCATATAGAAGATACAGTAGAAABGACA GATGAAGGCAGTCCCCATCCA'] |
| 1936 | NM_005633.3(SOS1): c.1649T > C (p.Leu550Pro) | 6654 | SOS1 | ['ATATCTTTACAGTACCGGAGTACACYGGAA AGGATGCTTGATGTAACAATG'] |
| 1937 | NM_005633.3(SOS1): c.2104T > C (p.Tyr702His) | 6654 | SOS1 | ['TCGGCACTGGGTAGAGCACCACTTCYATGAT TTTGAAAGAGATGCATATCT'] |
| 1938 | NM_002755.3(MAP2K1): c.388T > C (p.Tyr130His) | 5604 | MAP2K1 | ['CAACTCTCCGTACATCGTGGGCTTCYATGGT GCGTTCTACAGCGATGGCGA'] |
| 1939 | NC_012920.1: m.7505T > C | 4574 | MT-TS1 | ['TTTCAAGCCAACCCCATGGCCTCCAYGACTT TTTCAAAAAGGTATTAGAAA'] |
| 1940 | NM_000084.4(CLCN5): c.674T > C (p.Leu225Pro) | 1184 | CLCN5 | ['GTGGCTTGCTGCTGTGGGAACATCCYGTGCC ACTGCTTCAACAAATACAGG'] |
| 1941 | NM_000530.6(MPZ): c.89T > C (p.Ile30Thr) | 4359 | MPZ | ['GCAGTGCTGTCCCCGGCCCAGGCCAYCGTG GTTTACACCGACAGGGAGGTC'] |
| 1942 | NM_000530.6(MPZ): c.244T > C (p.Tyr82His) | 4359 | MPZ | ['CCCTCATTCCTCATAGATCTTCCACYATGCC AAGGGACAACCCTACATTGA'] |
| 1943 | NM_000530.6(MPZ): c.266T > C (p.Ile89Thr) | 4359 | MPZ | ['CACTATGCCAAGGGACAACCCTACAHTGAC GAGGTGGGGACCTTCAAAGAG'] |
| 1944 | NM_000748.2(CHRNB2): c.923T > C (p.Val308Ala) | 1141 | CHRNB2 | ['TACCTCATGTTCACCATGGTGCTTGYCACCT TCTCCATCGTCACCAGCGTG'] |
| 1945 | NM_003611.2(OFD1): c.111 + 2T > C | 8481 | OFD1 | ['CGGGGTATACTGGATACACTCAAGGYATCG GATTTAGGCGTATCTGTGTCA'] |
| 1946 | NM_003611.2(OFD1): c.274T > C (p.Ser92Pro) | 8481 | OFD1 | MAGATGTGGCTATGAATATTCACTTYCTGTT TTCTTTCCAGAAAGTGGTTT'] |
| 1947 | NM_024408.3(NOTCH2): c.1117T > C (p.Cys373Arg) | 4853 | NOTCH2 | ['GCCCCACCCTGTGCAGGTCTCCTGYGTCAT CTGGATGATGCATGCATCAG'] |
| 1948 | NM_024408.3(NOTCH2): c.1438T > C (p.Cys480Arg) | 4853 | NOTCH2 | ['TCTGGATAAGATTGGAGGCTTCACAYGTCTG TGCATGCCAGGTAAATGGGC'] |
| 1949 | NM_000540.2(RYR1): c.9242T > C (p.Met3081Thr) | 6261 | RYR1 | ['CCCCGCTGCCCTTCTAGGACAGTGAYGAAGT CAGGCCCTGAGATCGTGAAG'] |
| 1950 | NM_000096.3(CP): c.650T > C (p.Phe217Ser) | 1356 | CP | ['AAAGAAAAACATATTGACCGAGAATYTGTG GTGATGTTTTCTGTGGTGGAT'] |
| 1951 | NM_000096.3(CP): c.548T > C (p.Ile183Thr) | 1356 | CP | ['GTGACTAGGATTTACCATTCCCACABTGATG CTCCAAAAGATATTGCCTCA'] |
| 1952 | NM_000540.2(RYR1): c.1205T > C (p.Met402Thr) | 6261 | RYR1 | ['CAGGAGGAGTCCCAGGCCGCCCGCAYGATC CACAGCACCAATGGCCTATAC'] |
| 1953 | NM_006517.4(SLC16A2): c.1253T > C (p.Leu418Pro) | 6567 | SLC16A2 | ['TTCGGGGGCCTTATCGTCGTCTGTCYTTTCCT GGGCCTTTGCGATGGCTTC'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1954 | NM_000096.3(CP): c.1123T > C (p.Tyr375His) | 1356 | CP | ['CCGTGGGAAGCATGTTAGACACTACYACAT TGCCGCTGAGGAAATCATCTG'] |
| 1955 | NM_002739.3(PRKCG): c.391T > C (p.Cys131Arg) | 5582 | PRKCG | ['CGGGCTTGTGCACCAGGGCATGAAAHGCTC CTGTGAGTGACCTGGGCCTTG'] |
| 1956 | NM_000116.4(TAZ): c.310T > C (p.Phe104Leu) | 6901 | TAZ | ['GACCCCTGCAGCTGCAGACATCTGCYTCACC AAGGAGCTACACTCCCACTT'] |
| 1957 | NM_000138.4(FBN1): c.2341T > C (p.Cys781Arg) | 2200 | FBN1 | ['CAGTCTCCTTTGTGACAATGGACAAYGTAGA AATACTCCTGGAAGTTTTGT'] |
| 1958 | NM_000138.4(FBN1): c.4222T > C (p.Cys1408Arg) | 2200 | FBN1 | ['CTTTCTGGCTGTAGACCTTGATGAGYGCTCT GAGAACCTGAATCTCTGTGG'] |
| 1959 | NM_000256.3(MYBPC3): c.1351 + 2T > C | 4607 | MYBPC3 | ['GTAGCACGGAGCTCTTTGTGAAAGGYGGGC CTGGGACCTGAGGATGTGGGA'] |
| 1960 | NM_000256.3(MYBPC3): c.3392T > C (p.Ile1131Thr) | 4607 | MYBPC3 | ['GACGCGGAAGTAGTAGCCATTGCCARTGAT GAGCTCTGGCACCACGCAGTG'] |
| 1961 | NM_000256.3(MYBPC3): c.821 + 2T > C | 4607 | MYBPC3 | ['CCTCCTATCAGCCTTCCGCCGCACGYGAGTG GCCATCCTCAGGGCCTGGGG'] |
| 1962 | NM_000257.3(MYH7): c.1370T > C (p.Ile457Thr) | 4625 | MYH7 | ['ACCAAGCAGCCACGCCAGTACTTCAYAGGA GTCCTGGACATCGCTGGCTTC'] |
| 1963 | NM_000257.3(MYH7): c.2093T > C (p.Val698Ala) | 4625 | MYH7 | ['ATGCACCAGCTGCGCTGCAATGGTGYGCTG GAGGGCATCCGCATCTGCAGG'] |
| 1964 | NM_000257.3(MYH7): c.2546T > C (p.Met849Thr) | 4625 | MYH7 | ['AAGAGTGCAGAAAGAGAGAAGGAGAYGGC CTCCATGAAGGAGGAGTTCACA'] |
| 1965 | NM_000257.3(MYH7): c.2555T > C (p.Met852Thr) | 4625 | MYH7 | ['GAAAGAGAGAAGGAGATGGCCTCCAHGAA GGAGGAGTTCACACGCCTCAAA'] |
| 1966 | NM_000257.3(MYH7): c.602T > C (p.Ile201Thr) | 4625 | MYH7 | ['CAGTACTTTGCTGTTATTGCAGCCAYTGGGG ACCGCAGCAAGAAGGACCAG'] |
| 1967 | NM_000257.3(MYH7): c.788T > C (p.Ile263Thr) | 4625 | MYH7 | ['ACAGGAAAGTTGGCATCTGCAGACAYAGAG ACCTGTGAGTGCCATGAATCT'] |
| 1968 | NM_000260.3(MYO7A): c.5573T > C (p.Leu1858Pro) | 4647 | MYO7A | ['CTCCTGCCCCACGTGCAGCGCTTCCYGCAGT CCCGAAAGCACTGCCCACTC'] |
| 1969 | NM_000441.1(SLC26A4): c.164 + 2T > C | 5172 | SLC26A4 | ['GGAGAGCCTGGCCAAGTGCTGCAGGYAGCG GCCGCGCGGGCCTGCGTAGAG'] |
| 1970 | NM_000441.1(SLC26A4): c.2T > C (p.Met1Thr) | −1 | — | ['TCGCTGTCCTCTGGCTCGCAGGTCABGGCAG CGCCAGGCGGCAGGTCGGAG'] |
| 1971 | NM_000441.1(SLC26A4): c.765 + 2T > C | 5172 | SLC26A4 | ['AATGGAGTTCTCTCTATTATCTATGYAAGTG TTGCTTCTTGCTCCAGGGAT'] |
| 1972 | NM_000551.3(VHL): c.497T > C (p.Val166Ala) | 7428 | VHL | ['CTGAAAGAGCGATGCCTCCAGGTTGYCCGG AGCCTAGTCAAGCCTGAGAAT'] |
| 1973 | NM_001399.4(EDA): c.2T > C (p.Met1Thr) | 1896 | EDA | ['AGAGAGTGGGTGTCTCCGGAGGCCAYGGGC TACCCGGAGGTGGAGCGCAGG'] |
| 1974 | NM_001943.3(DSG2): c.523 + 2T > C | 1829 | DSG2 | ['CTGTTGAAGAGTTGAGTGCAGCACGYAAGA GTCTTTTTTTTTTTTTTAAT'] |
| 1975 | NM_004572.3(PKP2): c.2062T > C (p.Ser688Pro) | 5318 | PKP2 | ['TTGCGGACACTTTTGGCGATCAAGGRCAGAT ACATCCTTATAACAATGGAA'] |
| 1976 | NM_005633.3(SOS1): c.1310T > C (p.Ile437Thr) | 6654 | SOS1 | ['ATTGATGGTTGGGAGGGAAAAGACABTGGA CAGTGTTGTAATGAATTTATA'] |
| 1977 | NM_170707.3(LMNA): c.799T > C (p.Tyr267His) | 4000 | LMNA | [GTATAAGAAGGAGCTGGAGAAGACTYATTC TGCCAAGGTGCTTGCTCTCGA'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1978 | NM_206933.2(USH2A): c.10561T > C (p.Trp3521Arg) | 7399 | USH2A | ['TCTTGAAGATACAATTGTCTTAAACYGGAGA AAACCTATACAATCAAATGG'] |
| 1979 | NM_206933.2(USH2A): c.1606T > C (p.Cys536Arg) | 7399 | USH2A | ['CGACACAACAAGCCAGCCATATAGAYGCCT CTGCTCCCAGGAGAGCTTCAC'] |
| 1980 | NM_206933.2(USH2A): c.5857 + 2T > C | -1 | — | ['GTCGAGGACGTACAACAGGAGCAGGYAAAT ACTTATCTTCAAATGCATATG'] |
| 1981 | NM_000492.3(CFTR): c.1090T > C (p.Ser364Pro) | 1080 | CFTR | ['CTGGGCTGTACAAACATGGTATGACYCTCTT GGAGCAATAAACAAAATACA'] |
| 1982 | NM_000548.3(TSC2): c.5150T > C (p.Leu1717Pro) | 7249 | TSC2 | ['CCCTTCGTGGCCCGCCAGATGGCCCYGCACG CAAATGTGAGTGGGGGTGGG'] |
| 1983 | NM_000548.3 (TSC2): c.2410T > C (p.Cys804Arg) | 7249 | TSC2 | ['CCTCATCCACCGCTGTGCCAGCCAGYGCGTC GTGGCCTTGTCCATCTGCAG'] |
| 1984 | NM_000548.3(TSC2): c.3106T > C (p.Ser1036Pro) | 7249 | TSC2 | ['GGACATGATGGCTCGATACGTCTTCYCCAAC TTCACGGCTGTCCCGAAGAG'] |
| 1985 | NM_000212.2(ITGB3): c.2231T > C (p.Leu744Pro) | -1 | — | ['GCCGCCCTGCTCATCTGGAAACTCCYCATCA CCATCCACGACCGAAAAGAA'] |
| 1986 | NM_183415.2(UBE3B): c.1741 + 2T > C | 89910 | UBE3B | ['AGATGATCTGGGATGGAATTGTAGGYAAGA GAAAAGGTGTCTGCTGTTGTT'] |
| 1987 | NM_005120.2(MED12): c.3493T > C (p.Ser1165Pro) | 9968 | MED12 | ['CCTTTTAGCTTGTAGTGAACAGGACYCTGAG CCAGGGGCCCGGCTTACCTG'] |
| 1988 | NM_001033053.2(NLRP1): c.230T > C (p.Met77Thr) | 22861 | NLRP1 | ['CTAGCCCTCCATACCTGGGAGCAGAYGGGG CTGAGGTCACTGTGCGCCCAA'] |
| 1989 | NM_025152.2(NUBPL): c.815 - 27T > C | 80224 | NUBPL | ['ATGCCTATATGAACTTTTCTGGTTCYAATGG ATGTCTGCTGGGCTCTTTTA'] |
| 1990 | NM_001288953.1(TTC7A): c.2366T > C (p.Leu789Pro) | 57217 | TTC7A | ['GCGTGGCAGGGCCTGGGCGAGGTGCYGCAG GCCCAGGGCCAGAACGAGGCT'] |
| 1991 | NM_014845.5(FIG4): c.524T > C (p.Leu175Pro) | 9896 | FIG4 | ['TACAGCTATGATTTGTCCCACTCACYTCAAT ATAATCTCACTGTCTTGCGA'] |
| 1992 | NM_000059.3(BRCA2): c.2T > C (p.Met1Thr) | 675 | BRCA2 | ['ATTGGAGGAATATCGTAGGTAAAABGCCT ATTGGATCCAAAGAGAGGCCA'] |
| 1993 | NM_000059.3(BRCA2): c.316 + 2T > C | 675 | BRCA2 | ['TAGATAAATTCAAATTAGACTTAGGYAAGT AATGCAATATGGTAGACTGGG'] |
| 1994 | NM_000059.3(BRCA2): c.67 + 2T > C | 675 | BRCA2 | ['TTAAGACACGCTGCAACAAAGCAGGHATTG ACAAATTTTATATAACTTTAT'] |
| 1995 | NM_000059.3(BRCA2): c.7958T > C (p.Leu2653Pro) | 675 | BRCA2 | ['AGATGCCTAAGCCCAGAAAGGGTGCYTCTT CAACTAAAATACAGGCAAGTT'] |
| 1996 | NM_000218.2(KCNQ1): c.1016T > C (p.Phe339Ser) | 3784 | KCNQ1 | ['TGCTTCTCTGTCTTTGCCATCTCCHCTTTGC GCTCCCAGCGGTAGGTGCC'] |
|  | NM_000218.2(KCNQ1): c.1045T > C (p.Ser349Pro) | 3784 | KCNQ1 | [] |
|  | NM_000218.2(KCNQ1): c.1052T > C (p.Phe351Ser) | 3784 | KCNQ1 | [] |
|  | NM_000218.2(KCNQ1): c.1058T > C (p.Leu353Pro) | 3784 | KCNQ1 | [] |
|  | NM_000218.2(KCNQ1): c.1541T > C (p.Ile514Thr) | 3784 | KCNQ1 | [] |
|  | NM_000218.2(KCNQ1): c.1661T > C (p.Val554Ala) | 3784 | KCNQ1 | [] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 1997 | NM_000218.2(KCNQ1): c.1700T > C (p.Ile567Thr) | 3784 | KCNQ1 | ['CTTCTCTCCAGGCTGGACCAGTCCABTGGGA AGCCCTCACTGTTCATCTCC'] |
| | NM_000218.2(KCNQ1): c.2T > C (p.Met1Thr) | 3784 | KCNQ1 | [] |
| | NM_000218.2(KCNQ1): c.341T > C (p.Leu114Pro) | 3784 | KCNQ1 | [] |
| 1998 | NM_000218.2(KCNQ1): c.560T > C (p.Leu187Pro) | 3784 | KCNQ1 | ['GGCTGCCGCAGCAAGTACGTGGGCCYCTGG GGGCGGCTGCGCTTTGCCCGG'] |
| | NM_000218.2(KCNQ1): c.572T > C (p.Leu191Pro) | 3784 | KCNQ1 | [] |
| | NM_000218.2(KCNQ1): c.716T > C (p.Leu239Pro) | 3784 | KCNQ1 | [] |
| | NM_000218.2(KCNQ1): c.752T > C (p.Leu251Pro) | 3784 | KCNQ1 | [] |
| | NM_000218.2(KCNQ1): c.797T > C (p.Leu266Pro) | 3784 | KCNQ1 | [] |
| | NM_000218.2(KCNQ1): c.824T > C (p.Phe275Ser) | 3784 | KCNQ1 | [] |
| | NM_000218.2(KCNQ1): c.910T > C (p.Trp304Arg) | 3784 | KCNQ1 | [] |
| | NM_000218.2(KCNQ1): c.913T > C (p.Trp305Arg) | 3784 | KCNQ1 | [] |
| 1999 | NM_000492.3(CFTR): c.1021T > C (p.Ser341Pro) | 1080 | CFTR | ['CCTCCGGAAAATATTCACCACCATCYCATTC TGCATTGTTCTGCGCATGGC'] |
| 2000 | NM_000492.3(CFTR): c.1853T > C (p.Ile618Thr) | 1080 | CFTR | ['TTAAAGAAAGCTGACAAAATATTAAYTTTG CATGAAGGTAGCAGCTATTTT'] |
| 2001 | NM_000492.3(CFTR): c.2780T > C (p.Leu927Pro) | 1080 | CFTR | ['TACGTGGGAGTAGCCGACACTTTGCYTGCTA TGGGATTCTTCAGAGGTCTA'] |
| 2002 | NM_000492.3(CFTR): c.3230T > C (p.Leu1077Pro) | 1080 | CFTR | ['GGACGGCAGCCTTACTTTGAAACTCYGTTCC ACAAAGCTCTGAATTTACAT'] |
| 2003 | NM_007294.3(BRCA1): c.115T > C (p.Cys39Arg) | 672 | BRCA1 | ['GATCAAGGAACCTGTCTCCACAAAGNGTGA CCACATATTTTGCAAGTAAGT'] |
| 2004 | NM_007294.3(BRCA1): c.190T > C (p.Cys64Arg) | 672 | BRCA1 | ['GAAAGGGCCTTCACAGTGTCCTTTABGTAAG AATGATATAACCAAAAGGTA'] |
| 2005 | NM_007294.3(BRCA1): c.212 + 2T > C | 672 | BRCA1 | ['ATGTAAGAATGATATAACCAAAAGGYATAT AATTTGGTAATGATGCTAGGT'] |
| 2006 | NM_007294.3(BRCA1): c.2T > C (p.Met1Thr) | 672 | BRCA1 | ['TAAAGTTCATTGGAACAGAAAGAAABGGAT TTATCTGCTCTTCGCGTTGAA'] |
| 2007 | NM_007294.3(BRCA1): c.4357 + 2T > C | 672 | BRCA1 | ['CAGAACAAAGCACATCAGAAAAAGGBGTGT ATTGTTGGCCAAACACTGATA'] |
| 2008 | NM_007294.3 (BRCA1): c.5291T > C (p.Leu1764Pro) | 672 | BRCA1 | ['CTCTTCTTCCAGATCTTCAGGGGGCYAGAAA TCTGTTGCTATGGGCCCTTC'] |
| 2009 | NM_007294.3(BRCA1): c.65T > C (p.Leu22Ser) | 672 | BRCA1 | ['GTCATTAATGCTATGCAGAAAATCTYAGAGT GTCCCATCTGGTAAGTCAGC'] |
| 2010 | NM_005236.2(ERCC4): c.689T > C (p.Leu230Pro) | 2072 | ERCC4 | ['ATGCTTGCTATACAGACTGCTATACYGGACA TTTTAAATGCATGTCTAAAG'] |
| 2011 | NM_005236.2(ERCC4): c.706T > C (p.Cys236Arg) | 2072 | ERCC4 | ['TGCTATACTGGACATTTTAAATGCAYGTCTA AAGGAACTAAAATGCCATAA'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 2012 | NM_000435.2(NOTCH3): c.4556T > C (p.Leu1519Pro) | 4854 | NOTCH3 | ['GGCGTGCTGGTGCTCACAGTGCTGCYGCCGC CAGAGGAGCTACTGCGTTCC'] |
| 2013 | NM_153704.5(TMEM67): c.1046T > C (p.Leu349Ser) | 91147 | TMEM67 | ['GGAAATTTTCTCAAGTGGCAAACTTYAGAA GGAGGTGTTTTACAGGTAAGC'] |
| 2014 | NM_001142519.1(FAM111A): c.1531T > C (p.Tyr511His) | 63901 | FAM111A | ['GTCTAAAAAGCAGAAAGTCCAGAGYATGT CCATATGTATACTCAAAGAAG'] |
| 2015 | NM_014795.3(ZEB2): c.3211T > C (p.Ser1071Pro) | 9839 | ZEB2 | ['GCGCTTCTCACACTCGGGCTCGTACYCGCAG CACATGAATCACAGGTATTC'] |
| 2016 | NM_001199107.1(TBC1D24): c.686T > C (p.Phe229Ser) | 57465 | TBC1D24 | ['CCCCTCTGCTACTTCGCCCGGGTCTYTGACG TCTTCCTGGTGGAGGGCTAC'] |
| 2017 | NM_022114.3 (PRDM16): c.2660T > C (p.Leu887Pro) | 63976 | PRDM16 | ['GTGGGAGCCCTGAAGGAGAAGTACCYGCGG CCGTCCCCGCTGCTCTTCCAC'] |
| 2018 | NM_001130089.1(KARS): c.517T > C (p.Tyr173His) | 3735 | KARS | ['AGCTTCTGGGGGAAAGCTCATCTTCYATGAT CTTCGAGGAGAGGGGGTGAA'] |
| 2019 | NM_005689.2(ABCB6): c.1067T > C (p.Leu356Pro) | 10058 | ABCB6 | ['CTCATCTTCTCCCACCTGCACGAGCYCTCAC TGCGCTGGCACCTGGGGCGC'] |
| 2020 | NM_001070.4(TUBG1): c.1160T > C (p.Leu387Pro) | 7283 | TUBG1 | ['CCCCTGTTTTCTGCACACCCCAAGCYCTTCG AGAGAACCTGTCGCCAGTAT'] |
| 2021 | NM_001283009.1(RTEL1): c.3730T > C (p.Cys1244Arg) | -1 | — | ['CGGGCCCCTCTCAGCAGGCTGTGTGYGCCA GGGCTGTGGGGCAGAGGACGT'] |
| 2022 | NM_001135021.1(ELMOD3): c.794T > C (p.Leu265Ser) | 84173 | ELMOD3 | ['ATCACCCACATTGCCATCCAGGCCTYGAGA GAGGAGTGTCTCTCCAGGTGA'] |
| 2023 | NM_001382.3 (DPAGT1): c.503T > C (p.Leu168Pro) | 1798 | DPAGT1 | ['CTACCATCTCTCCCCGCAGGAATCCYGTACT ATGTCTACATGGGCTGCTG'] |
| 2024 | m.10237T > C | 4537 | MT-ND3 | ['CCATAAAATTCTTCTTAGTAGCTATYACCTT CTTATTATTTGATCTAGAAA'] |
| 2025 | m.11253T > C | 4538 | MT-ND4 | ['TCCCTTCCCCTACTCATCGCACTAAYTTACA CTCACAACACCCTAGGCTCA'] |
| 2026 | m.12811T > C | 4540 | MT-ND5 | ['ATCCTTCTTGCTCATCAGTTGATGAYACGCC CGAGCAGATGCCAACACAGC'] |
| 2027 | m.14325T > C | 4541 | MT-ND6 | ['ATTCAGCTTCCTACACTATTAAAGTYTACCA CAACCACCACCCCATCATAC'] |
| 2028 | NM_000142.4(FGFR3): c.2419T > C (p.Ter807Arg) | 2261 | FGFR3 | ['ACCCAGCAGTGGGGGCTCGCGGACGNGAAG GGCCACTGGTCCCCAACAATG'] |
| 2029 | NM_000370.3 (TTPA): c.548T > C (p.Leu183Pro) | 7274 | TTPA | ['GTAGCCAAGAAGATTGCTGCTGTACYTACG GTAAATGTATATTTTAACTGT'] |
| 2030 | NM_000375.2(UROS): c.139T > C (p.Ser47Pro) | 7390 | UROS | ['TGAGTTTTTGTCTCTTCCCAGTTTCYCTGAGA AGGTAAGGCCTGTTGTGAC'] |
| 2031 | NM_001006657.1(WDR35): c.1592T > C (p.Leu531Pro) | 57539 | WDR35 | ['TCTGGCACCATTCAGAGATACAGTCYACCTA ATGTTGGTTTGATTCAAAAA'] |
| 2032 | NM_001876.3 (CPT1A): c.1451T > C (p.Leu484Pro) | 1374 | CPT1A | ['GCAGATGCGCCGATCGTGGCCCACCYTTGG GAGGTGAGTTTTCACACTTTT'] |
| 2033 | NM_004595.4(SMS): c.449T > C (p.Ile150Thr) | 6611 | SMS | ['GACGAAGATTCACCTTATCAAAATAYAAAA ATTCTACACTCGAAGCAGTTT'] |
| 2034 | NM_005211.3 (CSF1R): c.2483T > C (p.Phe828Ser) | 1436 | CSF1R | ['AAGTGGATGGCCCCAGAGAGCATCTYTGAC TGTGTCTACACGGTTCAGAGC'] |
| 2035 | NM_170707.3 (LMNA): c.644T > C (p.Leu215Pro) | 4000 | LMNA | ['TCCTTCCTCCAACCCTTCCAGGAGCYGCGTG AGACCAAGCGCCGTCATGAG'] |

TABLE 6-continued

Diseases/disorders containging T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 2036 | NM_194248.2(OTOF): c.3413T > C (p.Leu1138Pro) | 9381 | OTOF | ['CCACCCTCCAACCTCTCCCAGGTGCYGTTCT GGGGCCTACGGGACCTAAAG'] |
| 2037 | NM_000540.2(RYR1): c.14762T > C (p.Phe4921Ser) | 6261 | RYR1 | [TACAGGGTGGTCTTCGACATCACCTYCTTCT TCTTCGTCATCGTCATCCTG'] |
| 2038 | NM_000540.2(RYR1): c.7358T > C (p.Ile2453Thr) | 6261 | RYR1 | ['GCCGGCAAGGGTGAGGCCCTGCGGAYCCGC GCCATCCTCCGCTCCCTTGTG'] |
| 2039 | NM_000540.2(RYR1): c.10817T > C (p.Leu3606Pro) | 6261 | RYR1 | ['GAAGTGTCAGCCGTGCTCTACTACCYGGACC AGGTGGGTGGGGCCGGAGGG'] |
| 2040 | NM_000540.2(RYR1): c.13703T > C (p.Leu4568Pro) | 6261 | RYR1 | ['TTTTACACCCTGCGGTTCCTTGCCCYCTTCT GGCATTTGCCATCAACTTC'] |
| 2041 | NM_000540.2(RYR1): c.13949T > C (p.Leu4650Pro) | 6261 | RYR1 | ['CCCGCCCTGCGGTGTCTGAGCCTCCYGCATA CACTGGTGGCCTTTCTCTGC'] |
| 2042 | NM_000540.2(RYR1): c.14378T > C (p.Leu4793Pro) | 6261 | RYR1 | ['GTGTGCCCACAGTCCTTCCTGTACCYGGGCT GGTATATGGTGATGTCCCTC'] |
| 2043 | NM_015896.3(ZMYND10): c.797T > C (p.Leu266Pro) | 51364 | ZMYND10 | ['CTCAGGGCTTAGCAGCAGGTTGTACRGGGC GATCCACACTTGCCCGTCCAA'] |
| 2044 | NM_018127.6(ELAC2): c.460T > C (p.Phe154Leu) | 60528 | ELAC2 | ['AAAATACCTCGAAGCAATCAAAATAYTTTCT GGTCCATTGAAAGGAATAGA'] |
| 2045 | NM_199355.2(ADAMTS18): c.605T > C (p.Leu202Pro) | 170692 | ADAMTS18 | ['CCTGCGGGTCACCATCCTCACGTACYGTACA AAAGGACAGCAGAGGAGAAG] |
| 2046 | NM_023110.2(FGFR1): c.494T > C (p.Leu165Ser) | 2260 | FGFR1 | ['TCCCCAGAAAAGATGGAAAAGAAATYGCAT GCAGTGCCGGCTGCCAAGACA'] |
| 2047 | NM_001059.2(TACR3): c.766T > C (p.Tyr256His) | 6870 | TACR3 | ['CCATATTATCGTCATTATACTGGTGYACTGT TTCCCATTGCTCATCATGGG'] |
| 2048 | NM_002055.4(GFAP): c.1070T > C (p.Leu357Pro) | 2670 | GFAP | ['TACCAGGACCTGCTCAATGTCAAGCHGGCC CTGGACATCGAGATCGCCACC'] |
| 2049 | NM_002055.4(GFAP): c.1076T > C (p.Leu359Pro) | 2670 | GFAP | ['GACCTGCTCAATGTCAAGCTGGCCCYGGAC ATCGAGATCGCCACCTACAGG'] |
| 2050 | NM_002055.4(GFAP): c.1096T > C (p.Tyr366His) | 2670 | GFAP | ['GGCCCTGGACATCGAGATCGCCACCYACAG GAAGCTGCTAGAGGGCGAGGA'] |
| 2051 | NM_002055.4(GFAP): c.221T > C (p.Met74Thr) | 2670 | GFAP | ['CGGGCCAGTGAGCGGGCAGAGATGAYGGAG CTCAATGACCGCTTTGCCAGC] |
| 2052 | NM_002055.4(GFAP): c.247T > C (p.Tyr83His) | 2670 | GFAP | ['GGAGCTCAATGACCGCTTTGCCAGCYACATC GAGAAGGTTCGCTTCCTGGA'] |
| 2053 | NM_002055.4(GFAP): c.269T > C (p.Leu90Pro) | 2670 | GFAP | ['AGCTACATCGAGAAGGTTCGCTTCCYGGAA CAGCAAAACAAGGCGCTGGCT'] |
| 2054 | NM_002055.4(GFAP): c.290T > C (p.Leu97Pro) | 2670 | GFAP | ['TTCCTGGAACAGCAAAACAAGGCGCYGGCT GCTGAGCTGAACCAGCTGCGG'] |
| 2055 | NM_002055.4(GFAP): c.302T > C (p.Leu101Pro) | 2670 | GFAP | ['CAAAACAAGGCGCTGGCTGCTGAGCYGAAC CAGCTGCGGGCCAAGGAGCCC'] |
| 2056 | NM_002055.4(GFAP): c.704T > C (p.Leu235Pro) | 2670 | GFAP | ['GCCAAGCCAGACCTCACCGCAGCCCYGAAA GAGATCCGCACGCAGTATGAG'] |
| 2057 | NM_002055.4(GFAP): c.739T > C (p.Ser247Pro) | 2670 | GFAP | ['CCGCACGCAGTATGAGGCAATGGCGYCCAG CAACATGCATGAAGCCGAAGA'] |
| 2058 | NM_002055.4(GFAP): c.992T > C (p.Leu331Pro) | 2670 | GFAP | ['AGTTATCAGGAGGCGCTGGCGCGGCYGGAG GAAGAGGGGCAGAGCCTCAAG'] |
| 2059 | NM_005554.3(KRT6A): c.1406T > C (p.Leu469Pro) | 3853 | KRT6A | ['GAGATCGCCACCTACCGCAAGCTGCBGGAG GGTGAGGAGTGCAGGTGGGTA'] |

TABLE 6-continued

Diseases/disorders containging T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 2060 | NM_005554.3(KRT6A): c.521T > C (p.Phe174Ser) | 3853 | KRT6A | ['CAGATCAAGACCCTCAACAACAAGTBTGCC TCCTTCATCGACAAGGTGAGC'] |
| 2061 | NM_153490.2(KRT13): c.332T > C (p.Leu111Pro) | 3860 | KRT13 | ['AATGAGAAGATCACCATGCAGAACCYCAAC GACCGCCTGGCTTCCTACCTG'] |
| 2062 | NM_170707.3(LMNA): c.1619T > C (p.Met540Thr) | 4000 | LMNA | ['CCATGTCCCCACCAGGAAGTGGCCAYGCGC AAGCTGGTGCGCTCAGTGACT'] |
|  | NM_000218.2(KCNQ1): c.1117T > C (p.Ser373Pro) | 3784 | KCNQ1 | [] |
| 2063 | NM_000218.2(KCNQ1): c.1135T > C (p.Trp379Arg) | 3784 | KCNQ1 | ['TCCCCCTGCCCGACCTCAGACCGCABGGAG GTGCTATGCTGCCGAGAACCC'] |
|  | NM_000218.2(KCNQ1): c.1165T > C (p.Ser389Pro) | 3784 | KCNQ1 | [] |
|  | NM_000218.2(KCNQ1): c.1174T > C (p.Trp392Arg) | 3784 | KCNQ1 | [] |
|  | NM_000218.2(KCNQ1): c.1550T > C (p.Ile517Thr) | 3784 | KCNQ1 | [] |
|  | NM_000218.2(KCNQ1): c.1696T > C (p.Ser566Pro) | 3784 | KCNQ1 | [] |
|  | NM_000218.2(KCNQ1): c.1805T > C (p.Leu602Pro) | -1 | — | [] |
|  | NM_000218.2(KCNQ1): c.401T > C (p.Leu134Pro) | 3784 | KCNQ1 | [] |
| 2064 | NM_000218.2(KCNQ1): c.550T > C (p.Tyr184His) | 3784 | KCNQ1 | ['CTGGTCCGCCGGCTGCCGCAGCAAGBACGT GGGCCTCTGGGGCGGCTGCG'] |
|  | NM_000218.2(KCNQ1): c.608T > C (p.Leu203Pro) | 3784 | KCNQ1 | [] |
|  | NM_000218.2(KCNQ1): c.625T > C (p.Ser209Pro) | 3784 | KCNQ1 | [] |
|  | NM_000218.2(KCNQ1): c.742T > C (p.Trp248Arg) | 3784 | KCNQ1 | [] |
| 2065 | NM_000218.2(KCNQ1): c.749T > C (p.Leu250Pro) | 3784 | KCNQ1 | ['GACCGCCAGGGAGGCACCTGGAGGCHCCTG GGCTCCGTGGTCTTCATCCAC'] |
|  | NM_000218.2(KCNQ1): c.829T > C (p.Ser277Pro) | 3784 | KCNQ1 | [] |
|  | NM_000218.2(KCNQ1): c.832T > C (p.Tyr278His) | 3784 | KCNQ1 | [] |
|  | NM_000218.2(KCNQ1): c.845T > C (p.Leu282Pro) | 3784 | KCNQ1 | [] |
|  | NM_000218.2(KCNQ1): c.908T > C (p.Leu303Pro) | 3784 | KCNQ1 | [] |
| 2066 | NM_000238.3(KCNH2): c.122T > C (p.Val41Ala) | 3757 | KCNH2 | ['AACGCTCGGGTGGAGAACTGCGCCGBCATC TACTGCAACGACGGCTTCTGC'] |
|  | NM_000238.3(KCNH2): c.1238T > C (p.Leu413Pro) | 3757 | KCNH2 | [] |
|  | NM_000238.3(KCNH2): c.1279T > C (p.Tyr427His) | 3757 | KCNH2 | [] |
|  | NM_000238.3 (KCNH2): c.1387T > C (p.Phe463Leu) | 3757 | KCNH2 | [] |
|  | NM_000238.3 (KCNH2): c.160T > C (p.Tyr54His) | 3757 | KCNH2 | [] |
| 2067 | NM_000238.3 (KCNH2): c.1655T > C (p.Leu552Ser) | 3757 | KCNH2 | ['GAGTACGGCGCGGCCGTGCTGTTCTYGCTCA TGTGCACCTTTGCGCTCATC'] |
|  | NM_000238.3 (KCNH2): c.1691T > C (p.Leu564Pro) | 3757 | KCNH2 | [] |
|  | NM_000238.3 (KCNH2): c.1700T > C (p.Ile567Thr) | 3757 | KCNH2 | [] |
|  | NM_000238.3 (KCNH2): c.1702T > C (p.Trp568Arg) | 3757 | KCNH2 | [] |
|  | NM_000238.3 (KCNH2): c.1705T > C (p.Tyr569His) | 3757 | KCNH2 | [] |
|  | NM_000238.3 (KCNH2): c.1736T > C (p.Met579Thr) | 3757 | KCNH2 | [] |

TABLE 6-continued

Diseases/disorders containging T to C Changes.The table includes human gene mutations that may be corrected by changing a cytosine (C) to a thymine (T). The gene name, gene symbol,and Gene ID are indicated.

| SEQ ID NO: | Name | Gene ID | Gene Symbol | Flanks |
|---|---|---|---|---|
| 2068 | NM_000238.3 (KCNH2): c.1778T > C (p.Ile593Thr) | 3757 | KCNH2 | ['TGGCTGCACAACCTGGGCGACCAGANAGGC AAACCCTACAACAGCAGCGGC'] |
|  | NM_000238.3 (KCNH2): c.1816T > C (p.Ser606Pro) | 3757 | KCNH2 | [] |
| 2069 | NM_000238.3 (KCNH2): c.1879T > C (p.Phe627Leu) | 3757 | KCNH2 | ['CTTCAGCAGCCTCACCAGTGTGGGCHTCGGC AACGTCTCTCCCAACACCAM |
|  | NM_000238.3 (KCNH2): c.1889T > C (p.Val630Ala) | 3757 | KCNH2 | [] |
|  | NM_000238.3 (KCNH2): c.1945T > C (p.Ser649Pro) | 3757 | KCNH2 | [] |
|  | NM_000238.3 (KCNH2): c.1985T > C (p.Ile662Thr) | 3757 | KCNH2 | [] |
|  | NM_000238.3 (KCNH2): c.202T > C (p.Phe68Leu) | 3757 | KCNH2 | [] |
|  | NM_000238.3(KCNH2): c.2033T > C (p.Leu678Pro) | 3757 | KCNH2 | [] |
|  | NM_000238.3 (KCNH2): c.206T > C (p.Leu69Pro) | 3757 | KCNH2 | [] |
|  | NM_000238.3 (KCNH2): c.2078T > C (p.Leu693Pro) | 3757 | KCNH2 | [] |
|  | NM_000238.3 (KCNH2): c.2309T > C (p.Val770Ala) | 3757 | KCNH2 | [] |
| 2070 | NM_000238.3 (KCNH2): c.2414T > C (p.Phe805Ser) | 3757 | KCNH2 | ['TGGCCTCCAGGGAAGAATGACATCTBTGGG GAGCCTCTGAACCTGTATGCA'] |
|  | NM_000238.3 (KCNH2): c.2452T > C (p.Ser818Pro) | 3757 | KCNH2 | [] |
|  | NM_000238.3 (KCNH2): c.2573T > C (p.Ile858Thr) | 3757 | KCNH2 | [] |
| 2071 | NM_000238.3 (KCNH2): c.257T > C (p.Leu86Pro) | 3757 | KCNH2 | ['GCTGCCGCGCAGATCGCGCAGGCACBGCTG GGCGCCGAGGAGCGCAAAGTG'] |
|  | NM_000238.3(KCNH2): c.260T > C (p.Leu87Pro) | 3757 | KCNH2 | [] |
|  | NM_000238.3 (KCNH2): c.287T > C (p.Ile96Thr) | 3757 | KCNH2 | [] |
|  | NM_000238.3(KCNH2): c.3146T> C (p.Leu1049Pro) | 3757 | KCNH2 | [] |
|  | NM_000238.3 (KCNH2): c.322T > C (p.Cys108Arg) | 3757 | KCNH2 | [] |
| 2072 | NM_000238.3 (KCNH2): c.371T > C (p.Met124Thr) | 3757 | KCNH2 | ['AAGAACGAGGATGGGGCTGTCATCABGTTC ATCCTCAATTTCGAGGTGGTG'] |
|  | NM_000238.3 (KCNH2): c.65T > C (p.Phe22Ser) | 3757 | KCNH2 | [] |
|  | NM_000238.3 (KCNH2): c.86T > C (p.Phe29Ser) | 3757 | KCNH2 | [] |
|  | NM_000238.3 (KCNH2): c.872T > C (p.Met291Thr) | 3757 | KCNH2 | [] |
|  | NM_000238.3 (KCNH2): c.89T > C (p.Ile30Thr) | 3757 | KCNH2 | [] |
| 2073 | NM_000238.3 (KCNH2): c.92T > C (p.Ile31Thr) | 3757 | KCNH2 | ['GCCCCCCTAGGCCGTAAGTTCATCABCGCCA ACGCTCGGGTGGAGAACTGC'] |
|  | NM_000891.2(KCNJ2): c.301T > C (p.Cys101Arg) | 3759 | KCNJ2 | [] |
|  | NM_000891.2(KCNJ2): c.650T > C (p.Leu217Pro) | 3759 | KCNJ2 | [] |
|  | NM_000335.4(SCN5A): c.1187T > C (p.Val396Ala) | 6331 | SCN5A | [] |
|  | NM_000335.4(SCN5A): c.1190T > C (p.Ile397Thr) | 6331 | SCN5A | [] |
|  | NM_000335.4(SCN5A): c.2018T > C (p.Leu673Pro) | 6331 | SCN5A | [] |
|  | NM_000335.4(SCN5A): c.2516T > C (p.Leu839Pro) | 6331 | SCN5A | [] |
|  | NM_000335.4(SCN5A): c.2551T > C (p.Phe851Leu) | 6331 | SCN5A | [] |
|  | NM_000335.4(SCN5A): c.2743T > C (p.Cys915Arg) | 6331 | SCN5A | [] |

TABLE 6-continued

Diseases/disorders containging T to C Changes.The table includes human gene mutations that may be corrected by changing a cytosine (C) to a thymine (T). The gene name, gene symbol,and Gene ID are indicated.

| SEQ ID NO: | Name | Gene ID | Gene Symbol | Flanks |
|---|---|---|---|---|
| | NM_000335.4(SCN5A): c.2783T > C (p.Leu928Pro) | 6331 | SCN5A | [] |
| | NM_000335.4(SCN5A): c.278T > C (p.Phe93Ser) | 6331 | SCN5A | [] |
| | NM_000335.4(SCN5A): c.2804T > C (p.Leu935Pro) | 6331 | SCN5A | [] |
| 2074 | NM_000335.4(SCN5A): c.2944T > C (p.Cys982Arg) | 6331 | SCN5A | ['CAAGCGGACCACCTGGGATTTCTGCYGTGGT CTCCTGCGGCAGCGGCCTCA'] |
| 2075 | NM_198056.2(SCN5A): c.3010T > C (p.Cys1004Arg) | 6331 | SCN5A | ['TGCCGCCCAGGGCCAGCTGCCCAGCYGCAT TGCCACCCCTACTCCCCGCC'] |
| 2076 | NM_000335.4(SCN5A): c.3679T > C (p.Tyr1227His) | 6331 | SCN5A | ['TTGTCTGCAGGCCTTCGAGGACATCYACCTA GAGGAGCGGAAGACCATCAA'] |
| | NM_000335.4(SCN5A): c.3713T > C (p.Leu1238Pro) | 6331 | SCN5A | |
| 2077 | NM_000335.4(SCN5A): c.3745T > C (p.Phe1249Leu) | 6331 | SCN5A | ['TGCCGACAAGATGTTCACATATGTCYTCGTG CTGGAGATGCTGCTCAAGTG'] |
| | NM_000335.4(SCN5A): c.3929T > C (p.Leu1310Pro) | 6331 | SCN5A | [] |
| | NM_000335.4(SCN5A): c.4027T > C (p.Phe1343Leu) | 6331 | SCN5A | [] |
| | NM_000335.4(SCN5A): c.4028T > C (p.Phe1343Ser) | 6331 | SCN5A | [] |
| | NM_000335.4(SCN5A): c.4034T > C (p.Leu1345Pro) | 6331 | SCN5A | [] |
| | NM_000335.4(SCN5A): c.4046T > C (p.Ile1349T1ir) | 6331 | SCN5A | [] |
| | NM_000335.4(SCN5A): c.407T > C (p.Leu136Pro) | 6331 | SCN5A | [] |
| | NM_000335.4(SCN5A): c.4340T > C (p.Ile1447T1ir) | 6331 | SCN5A | [] |
| 2078 | NM_000335.4(SCN5A): c.4415T > C (p.Phe1472Ser) | 6331 | SCN5A | ['TTTATTGGTGTCATCATTGACAACTBCAACC AACAGAAGAAAAAGATACGT'] |
| | NM_000335.4(SCN5A): c.4453T > C (p.Phe1485Leu) | 6331 | SCN5A | [] |
| | NM_198056.2(SCN5A): c.4493T > C (p.Met1498T1ir) | 6331 | SCN5A | [] |
| | NM_000335.4(SCN5A): c.4742T > C (p.Leu1581Pro) | 6331 | SCN5A | [] |
| | NM_000335.4(SCN5A): c.4778T > C (p.Phe1593Ser) | 6331 | SCN5A | [] |
| 2079 | NM_000335.4(SCN5A): c.4952T > C (p.Met1651Thr) | 6331 | SCN5A | ['CGCACGCTGCTCTTTGCCCTCATGABGTCCC TGCCTGCCCTCTTCAACATC'] |
| | NM_000335.4(SCN5A): c.5111T > C (p.Phe1704Ser) | 6331 | SCN5A | [] |
| | NM_000335.4(SCN5A): c.5179T > C (p.Cys1727Arg) | 6331 | SCN5A | [] |
| | NM_000335.4(SCN5A): c.544T > C (p.Cys182Arg) | 6331 | SCN5A | [] |
| 2080 | NM_000335.4(SCN5A): c.5471T > C (p.Leu1824Pro) | 6331 | SCN5A | ['TTTGCCGATGCCCTGTCTGAGCCACYCCGTA TCGCCAAGCCCAACCAGATA'] |
| 2081 | NM_198056.2(SCN5A): c.5624T > C (p.Met1875Thr) | 6331 | SCN5A | ['GAGATGGACGCCCTGAAGATCCAGAHGGAG GAGAAGTTCATGGCAGCCAAC'] |
| 2082 | NM_000335.4(SCN5A): c.635T > C (p.Leu212Pro) | 6331 | SCN5A | ['AGATACACAACTGAATTTGTGGACCHGGGC AATGTCTCAGCCTTACGCACC'] |
| | NM_000335.4(SCN5A): c.689T > C (p.Ile230Thr) | 6331 | SCN5A | [] |
| | NM_198056.2(SCN5A): c.944T > C (p.Leu315Pro) | 6331 | SCN5A | [] |
| 2083 | NM_177976.2(ARL6): c.272T > C (p.Ile91Thr) | 84100 | ARL6 | ['TTACACAGAGAAGGCCAAGCTATTAYTTTTG TCATTGATAGTAGTGATAGA'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 2084 | NM_000487.5(ARSA): c.899T > C (p.Leu300Ser) | 410 | ARSA | ['TCCCGAGGCGGCTGCTCCGGTCTCTYGCGGT GTGGAAAGGGAACGACCTAC'] |
| 2085 | NM_000267.3(NF1): c.1595T > C (p.Leu532Pro) | 4763 | NF1 | ['GAATTAATTACAGGGCTCGTCCAACYGGTCC CTCAGTCACACATGCCAGAG'] |
| 2086 | NM_001042492.2(NF1): c.2288T > C (p.Leu763Pro) | 4763 | NF1 | ['CTTCAGAAAAGAGTGATGGCACTGCBGAGG CGCATTGAGCATCCCACTGCA'] |
| 2087 | NM_004990.3(MARS): c.1108T > C (p.Phe370Leu) | 4141 | MARS | ['CCTCACCAGAATCACCCAGGACATTYTCCAG CAGTTGCTGAAACGAGGTTT'] |
| 2088 | NM_004990.3(MARS): c.1568T > C (p.Ile523Thr) | 4141 | MARS | ['TTCTATGTCTGGTTTGATGCCACTAYTGGCT ATCTGTCCATCACAGCCAAC'] |
| 2089 | NM_006920.4(SCN1A): c.4729T > C (p.Cys1577Arg) | -1 | — | ['GTTCATTGTGCTATTTACTGGAGAGYGTGTA CTGAAACTCATCTCTCTACG'] |
| 2090 | NM_006920.4(SCN1A): c.5113T > C (p.Cys1705Arg) | -1 | — | ['TGAGACCTTTGGCAACAGCATGATCYGCCTA TTCCAAATTACAACCTCTGC'] |
| 2091 | NM_006920.4(SCN1A): c.838T > C (p.Trp280Arg) | 6323 | SCN1A | ['CAACCTGAGGAATAAATGTATACAAYGGCC TCCCACCAATGCTTCCTTGA'] |
| 2092 | NM_006920.4(5CN1A): c.269T > C (p.Phe90Ser) | 6323 | SCN1A | ['TGTTGTGTTCCTGTCTTACAGACTTYTATAGT ATTGAATAAAGGGAAGGCC'] |
| 2093 | NM_006920.4(5CN1A): c.272T > C (p.Ile91Thr) | 6323 | SCN1A | ['TGTGTTCCTGTCTTACAGACTTTTAYAGTATT GAATAAAGGGAAGGCCATC'] |
| 2094 | NM_006920.4(SCN1A): c.3827T > C (p.Leu1276Pro) | -1 | — | ['TATTTCACCAATGCCTGGTGTTGGCYGGACT TCTTAATTGTTGATGTAGGT'] |
| 2095 | NM_006920.4(5CN1A): c.5522T > C (p.Met1841Thr) | -1 | — | ['CCAAACAAACTCCAGCTCATTGCCAYGGATT TGCCCATGGTGAGTGGTGAC'] |
| 2096 | NM_006920.4(SCN1A): c.568T > C (p.Trp190Arg) | 6323 | SCN1A | ['AGATTTACTTTCCTTCGGGATCCAYGGAAC TGGCTCGATTTCACTGTCAT'] |
| 2097 | NM_002608.2(PDGFB): c.356T > C (p.Leu119Pro) | 5155 | PDGFB | ['ATAGACCGCACCAACGCCAACTTCCYGGTG TGGCCGCCCTGTGTGGAGGTG'] |
| 2098 | NM_000833.4(GRIN2A): c.2T > C (p.Met1Thr) | 2903 | GRIN2A | ['TTGCAGGGACCGTCAGTGGCGACTAYGGGC AGAGTGGGCTATTGGACCCTG'] |
| 2099 | NM_002474.2(MYH11): c.3791T > C (p.Leu1264Pro) | 4629 | MYH11 | ['CTCCCCATCGCTGCACTTGGACTGCDGCTCC TGCACCTGCGCCTCCAGCTT'] |
| 2100 | NM_014139.2(SCN11A): c.2432T > C (pLeu811Pro) | 11280 | SCN11A | ['CTCAACCTCTTCATTGCCTTACTGCYCAATT CCTTTAGCAATGAGGAAAGA'] |
| 2101 | NM_006514.3(SCN10A): c.1661T > C (p.Leu554Pro) | 6336 | SCN10A | ['GGAGTCAGGGTTGCTGGGTTGAGGARGAGG GCTTCTAGGGAGGGGGCCTTG'] |
| 2102 | NM_000179.2(MSH6): c.1346T > C (p.Leu449Pro) | 2956 | MSH6 | ['CTTATTGGAGTCAGTGAACTGGGGCYGGTAT TCATGAAAGGCAACTGGGCC'] |
| 2103 | NM_000179.2(MSH6): c.4001 + 2T > C | 2956 | MSH6 | ['GAATCAGTCACTACGATTATTTCGGYAACTA ACTAACTATAATGGAATTAT'] |
| 2104 | NM_000249.3(MLH1): c.1745T > C (p.Leu582Pro) | 4292 | MLHI | ['GCTTCTTCCTAGGAGCCAGCACCGCYCTTTG ACCTTGCCATGCTTGCCTTA'] |
| 2105 | NM_000249.3(MLH1): c.2246T > C (p.Leu749Pro) | 4292 | MLHI | ['CTGCAGCTTGCTAACCTGCCTGATCHATACA AAGTCTTTGAGAGGTGTTAA'] |
| 2106 | NM_000249.3(MLH1): c.229T > C (p.Cys77Arg) | 4292 | MLHI | ['ACAGAAAGAAGATCTGGATATTGTAYGTGA AAGGTTCACTACTAGTAAACT'] |
| 2107 | NM_000249.3(MLH1): c.453 + 2T > C | 4292 | MLHI | ['GGCAATCAAGGGACCCAGATCACGGYAAGA ATGGTACATGGGAGAGTAAAT'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 2108 | NM_000249.3(MLH1): c.739T > C (p.Ser247Pro) | 4292 | MLHI | ['AGCCTTCAAAATGAATGGTTACATABCCAAT GCAAACTACTCAGTGAAGAA'] |
| 2109 | NM_000249.3(MLH1): c.790 + 2T > C | 4292 | MLHI | ['GCATCTTCTTACTCTTCATCAACCGHAAGTT AAAAAGAACCACATGGGAAA'] |
| 2110 | NM_000251.2(MSH2): c.1319T > C (p.Leu440Pro) | 4436 | MSH2 | ['TTGTTGGCAGTTTTTGTGACTCCTCYTACTG ATCTTCGTTCTGACTTCTCC'] |
| 2111 | NM_000251.2(MSH2): c.2005 + 2T > C | 4436 | MSH2 | ['AACAGATGTTCCACATCATTACTGGYAAAA AACCTGGTTTTTGGGCTTTGT'] |
| 2112 | NM_000251.2(MSH2): c.2089T > C (p.Cys697Arg) | 4436 | MSH2 | ['GGCCCAAATTGGGTGTTTTGTGCCAYGTGAG TCAGCAGAAGTGTCCATTGT'] |
| 2113 | NM_000251.2(MSH2): c.560T > C (p.Leu187Pro) | 4436 | MSH2 | ['CCTGATAATGATCAGTTCTCCAATCBTGAGG CTCTCCTCATCCAGATTGGA'] |
| 2114 | NM_000251.2(MSH2): c.595T > C (p.Cys199Arg) | 4436 | MSH2 | ['CCTCATCCAGATTGGACCAAAGGAAYGTGT TTTACCCGGAGGAGAGACTGC'] |
| 2115 | NM_000251.2(MSH2): c.929T > C (p.Leu310Pro) | 4436 | MSH2 | ['TTGGATATTGCAGCAGTCAGAGCCCBTAACC TTTTTCAGGTAAAAAAAAAA'] |
| 2116 | NM_007294.3(BRCA1): c.134 + 2T > C | 672 | BRCAI | ['AAAGTGTGACCACATATTTTGCAAGBAAGTT TGAATGTGTTATGTGGCTCC'] |
| 2117 | NM_001194998.1(CEP152): c.3149T > C (p.Leu1050Pro) | 22995 | CEP152 | ['TATGAGGAAGACATCCTGACTGTACYTGGG GTTCTTTTAAGTGATACCCAA'] |
| 2118 | NM_001271723.1(FBX038): c.616T > C (p.Cys206Arg) | 81545 | FBX038 | ['AGGGGTGAATGTTCCTGAAATTCCTYGTATC CCAATGCTAAGGCACCTTTA'] |
| 2119 | NM_014495.3(ANGPTL3): c.883T > C (p.Phe295Leu) | -1 | — | ['ACATCGAATAGATGGATCACAAAACYTCAA TGAAACGTGGGAGAACTACAA'] |
| 2120 | NM_003184.3(TAF2): c.1945T > C (p.Trp649Arg) | 6873 | TAF2 | ['CTCTCATAGCGGAGCTGATACTGCCRCATAA AATCAGCTTGCTCAAATTCT'] |
| 2121 | NM_000016.5(ACADM): c.233T > C (p.Ile78Thr) | 34 | ACADM | ['TTCTTCTAGTATCCAGTCCCCCTAAYTAGAA GAGCCTGGGAACTTGGTTTA'] |
| 2122 | NM_000019.3(ACAT1): c.730 + 2T > C | 38 | ACATI | ['TTCCTGTCACAGTTACAGTAAAAGGYAGAG ATAATGTTCCAAAAAGGATGA'] |
| 2123 | NM_000143.3(FH): c.1255T > C (p.Ser419Pro) | 2271 | FH | ['GAAGCATCCCCCAGCAGCCTGGCTGRGTGT AACACATTTTTAATCTTTGAG'] |
| 2124 | NM_000169.2(GLA): c.899T > C (p.Leu300Pro) | -1 | — | ['GCTCCTTTATTCATGTCTAATGACCYCCGAC ACATCAGCCCTCAAGCCAAA'] |
| 2125 | NM_000202.6(IDS): c.587T > C (p.Leu196Ser) | 3423 | IDS | [GTGCTGGATGTTCCCGAGGGCACCTYGCCTG ACAAACAGAGCACTGAGCAA'] |
| 2126 | NM_000252.2(MTM1): c.688T > C (p.Trp230Arg) | 4534 | MTM1 | ['TCTGACTTAACCATAGGTGCTGTCAYGGATT CATCCAGAAAATAAGACGGT'] |
| 2127 | NM_000277.1(PAH): c.638T > C (p.Leu213Pro) | 5053 | PAH | ['GAGTACAATCACATTTTTCCACTTCYTGAAA AGTACTGTGGCTTCCATGAA'] |
| 2128 | NM_000404.2(GLB1): c.457 + 2T > C | 2720 | GLB1 | ['TTCTTCTCCGCTCCTCCGACCCAGGYAGGTT GTTACAGATGTCTTGAGAAG'] |
| 2129 | NM_000528.3(MAN2B1): c.2436 + 2T > C | 4125 | MAN2B1 | ['AGAGATGGCTCGCTGGAGCTCATGGYGAGT GGGTCAGAGCCCCATCCGAGC'] |
| 2130 | NM_000531.5(OTC): c.540 + 2T > C | 5009 | OTC | ['CTGGCTGATTACCTCACGCTCCAGGHTGGTT TATTTATTTGTCTTACAAAA'] |
| 2131 | NM_001005741.2(GBA): c.667T > C (p.Trp223Arg) | 2629 | GBA | ['TTCACCGCTCCATTGGTCTTGAGCCRAGTGG GTGATGTCCAGGGGCTGGCA'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 2132 | NM_000402.4(G6PD): c.473T > C (p.Leu158Pro) | 2539 | G6PD | ['CGCCTCAACAGCCACATGAATGCCCYCCAC CTGGGGTCACAGGCCAACCGC'] |
| 2133 | NM_000402.4(G6PD): c.188T > C (p.Ile63Thr) | -1 | — | ['CACCGATGCACCCATGATGATGAATRTGTGT GTATCCGACTGATGGAAGGC'] |
| 2134 | NM_006920.4(SCN1A): c.4251 + 2T > C | -1 | — | ['GGGTATCTCTCTTTGCTTCAAGTTGYAAGTG AACACTATTTTCTCTGAATA'] |
| 2135 | NM_002225.3(IVD): c.465+2T > C | 3712 | IVD | ['CAGAAAGAGAAGTATCTCCCGAAGGYGAGG AAATGGAAATGTAATACACGC'] |
| 2136 | NM_003494.3(DYSF): c.1284 + 2T > C | 8291 | DYSF | ['GAGGTCAGCTTTGCGGGGAAAATGGYAAGG AGCAAGGGAGCAGGAGGGTTC'] |
| 2137 | NM_004006.2(DMD): c.2380 + 2T > C | 1756 | DMD | ['CCCTGGTGGAACAGATGGTGAATGGYAATT ACACGAGTTGATTTAGATAAT'] |
| 2138 | NM_012463.3(ATP6V0A2): c.825 + 2T > C | 23545 | ATP6V0A2 | ['ACCCGCATCCAGGATCTCTACACTGYGAGTA AGCTGGAAGTGGATTGCCTC'] |
| 2139 | NM_014795.3(ZEB2): c.73+2T > C | 9839 | ZEB2 | ['AAGCCAATCCCAGGAGGAAAAACGGYAAG AAGCAGCCCGAACCAAACTTTT'] |
| 2140 | NM_016725.2(FOLR1): c.493 + 2T > C | 2348 | FOLR1 | ['ACAAGGGCTGGAACTGGACTTCAGGYGAGG GCTGGGGTGGGCAGGAATGGA'] |
| 2141 | NM_000056.3(BCKDHB): c.752T > C (p.Val251Ala) | 594 | BCKDHB | ['CCTGTTCTGTATTTAGCGGAAGAAGYCCCTA TAGAACCATACAACATCCCA'] |
| 2142 | NM_175053.3(KRT74): c.821T > C (p.Phe274Ser) | 121391 | KRT74 | ['TACTGCATCATACAGACACTTGAGGRACTTG ATTTCTTTGTCCAGTGAGTC'] |
| 2143 | NM_003764.3(STX11): c.173T > C (p.Leu58Pro) | 8676 | STX11 | ['GACATTCAGGATGAAAACCAGCTGCYGGTG GCCGACGTGAAGCGGCTGGGA'] |
| 2144 | NM_001044.4(SLC6A3): c.671T > C (p.Leu224Pro) | 6531 | SLC6A3 | ['CTCTGCAGACGTGGCGTGCTGCACCYCCACC AGAGCCATGGCATCGACGAC'] |
| 2145 | NM_015662.2(IFT172): c.5179T > C (p.Cys1727Arg) | -1 | — | ['CTGATGAATTTCAGCACGTCCTGGCRCACTG GGCTGTGGGAGGTCTGTGAG'] |
| 2146 | NM_015662.2(IFT172): c.4607T > C (p.Leu1536Pro) | 26160 | IFT172 | ['GCGCGTGGCATAGTAATGAGCGATCRGCAG CATCGTCTTGAACTCCTCATG'] |
| 2147 | NM_014754.2(PTDSS1): c.794T > C (p.Leu265Pro) | 9791 | PTDSS1 | ['ACCGGGAAGATCAAGAGAGCTGTTCYGCAG TTCACTCCTGCTAGCTGGACC'] |
| 2148 | NM_014714.3(IFT140): c.4078T > C (p.Cys1360Arg) | 9742 | IFT140 | ['GGACCCCAAGGAGTCCATCAAGCAGYGTGA GCTGCTCCTGGAGGAACCAGA'] |
| 2149 | NM_000531.5(OTC): c.1005 + 2T > C | 5009 | OTC | ['GAAACAGAAAGTGGACAATCATGGYAAGC AAGAAACAAGGAATGGAGGAT'] |
| 2150 | NM_000531.5(OTC): c.1018T > C (p.Ser340Pro) | 5009 | OTC | ['GTTGTGTCATCAGGCTGTCATGGTGYCCCTG CTGACAGATTACTCACCTCA'] |
| 2151 | NM_000531.5(OTC): c.1022T > C (p.Leu341Pro) | 5009 | OTC | ['TGTCATCAGGCTGTCATGGTGTCCCYGCTGA CAGATTACTCACCTCAGCTC'] |
| 2152 | NM_000531.5(OTC): c.1033T > C (p.Tyr345His) | 5009 | OTC | ['TGTCATGGTGTCCCTGCTGACAGATBACTCA CCTCAGCTCCAGAAGCCTAA'] |
| 2153 | NM_000531.5(OTC): c.143T > C (p.Phe48Ser) | 5009 | OTC | ['CGTGACCTTCTCACTCTAAAAAACTYTACCG GAGAAGAAATTAAATATATG'] |
| 2154 | NM_000531.5(OTC): c.158T > C (p.Ile53Thr) | 5009 | OTC | ['CTAAAAACTTTACCGGAGAAGAAABTAAA TATATGCTATGGCTATCAGCA'] |
| 2155 | NM_000531.5(OTC): c.167T > C (p.Met56Thr) | 5009 | OTC | ['TTTACCGGAGAAGAAATTAAATATAYGCTA TGGCTATCAGCAGATCTGAAA'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 2156 | NM_000531.5(OTC): c.188T > C (p.Leu63Pro) | 5009 | OTC | ['TATATGCTATGGCTATCAGCAGATCYGAAAT TTAGGATAAAACAGAAAGGA'] |
| 2157 | NM_000531.5(OTC): c.227T > C (p.Leu76Ser) | 5009 | OTC | ['GTCCTTGATTTATAGTATTTGCCTTYATTGCA AGGGAAGTCCTTAGGCATG'] |
| 2158 | NM_000531.5(OTC): c.284T > C (p.Leu95Ser) | 5009 | OTC | ['GAGAAAAGAAGTACTCGAACAAGATYGTCT ACAGAAACAGGTAAGTCCACT'] |
| 2159 | NM_000531.5(OTC): c.2T > C (p.Met1Thr) | 5009 | OTC | ['CGTCCTTTACACAATTAAAAGAAGAYGCTGT TTAATCTGAGGATCCTGTTA'] |
| 2160 | NM_000531.5(OTC): c.386 + 2T > C | 5009 | OTC | ['TGAAAGTCTCACGGACACGGCCCGGYTTGT AAATATTTTCTTCTCTCCAAA'] |
| 2161 | NM_000531.5(OTC): c.392T > C (p.Leu131Ser) | 5009 | OTC | ['TTTTTCTTGGTTTGCCACAGTGTATYGTCTAG CATGGCAGATGCAGTATTG'] |
| 2162 | NM_000531.5(OTC): c.394T > C (p.Ser132Pro) | 5009 | OTC | ['TTTCTTGGTTTGCCACAGTGTATTGYCTAGC ATGGCAGATGCAGTATTGGC'] |
| 2163 | NM_000531.5(OTC): c.416T > C (p.Leu139Ser) | 5009 | OTC | [HIGTCTAGCATGGCAGATGCAGTATYGGCTC GAGTGTATAAACAATCAGAT'] |
| 2164 | NM_000531.5(OTC): c.443T > C (p.Leu148Ser) | 5009 | OTC | ['GCTCGAGTGTATAAACAATCAGATTBGGAC ACCCTGGCTAAAGAAGCATCC'] |
| 2165 | NM_000531.5(OTC): c.476T > C (p.Ile159Thr) | 5009 | OTC | ['CTGGCTAAAGAAGCATCCATCCCAAYTATC AATGGGCTGTCAGATTTGTAC'] |
| 2166 | NM_000531.5(OTC): c.479T > C (p.Ile160Thr) | 5009 | OTC | ['GCTAAAGAAGCATCCATCCCAATTANCAAT GGGCTGTCAGATTTGTACCAT'] |
| 2167 | NM_000531.5(OTC): c.490T > C (p.Ser164Pro) | 5009 | OTC | ['ATCCATCCCAATTATCAATGGGCTGYCAGAT TTGTACCATCCTATCCAGAT'] |
| 2168 | NM_000531.5(OTC): c.526T > C (p.Tyr176His) | 5009 | OTC | ['CCATCCTATCCAGATCCTGGCTGATYACCTC ACGCTCCAGGTTGGTTTATT'] |
| 2169 | NM_000531.5(OTC): c.536T > C (p.Leu179Pro) | 5009 | OTC | ['CAGATCCTGGCTGATTACCTCACGCYCCAGG TTGGTTTATTTATTTGTCTT'] |
| 2170 | NM_000531.5(OTC): c.577T > C (p.Trp193Arg) | 5009 | OTC | ['CTCTCTGAAAGGTCTTACCCTCAGCBGGATC GGGGATGGGAACAATATCCT'] |
| 2171 | NM_000531.5(OTC): c.602T > C (p.Leu201Pro) | 5009 | OTC | ['TGGATCGGGGATGGGAACAATATCCYGCAC TCCATCATGATGAGCGCAGCG'] |
| 2172 | NM_000531.5(OTC): c.663 + 2T > C | 5009 | OTC | ['CACCTTCAGGCAGCTACTCCAAAGGYAGGG AAACTTTTTGCCTTGAAACTA'] |
| 2173 | NM_000531.5(OTC): c.779T > C (p.Leu260Ser) | 5009 | OTC | ['GAAGCAGCGCATGGAGGCAATGTATYAATT ACAGACACTTGGATAAGCATG'] |
| 2174 | NM_000531.5(OTC): c.793T > C (p.Trp265Arg) | 5009 | OTC | ['AGGCAATGTATTAATTACAGACACTYGGAT AAGCATGGGACAAGAAGAGGA'] |
| 2175 | NM_000531.5(OTC): c.803T > C (p.Met268Thr) | 5009 | OTC | ['TTAATTACAGACACTTGGATAAGCAYGGGA CAAGAAGAGGAGAAGAAAAAG'] |
| 2176 | NM_000531.5(OTC): c.907T > C (p.Cys303Arg) | 5009 | OTC | ['TGCCTCTGACTGGACATTTTTACACBGCTTG CCCAGAAAGCCAGAAGAAGT'] |
| 2177 | NM_000531.5(OTC): c.947T > C (p.Phe316Ser) | 5009 | OTC | ['CCAGAAGAAGTGGATGATGAAGTCTYTTAT TCTCCTCGATCACTAGTGTTC'] |
| 2178 | NM_000322.4(PRPH2): c.637T > C (p.Cys213Arg) | 5961 | PRPH2 | ['CCTGGTGGACGCGTCCCTTTCAGCYGCTGC AATCCTAGCTCGCCACGGCC'] |
| 2179 | NM_000322.4(PRPH2): c.736T > C (p.Trp246Arg) | 5961 | PRPH2 | ['CCACCAGACGGAGGAGCTCAACCTGYGGGT GCGTGGCTGCAGGGCTGCCCT'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| | NM_017415.2(KLHL3): c.1160T > C (p.Leu387Pro) | 26249 | KLHL3 | [] |
| | NM_017415.2(KLHL3): c.1280T > C (p.Met427Thr) | 26249 | KLHL3 | [] |
| 2180 | NM_003859.1(DPM1): c.742T > C (p.Ser248Pro) | -1 | — | ['AGAGTCAATAATCCTTTCAAGAAAGRTACTA TTTCATTTCCTCCCAACTTG'] |
| 2181 | NM_004826.3(ECEL1): c.2278T > C (p.Cys760Arg) | 9427 | ECEL1 | ['GGGTTCATGGGTGAGTCCTTGGGACRGTGG AAAGCCCGGCCAAACTCCTCA'] |
| 2182 | NM_014908.3(DOLK): c.2T > C (p.Met1Thr) | 22845 | DOLK | ['GGCCGGAGATGGGCACTCTCGGGTCRTATCT CTAGACCTGGGGCTTCACGG'] |
| 2183 | NM_000404.2(GLB1): c.922T > C (p.Phe308Leu) | 2720 | GLB1 | ['TCTTTTGTTTCCTTGTAGGTACATGYTTATAG GTGGGACCAATTTTGCCTA'] |
| 2184 | NM_012434.4(SLC17A5): c.500T > C (p.Leu167Pro) | 26503 | SLC17A5 | ['TTAGGAGTTGGACCACTCATTGTACYCAGAG CACTAGAAGGACTAGGAGAG'] |
| 2185 | NM_000211.4(ITGB2): c.1877 + 2T > C | 3689 | ITGB2 | ['CCCCTCACCCTGTGGCAAGTACATGYGAGTG CAGGCGGAGCAGGCAGGGCG'] |
| 2186 | NM_006702.4(PNPLA6): c.3053T > C (p.Phe1018Ser) | 10908 | PNPLA6 | ['ACCTCCATGTTCACTGGGTCTGCCTYTAACC GCAGCATCCATCGGGTCTTC'] |
| 2187 | NM_176787.4(PIGN): c.808T > C (p.Ser270Pro) | 23556 | PIGN | ['TCTGAAGGATGACCAGCCCCATGGGRACCT ACAAATAAGATATAAAGAATA'] |
| 2188 | NM_001165899.1(PDE4D): c.1850T > C (p.Ile617Thr) | 5144 | PDE4D | ['CCATGTCTCCCAGAGGGGATGAACARTATA GTCTATGAAGCCCACCTAGTT'] |
| 2189 | NM_005017.3(PCYT1A): c.571T > C (p.Phe191Leu) | 5130 | PCYT1A | ['CCTTCTGTCCTCTGTGTTGGAGCAARCATGC CTAACTCAGAAACACATACA'] |
| 2190 | NM_000090.3(COL3A1): c.951 + 6T > C (p.Gly300_Ala317del) | 1281 | COL3A1 | ['CAGGACTTCCTGGGGCTGCAGTGAGHATAG CTGCTAACATCACACAATTAC'] |
| 2191 | NM_000090.3(COL3A1): c.2022 + 2T > C (p.Gly660_Lys674del) | 1281 | COL3A1 | ['GCACCTGGAGCTCCAGGAGGCAAGGYAGTA TTTCAATTTATTCTCTACCTT'] |
| 2192 | NM_000090.3(COL3A1): c.951 + 2T > C (p.Gly300_Ala317del) | 1281 | COL3A1 | ['CGGCCAGGACTTCCTGGGGCTGCAGHGAGT ATAGCTGCTAACATCACACAA'] |
| 2193 | NM_000090.3(COL3A1): c.3093 + 2T > C (p.Gly1014_Lys1031del) | 1281 | COL3A1 | ['CGAGATGGATCTCCTGGTGGCAAGGBATAA TAAAACACATGTGCAATTGATT'] |
| 2194 | NM_000090.3(COL3A1): c.2337 + 2T > C (p.Gly762_Lys779del) | 1281 | COL3A1 | ['CCAGCTGGCCAGCCTGGAGATAAGGYAACC CTTAATACTACCTGGATATAA'] |
| 2195 | NM_000090.3(COL3A1): c.1761 + 2T > C (p.Gly555_Asp587del) | 1281 | COL3A1 | ['TTCCCCGGTCCTAAAGGAAATGATGBGAGTT CCTTCATTAATTTCTTCAAT'] |
| 2196 | NM_000090.3(C0L3A1): c.3039 + 6T > C (p.Asp1013_Gly1014insVSSSFY STSQ) | 1281 | COL3A1 | ['CTGGTGAACCTGGAAGAGATGTGAGYAGCA GTTTTTATTCAACCAGCCAGG'] |
| 2197 | NM_000090.3(COL3A1): c.4399T > C (p.Ter1467Gln) | 1281 | COL3A1 | ['GGACGTTGGCCCTGTTTGCTTTTTAYAAACC AAACTCTATCTGAAATCCCA'] |
| 2198 | NM_000090.3(COL3A1): c.2553 + 2T > C (p.Gly816_Ala851del) | 1281 | COL3A1 | ['CCCCCTGGAGGTTCTGGACCTGCTGYAAGTT CCTTCCTCTTTCTCTGTCTA'] |
| 2199 | NM_001278503.1(STT3A): c.1877T > C (p.Val626Ala) | 3703 | STT3A | ['TATACTCCAACTGGGGAGTTCCGTGYGGACC GTGAAGGTTCTCCAGTGCTG'] |
| 2200 | NM_000277.1(PAH): c.691T > C (p.Ser231Pro) | 5053 | PAH | ['TAACATTCCCCAGCTGGAAGACGTTYCTCAG TTCCTGCAGAGTAAGTCCAC'] |
| 2201 | NM_007294.3(BRCA1): c.5467 + 2T > C | 672 | BRCA1 | ['GGACAGAGGACAATGGCTTCCATGGAAGG TGCCTGCATGTACCTGTGCTA'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 2202 | NM_020347.3(LZTFL1): c.260T > C (p.Leu87Pro) | 54585 | LZTFL1 | ['ATACCACTTCTCAGCTTGTGCAAACRGCTGT CGCAGAAGTAACACATTGGT'] |
| 2203 | NM_016381.5(TREX1): c.530T > C (p.Val177Ala) | 11277 | TREX1 | ['CGCCAGCCACAGCCCTGGTGCCTGGYGGCA CACAATGGTGACCGCTACGAC'] |
| 2204 | NM_015474.3(SAMHD1): c.1106T > C (p.Leu369Ser) | 25939 | SAMHD1 | ['TTTGTGTTGATAAGCTCTACGGTGTRAAGAG TTGCGAGTGTGGAACATGTC'] |
| 2205 | NM_005654.5(NR2F1): c.755T > C (p.Leu252Pro) | 7025 | NR2F1 | ['CAGATCACCGACCAGGTGTCCCTGCYACGC CTCACCTGGAGCGAGCTGTTC'] |
| 2206 | NM_003638.2(ITGA8): c.2982 + 2T > C | 8516 | ITGA8 | ['TGCCTATATATATTTAAAGATACTCRCTACT ATGCTTCCTTCTGGGAGTTT'] |
| 2207 | NM_000321.2(RB1): c.2663+2T > C | 5925 | RB1 | ['AGGATCAGATGAAGCAGATGGAAGGYAGG AACCAGTTTTGAATGTTTTCCA'] |
| 2208 | NM_000321.2(RB1): c.1472T > C (p.Leu491Pro) | 5925 | RB1 | ['CATATGTCTTTATTGGCGTGCGCTCYTGAGG TTGTAATGGCCACATATAGC'] |
| 2209 | NM_015884.3(MBTPS2): c.1391T > C (p.Phe464Ser) | 51360 | MBTPS2 | ['GCTATTGTTAATGCAGTACCCTGCTYTGCTT TGGATGGACAATGGATTCTA'] |
| 2210 | NM_001739.1(CA5A): c.697T > C (p.Ser233Pro) | 763 | CA5A | ['TCGGTCAGCGGCGGGTGGTGAGCGRGCCC GCGTAGGTCCAGTAATCCCAG'] |
| 2211 | NM_005051.2(QARS): c.169T > C (p.Tyr57His) | 5859 | QARS | ['TCCCTGAGTCGGGAGGCCAAGCCATRTAAC AGGATCCCGGTAGCTTTGTCA'] |
| 2212 | NM_005356.4(LCK): c.1022T > C (p.Leu341Pro) | 3932 | LCK | ['GGCATCAAGTTGACCATCAACAAACYCCTG GACATGGCAGCCCAAGTAAGG'] |
| 2213 | NM_021803.3(IL21): c.146T > C (p.Leu49Pro) | 59067 | IL21 | ['TACCAAGTCATTCACATAATTTTTCRGCTGA TCAACAATATCTATAAGTTG'] |
| 2214 | NM_005861.3(STUB1): c.719T > C (p.Met240Thr) | -1 | — | ['TGTGGCAAGATCAGCTTTGAGCTGAYGCGG GAGCCGTGCATCACGCCCAGT'] |
| 2215 | NM_032575.2(GLIS2): c.523T > C (p.Cys175Arg) | 84662 | GLIS2 | ['TCAGAACACTTCCCATCCTCCGCAGYGTAAC CAGCTCTTTGAGCTCCTGCA'] |
| 2216 | NM_001101.3(ACTB): c.224T > C (p.Ile75Thr) | 60 | ACTB | ['CTGAAGTACCCCATCGAGCACGGCAYCGTC ACCAACTGGGACGACATGGAG'] |
| 2217 | NM_001101.3(ACTB): c.356T > C (p.Met119Thr) | 60 | ACTB | ['AACCCCAAGGCCAACCGCGAGAAGAYGACC CAGGTGAGTGGCCCGCTACCT'] |
| 2218 | NM_003401.3(XRCC4): c.127T > C (p.Trp43Arg) | 7518 | XRCC4 | ['TACACTTACTGATGGTCATTCAGCAYGGACT GGGACAGGTAATACTAAAAA'] |
| 2219 | NM_000051.3(ATM): c.2638 + 2T > C | 472 | ATM | ['CTGGAGAGAGCCAAAGTACCATAGGYAAAT ACATATTTACTACTTGGGATT'] |
| 2220 | NM_000535.5(PMS2): c.2T > C (p.Met1Thr) | 5395 | PMS2 | ['CGAGGCGGATCGGGTGTTGCATCCAHGGAG CGAGCTGAGAGCTCGAGGTGA'] |
| 2221 | NM_015713.4(RRM2B): c.190T > C (p.Trp64Arg) | 50484 | RRM2B | ['ATGCCACGTACCTCTTCTGCTGTCCRGAAGG AAGCCTGTGCCTGTTTATAC'] |
| 2222 | NM_015713.4(RRM2B): c.368T > C (p.Phe123Ser) | 50484 | RRM2B | ['CTCGATGAGAATTTGAAAGCCATAGRAACA GCGAGCCTCTGGAACCTGCAC'] |
| 2223 | NM_003122.4(SPINK1): c.194 + 2T > C | 6690 | SPINK1 | ['TTAAAGAAACTCAAGTTTGTACTCRCCGAT TTTCAAAACATAACACGCAT'] |
| 2224 | NM_003122.4(SPINK1): c.160T > C (p.Tyr54His) | 6690 | SPINK1 | ['AAACATAACACGCATTCATTGGGATRAGTAT TTCCATCAGTCCCACAGACA'] |
| | NM_000219.5(KCNE1): c.158T > C (p.Phe53Ser) | 3753 | KCNE1 | [] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 2225 | NM_000219.5(KCNE1): c.176T > C (p.Leu59Pro) | 3753 | KCNE1 | ['GCGGATGTAGCTCAGCATGATGCCCRGGGT GAAGAAGCCGAAGAATCCCAG'] |
|  | NM_000219.5(KCNE1): c.259T > C (p.Trp87Arg) | 3753 | KCNE1 | [] |
| 2226 | NM_017890.4(VPS13B): c.11119 + 2T > C | 157680 | VPS13B | ['CGTTTGTAAAGCACATCTCCAAAGGYAGCG GGTTCCGTTCCTTGTAATAAT'] |
| 2227 | NM_005026.3(PIK3CD): c.1246T > C (p.Cys416Arg) | 5293 | PIK3CD | ['CACCTGCCCTGTCCTTCTGCAGGACYGCCCC ATTGCCTGGGCCAACCTCAT'] |
| 2228 | NM_000271.4(NPC1): c.2054T > C (p.Ile685Thr) | 4864 | NPC1 | ['TACATTGGGTTGCCCTTGACCCTCAYTGTGA TTGAAGTCATCCCGTTCCTG'] |
| 2229 | NM_002633.2(PGM1): c.1547T > C (p.Leu516Pro) | 5236 | PGM1 | ['GGGAGTGCCGGGGCCACCATTCGGCYGTAC ATCGATAGCTATGAGAAGGAC'] |
| 2230 | NM_015599.2(PGM3): c.248T > C (p.Leu83Ser) | 5238 | PGM3 | ['TTGGTTGATCCTTTGGGTGAAATGTYGGCAC CATCCTGGGAGGAACATGCC'] |
| 2231 | NM_002136.2(HNRNPA1): c.817T > C (p.Phe273Leu) | 3178 | HNRNPA1 | ['GAATTACAACAATCAGTCTTCAAATBTTGGA CCCATGAAGGGAGGAAATTT'] |
| 2232 | NM_002136.2(HNRNPA1): c.841T > C (p.Phe281Leu) | 3178 | HNRNPA1 | ['TTTTGGACCCATGAAGGGAGGAAATYTTGG AGGCAGAAGCTCTGGCCCCTA'] |
| 2233 | NM_001159287.1(TPI1): c.833T > C (p.Phe278Ser) | 7167 | TPI1 | ['GGTGGTGCTTCCCTCAAGCCCGAATYCGTGG ACATCATCAATGCCAAACAA'] |
| 2234 | NM_130838.1(UBE3A): c.2T > C (p.Met1Thr) | 7337 | UBE3A | ['TCTGACGACATTGAAGCTAGCCGAAYGTAA GTGTAACTTGGTTGAGACTGT'] |
| 2235 | NM_130838.1(UBE3A): c.710T > C (p.Leu237Pro) | 7337 | UBE3A | ['ATTGAAACTGCCTTTCTCAATGCACHTGTAT ATTTGTCACCTAACGTGGAA'] |
| 2236 | NM_000414.3(HSD17B4): c.1547T > C (p.Ile516Thr) | 3295 | HSD17B4 | ['AGTGGAGACTGGAATCCCTTACACAYTGATC CTAACTTTGCTAGTCTAGCA'] |
| 2237 | NM_022068.3(PIEZO2): c.8215T > C (p.Ser2739Pro) | 63895 | PIEZO2 | ['GTCCATTTGATCATTGTCTCTGGTGRGCGAT ATAGGAATATTAATTTGGCA'] |
| 2238 | NM_012079.5(DGAT1): c.751 + 2T > C | 8694 | DGAT1 | ['GCACCTCAGGCCCACAGAGGTCCTCRCCGC GGTAGGTCAGATTGTCCGGGT'] |
| 2239 | NM_003108.3(SOX11): c.178T > C (p.Ser60Pro) | 6664 | SOX11 | ['GCCGATGAACGCGTTCATGGTATGGYCCAA GATCGAACGCAGGAAGATCAT'] |
| 2240 | NM_021072.3(HCN1): c.814T > C (p.Ser272Pro) | 348980 | HCN1 | ['TGATGTATGTATCTAATTAACCTTGRAAGTC GTAATAAACGCAAGAGACTG'] |
| 2241 | NM_001079867.1(PEX2): c.739T > C (p.Cys247Arg) | 5828 | PEX2 | ['CACCAGTGGCAAAGAATGCGCTCTAYGTGG AGAGTGGCCCACCATGCCTCA'] |
| 2242 | NM_022552.4(DNMT3A): c.1943T > C (p.Leu648Pro) | 1788 | DNMT3A | ['CTGAATGCCCAAGTCCTTCAGCACCRGGAGC CCTGCACCAGCCAGCAGACA'] |
| 2243 | NM_022552.4(DNMT3A): c.2705T > C (p.Phe902Ser) | 1788 | DNMT3A | ['CGCAAAATACTCCTTCAGCGGAGCGRAGAG GTGGCGGATGACTGGCACGCT'] |
| 2244 | NM_018400.3(SCN3B): c.482T > C (p.Met161Thr) | 55800 | SCN3B | ['GAGGAAGACCAGAAGGATGTACATCRTGAT TTCTGAGACCACAGAGGTGAA'] |
| 2245 | NM_000406.2(GNRHR): c.392T > C (p.Met131Thr) | 2798 | GNRHR | ['TTCTCCATGTATGCCCCAGCCTTCAYGATGG TGGTGATCAGCCTGGACCGC'] |
| 2246 | NM_001030001.2(RPS29): c.149T > C (p.Ile50Thr) | 6235 | RPS29 | ['GCAGACGCCTACCTTAATGAAACCGRTATCC TTCGCGTACTGACGGAAACA'] |
| 2247 | NM_177550.4(SLC13A5): c.1463T > C (p.Leu488Pro) | 284111 | SLC13A5 | ['CAGGGTACAGGGCAGCATGATGTACRGCGG ATTGAGGCCGATGGAGCGAGA'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 2248 | NM_004464.3(FGF5): c.520T > C (p.Tyr174His) | 2250 | FGF5 | ['TTTTCAAGAAAATAGCTATAATACCBATGCC TCAGCAATACATAGAACTGA'] |
| 2249 | NM_000051.3(ATM): c.4776 + 2T > C | 472 | ATM | ['AGAGGACCCTTTTCACTCTTGGAGGYAATAA AAATTTCATCATCTACTATT'] |
| 2250 | NM_002880.3(RAF1): c.1808T > C (p.Leu603Pro) | 5894 | RAF1 | ['GTGTTGGAGCAGCTCAATGGAAGACRGGAT CTGAAACAAAGCCCAAGAATG'] |
| 2251 | NM_000251.2(MSH2): c.942 + 2T > C | 4436 | MSH2 | ['GTCAGAGCCCTTAACCTTTTTCAGGBAAAAA AAAAAAAAAAAAAAAAAAAA'] |
| 2252 | NM_001077620.2(PRCD): c.2T > C (p.Met1Thr) | -1 | — | ['GGGAGGGGATGGGGCAGCTGCGCCAYGTGC ACCACCCTTTTCCTGCTCAGC'] |
| 2253 | NM_001142800.1(EYS): c.9209T > C (p.Ile3070Thr) | 346007 | EYS | ['AGCCACAAAGTTTTTATGTGGATCARTATCC TCGGAAAGAATTAGACTGTT'] |
| 2254 | NM_206933.2(USH2A): c.9751T > C (p.Cys3251Arg) | 7399 | USH2A | ['TCCTAAATTGACAGGTGAAGTATGCYGTCCA GATGAACAGCACAATCGGGT'] |
| 2255 | NM_000257.3(MYH7): c.4442T > C (p.Leu1481Pro) | -1 | — | ['GAGGCTCGCTCCCTCAGCACAGAGCYCTTCA AACTCAAGAACGCCTATGAG'] |
| 2256 | NM_000257.3(MYH7): c.4835T > C (p.Leu1612Pro) | -1 | — | ['GAGACACGCAGCCGCAACGAGGCCCYGAGG GTGAAGAAGAAGATGGAAGGA'] |
| 2257 | NM_000257.3(MYH7): c.4937T > C (p.Leu1646Pro) | -1 | — | ['GAGGCCCAGAAGCAAGTCAAGAGCCYCCAG AGCTTGTTGAAGGTACTCACC'] |
| 2258 | NM_001199138.1(NLRC4): c.1022T > C (p.Val341Ala) | 58484 | NLRC4 | ['AATCTCATGAAGACCCCTCTCTTTGYGGTCA TCACTTGTGCAATCCAGATG'] |
| 2259 | NM_000076.2(CDKN1C): c.*5 + 2T > C | 1028 | CDKN1C | ['GCGCAAGAGGCTGCGGTGAGCCAAGYGAGT ACAGCGCACCTGGGGGGGCGC'] |
| 2260 | NM_003159.2(CDKL5): c.659T > C (p.Leu220Pro) | 6792 | CDKL5 | ['CCTGGAGAAAGTGAAATTGACCAACYTTTT ACTATTCAGAAGGTGCTAGGA'] |
| 2261 | NM_005027.3(PEK3R2): c.1202T > C (p.Leu401Pro) | 5296 | PIK3R2 | ['CTCACCTTCTGCTCCGTTGTGGACCYCATCA ATCACTACCGCCACGAGTCT'] |
| 2262 | NM_173596.2(SLC39A5): c.911T > C (p.Met304Thr) | 283375 | SLC39A5 | ['TTCCTGCTCTTTGTGCTGGAGAACAYGCTGG GGCTTTTGCGGCACCGAGGG'] |
| 2263 | NM_153334.6(SCARF2): c.190T > C (p.Cys64Arg) | 91179 | SCARF2 | ['CCTTGCTGCCTCCAGCCAGCGCAGCRCGTGG GCACCTGGGAGCTGCGAGCA'] |
| 2264 | NM_001288767.1(ARMC5): c.1928T > C (p.Leu643Pro) | 79798 | ARMC5 | ['GGGGCACTTGTGACCGGCCCGGCGCYGTAC GGCCTGCTGACCTATGTGACC'] |
| 2265 | NM_001288767.1(ARMC5): c.1379T > C (p.Leu460Pro) | 79798 | ARMC5 | ['CGTGAGGCCATCAACCGGGCCCGACYGCGG GATGCTGGTGGCTTGGATCTA'] |
| 2266 | NC_012920.1: m.9478T > C | 4514 | MT-CO3 | ['ATAATCCTATTTATTACCTCAGAAGYTTTTT CTTCGCAGGATTTTTCTGA'] |
| 2267 | NC_012920.1: m.11984T > C | 4538 | MT-ND4 | ['ACTAGTCACAGCCCTATACTCCCTCYACATA TTTACCACAACACAATGGGG'] |
| 2268 | NM_014845.5(FIG4): c.50T > C (p.Leu17Pro) | 9896 | FIG4 | ['ATCAGCTCGGTCCAGAAGCTGGTTCYGTATG AGACTAGAGCTGTGAGTACC'] |
| 2269 | NM_003159.2(CDKL5): c.145 + 2T > C | 6792 | CDKL5 | ['TCAAGAAATTCAAGGACAGTGAAGGYAGAT ATATATATATATATATATATA'] |
| 2270 | NM_002775.4(HTRA1): c.1091T > C (p.Leu364Pro) | 5654 | HTRA1 | ['CCATCTGATAAGATTAAAAAGTTCCYCACG GAGTCCCATGACCGACAGGCC'] |
| 2271 | NM_021870.2(FGG): c.1210T > C (p.Ser404Pro) | 2266 | FGG | ['ATCTTCATAGTGGTTTTCTTCATGGRATACC ACCGGGTTTTCCAAGTGGCC'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 2272 | NM_017617.3(NOTCH1): c.1285T > C (p.Cys429Arg) | 4851 | NOTCH1 | ['TCGAAGGAGCCCAGCGTGTTGATGCRCTTGC CCGCATGCTCGCAGGGGTTG'] |
| 2273 | NM_024915.3(GRHL2): c.1192T > C (p.Tyr398His) | 79977 | GRHL2 | ['GATGATTCAGATTGACACATACAGTYATAA CAATCGTAGCAATAAACCCAT'] |
| 2274 | NM_002049.3(GATA1): c.2T > C (p.Met1Thr) | 2623 | GATA1 | ['CGCAGGTTAATCCCCAGAGGCTCCAYGGAG TTCCCTGGCCTGGGGTCCCTG'] |
| 2275 | NM_002049.3(GATA1): c.1240T > C (p.Ter414Arg) | 2623 | GATA1 | ['TACTGTGGTGGCTCCGCTCAGCTCAYGAGGG CACAGAGCATGGCCTCCAGA'] |
| 2276 | NM_005859.4(PURA): c.299T > C (p.Leu100Pro) | 5813 | PURA | ['GGCGCGGGCGGCAACAAGAGCCGCCYTACT CTCTCCATGTCAGTGGCCGTG'] |
| 2277 | NM_032374.4(APOPT1): c.353T > C (p.Phe118Ser) | 84334 | APOPT1 | ['TTCTGGGCAAACCAGAATTTGACTTYTAGTA AGGTAAGTTTAAGTTTTAGA'] |
| 2278 | NM_032551.4(KISS1R): c.937T > C (p.Tyr313His) | 84634 | KISS1R | ['TAAGACCTGGGCTCACTGCATGTCCYACAGC AACTCCGCGCTGAACCCGCT'] |
| 2279 | NM_017696.2(MCM9): c.1732 + 2T > C | 254394 | MCM9 | ['AAAGCTTGATACGATTAGCAGAAGGYCTAT TTCATTCAGCGAATGATGCTT'] |
| 2280 | NM_003159.2(CDKL5): c.602T > C (p.Leu201Pro) | 6792 | CDKL5 | ['GACATGTGGTCGGTGGGCTGTATTCYTGGGG AGCTTAGCGATGGACAGCCT'] |
| 2281 | NM_005740.2(DNAL4): c.153 + 2T > C | 10126 | DNAL4 | ['GAGAAATTCTCCAACAACAACGAGGYATTG CCAGCAGTGCAGGCGGCCCCT'] |
| 2282 | NM_201631.3(TGM5): c.763T > C (p.Trp255Arg) | 9333 | TGM5 | ['TTCAGGATGGCCACGCTGCCCGTCCRCTCCG CAGGGTTGGCGCCGTCTGTG'] |
| 2283 | NM_201631.3(TGM5): c.122T > C (p.Leu41Pro) | 9333 | TGM5 | ['GCTCCGGTTCCTGAAGTACAGGGTGRGGTTG AAGGCCTGGCCCCGGCGAAC'] |
| 2284 | NM_001287223.1(SCN11A): c. 3473T > C (p.Leu1158Pro) | 11280 | SCN11A | ['TACCTTCATTCCTTCAAACTGGGACRGCGCA CGAAGAGGCCTCAGTGCTCG'] |
| 2285 | NM_001287223.1(SCN11A): c. 1142T > C (p.Ile381Thr) | 11280 | SCN11A | ['GGGCTCTACTCAGTCTTCTTCTTCAYTGTGG TCATTTTCCTGGGCTCCTTC'] |
| 2286 | NM_001302946.1(TRNT1): c.668T > C (p.Ile223Thr) | 51095 | TRNT1 | ['CATGATCCTGAGACTTTGGAAGCAAYTGCA GAAAATGCAAAAGGCTTGGCT'] |
| 2287 | NM_001302946.1(TRNT1): c.497T > C (p.Leu166Ser) | 51095 | TRNT1 | ['TAATGAATAGGTTTTGATGGCACTTYATTTG ACTACTTTAATGGTTATGAA'] |
| 2288 | NM_018136.4(ASPM): c.2419 + 2T > C | 259266 | ASPM | ['ATAGACACCTATGGAAAGATGTGGGYAAGA AGACTGCAGAAATCTTGACAT'] |
| 2289 | NM_022455.4(NSD1): c.5885T > C (p.Ile1962Thr) | 64324 | NSD1 | ['TGGGGTCTACGGACAAAAACAGATAYTAAA AAGGTTAGAAAAAGCTAAATT'] |
| 2290 | NM_022455.4(NSD1): c.5989T > C (p.Tyr1997His) | 64324 | NSD1 | ['TCAAGAACATGATATCACTAATTTCYATATG CTCACCCTAGACAAAGTAAG'] |
| 2291 | NM_133433.3(NIPBL): c.7062 + 2T > C | 25836 | NIPBL | ['AAAAATATGCTGGATTCATTCATGYATGTA TTTTAACATTTTATAACCTA'] |
| 2292 | NM_000525.3(KCNJ11): c.988T > C (p.Tyr330His) | 3767 | KCNJ11 | ['GGAGGACGGACGTTACTCTGTGGACYACTC CAAGTTTGGCAACACCGTCAA'] |
| 2293 | NM_004004.5(GJB2): c.107T > C (p.Leu36Pro) | 2706 | GJB2 | ['CTCTTCATTTTTCGCATTATGATCCYCGTTGT GGCTGCAAAGGAGGTGTGG'] |
| 2294 | NM_130838.1(UBE3A): c.2485T > C (p.Tyr829His) | 7337 | UBE3A | ['CTTTAATGTGCTTTACTTCCGGAAYACTCA AGCAAAGAAAAACTTAAAGA'] |
| 2295 | NM_005682.6(ADGRG1): c.1460T > C (p.Leu487Pro) | 9289 | ADGRG1 | ['GCCATCTTCCTGCACTTCTCCCTGCYCACCT GCCTTTCCTGGATGGGCCTC'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 2296 | NM_000430.3(PAFAH1B1): c.841T > C (p.Cys281Arg) | 5048 | PAFAH1B1 | ['CCGAGAGCATGAGCATGTGGTAGAAYGCATTTCCTGGGCTCCAGAAAGCTC'] |
| 2297 | NM_001005360.2(DNM2): c.1862T > C (p.Leu621Pro) | 1785 | DNM2 | ['GTGGACAGCTGGAAGGCCTCGTTCCYCCGAGCTGGCGTCTACCCCGAGAAG'] |
| 2298 | NM_178151.2(DCX): c.683T > C (p.Leu228Pro) | 1641 | DCX | ['CTGGAGACCGGGGTTGTCAAAAAACYCTACACTCTGGATGGAAAACAGGTA'] |
| 2299 | NM_178151.2(DCX): c.641T > C (p.Ile214Thr) | 1641 | DCX | ['TCTTTTGAGCAAGTCCTCACTGATAYCACAGAAGCCATCAAACTGGAGACC'] |
| 2300 | NM_178151.2(DCX): c.412T > C (p.Tyr138His) | 1641 | DCX | ['AGACAACTTCTTTAAAAGGTGGAGYACACCAAGAATGTCAATCCCAACTG'] |
| 2301 | NM_178151.2(DCX): c.272T > C (p.Leu91Pro) | 1641 | DCX | ['TTGCTGGCTGACCTGACGCGATCTCYGTCTGACAACATCAACCTGCCTCAG'] |
| 2302 | NM_178151.2(DCX): c.128T > C (p.Leu43Ser) | 1641 | DCX | ['TGTAGCTTCTACCGAACCAGAACCTYGCAGGCACTGAGTAATGAGAAGAAA'] |
| 2303 | NM_178151.2(DCX): c.2T > C (p.Met1Thr) | 1641 | DCX | ['AGGTCTCTGAGGTTCCACCAAAATAYGGAACTTGATTTTGGACACTTTGAC'] |
| 2304 | NM_000252.2(MTM1): c.260T > C (p.Leu87Pro) | 4534 | MTM1 | ['TCTTCTCTAATACTTGATGTTCCTCYGGGTGTGATCTCGAGAATTGAAAAA'] |
| 2305 | NM_000252.2(MTM1): c.683T > C (p.Leu228Pro) | 4534 | MTM1 | ['AACTTTCTGACTTAACCATAGGTGCYGTCATGGATTCATCCAGAAAATAAG'] |
| 2306 | NM_000252.2(MTM1): c.958T > C (p.Ser320Pro) | 4534 | MTM1 | ['TCATAATATTCATGTTATGCGGGAAYCTTTAAAAAAAGTGAAGGACATTGT'] |
| 2307 | NM_000252.2(MTM1): c.1353 + 2T > C | 4534 | MTM1 | ['TGTGTGTGGCAAATGTCAAAACAGGYAAGGAATATGAGGGATGAAAATACA'] |
| 2308 | NM_000252.2(MTM1): c.1367T > C (p.Phe456Ser) | 4534 | MTM1 | [GTTTTGTTTAGTTCCCTACAGCTTYTGAATTCAATGAACAATTTTTGATT'] |
| 2309 | NM_000252.2(MTM1): c.1433T > C (p.Phe478Ser) | 4534 | MTM1 | ['CTGTATAGTTGCCGATTTGGTACTTYCTTATTCAACTGTGAATCTGCTCGA'] |
| 2310 | NM_000252.2(MTM1): c.1495T > C (p.Trp499Arg) | 4534 | MTM1 | ['GGTTACAGAAAGGACTGTTTCTTTAYGGTCACTGATAAACAGTAATAAAGA'] |
| 2311 | NM_006579.2(EBP): c.310T > C (p.Tyr104His) | 10682 | EBP | ['TCTCTTCTTTTCTTCAGGGAAAGAGYATGCCAAGGGAGACAGCCGATACAT'] |
| 2312 | NM_152296.4(ATP1A3): c.2270T > C (p.Leu757Pro) | 478 | ATP1A3 | ['GAGCCTGCCTGTGCCACAGGCCGCCYGATCTTCGACAACCTAAAGAAGTCC'] |
| 2313 | NM_152296.4(ATP1A3): c.1250T > C (p.Leu417Pro) | 478 | ATP1A3 | ['GTGGCCCTGTCTCACATCGCTGGGCYCTGCAATCGCGCTGTCTTCAAGGGT'] |
| 2314 | NM_152296.4(ATP1A3): c.1144T > C (p.Trp382Arg) | 478 | ATP1A3 | ['GAACCGCATGACAGTCGCCCACATGYGGTTTGACAACCAGATCCACGAGGC'] |
| 2315 | NM_152296.4(ATP1A3): c.1112T > C (p.Leu371Pro) | 478 | ATP1A3 | ['ATCTGCTCAGATAAGACAGGGACCCYCACTCAGAACCGCATGACAGTCGCC'] |
| 2316 | NM_004963.3(GUCY2C): c.2782T > C (p.Cys928Arg) | −1 | — | ['CTTTCTGTCCTTCATTTCAGGTCCCYGTGCTGCTGGAGTTGTGGGAATCAA'] |
| 2317 | NM_000109.3(DMD): c.1700T > C (p.Leu567Pro) | 1756 | DMD | ['GTTCACTGCATCTTCTTTTTCTGAARGCCATGCACTAAAAAGGCACTGCAA'] |
| 2318 | NM_001543.4(NDST1): c.1918T > C (p.Phe640Leu) | 3340 | NDST1 | ['CAGCAACTACCCCAGCTCTGAGACCYTTGAGGGAGATCCAGTTTTTTAATGG'] |
| 2319 | NM_001999.3(FBN2): c.3740T > C (p.Met1247Thr) | 2201 | FBN2 | ['GGTGTCACAGCCTCCGTTCATTATCRTACATTCATCAATATCTGTGAAAAC'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 2320 | NM_005154.4(USP8): c.2152T > C (p.Ser718Pro) | 9101 | USP8 | ['ACCTTCCAAACTGAAGCGCTCCTACYCCTCC CCAGATATAACCCAGGCTAT'] |
| 2321 | NM_000734.3(CD247): c.2T > C (p.Met1Thr) | 919 | CD247 | ['CCTCTTTCTGAGGGAAAGGACAAGAYGAAG TGGAAGGCGCTTTTCACCGCG'] |
| 2322 | NM_000663.4(ABAT): c.1433T > C (p.Leu478Pro) | 18 | ABAT | ['AAATCCATTCGTTTCCGTCCCACGCYGGTCT TCAGGGATCACCACGCTCAC'] |
| 2323 | NM_005211.3(CSF1R): c.2717T > C (p.Ile906Thr) | 1436 | CSF1R | ['ACCCACAGACCCACCTTCCAGCAGAYCTGCT CCTTCCTTCAGGAGCAGGCC'] |
| 2324 | NM_005211.3(CSF1R): c.2566T > C (p.Tyr856His) | 1436 | CSF1R | ['CTTGGCCTTTGCAGGGCTGAATCCCYACCCT GGCATCCTGGTGAACAGCAA'] |
| 2325 | NM_005211.3(CSF1R): c.2480T > C (p.Ile827Thr) | 1436 | CSF1R | ['GTGAAGTGGATGGCCCCAGAGAGCAYCTTT GACTGTGTCTACACGGTTCAG'] |
| 2326 | NM_005211.3(CSF1R): c.2450T > C (p.Leu817Pro) | 1436 | CSF1R | ['TGGGGACTGTCATCCCAGGCCCGCCYGCCTG TGAAGTGGATGGCCCCAGAG'] |
| 2327 | NM_005211.3(CSF1R): c.1957T > C (p.Cys653Arg) | 1436 | CSF1R | ['GAACATCGTCAACCTTCTGGGAGCCYGTACC CATGGAGGTAAGGGCCTTGG'] |
| 2328 | NM_005211.3(CSF1R): c.1745T > C (p.Leu582Pro) | 1436 | CSF1R | ['AAGTGGGAGTTCCCCCGGAACAACCYGCAG TTTGGTGAGATGGCAGCTCAT'] |
| 2329 | NM_001563.3 (EVIPG1): c.461T > C (p.Leu154Pro) | 3617 | EVIPG1 | ['AATTCCCAGGAGCACCTGGATCTTCYCCAGC AGGTGAGCCTAAACACCACA'] |
|  | NM_001130823.1(DNMT1): c.1531T > C (p.Tyr511His) | 1786 | DNMT1 | [] |
| 2330 | NM_152515.4(CKAP2L): c.2T > C (p.Met1Thr) | 150468 | CKAP2L | ['AGCAGCGGTAGGCCCGGGCCCCACCRTGAC TCTTCAGTGACAGTTTTTCTT'] |
| 2331 | NM_170707.3(LMNA): c.1968 + 2T > C | 4000 | LMNA | ['GGCAACTCCAGCCCCCGAACCCAGGNGAGT TGTCTCTGCTTTGTCTCCAAA'] |
| 2332 | NM_153818.1(PEX10): c.890T > C (p.Leu297Pro) | 5192 | PEX10 | ['AGAAACCCCTGTGCACCCTGTGCCYGGAG GAGCGCAGGCACCCAACAGCC'] |
| 2333 | NM_153818.1(PEX10): c.2T > C (p.Met1Thr) | 5192 | PEX10 | ['TCGGGACCACCCGAACCCGCGGCCAYGGCC CCGGCCGCCGCCAGCCCCCG'] |
| 2334 | NM_014305.3(TGDS): c.700T > C (p.Tyr234His) | 23483 | TGDS | ['AATGCTTCTACAACATCAGTAGCATRAAGG AAGTTTCTTGTTTGAAGCCCT'] |
| 2335 | NM_000256.3(MYBPC3): c.2994 + 2T > C | 4607 | MYBPC3 | ['GTGAACCTTCTCATCCCTTTCCAGGYGGGAC TGGCCCCCTTCCCTGTCCCC'] |
| 2336 | NM_000256.3(MYBPC3): c.1624 + 2T > C | 4607 | MYBPC3 | ['CTCATGTGCCCCCCCAGCCAGGCTCDCCCTG CACAATGAGCTCAGCCAGCG'] |
| 2337 | NM_000257.3(MYH7): c.2207T > C (p.Ile736Thr) | 4625 | MYH7 | ['GCGGCCATCCCTGAGGGACAGTTCAHTGAT AGCAGGAAGGGGGCAGAGAAG'] |
| 2338 | NM_000138.4(FBN1): c.7754T > C (p.Ile2585Thr) | 2200 | FBN1 | ['TGCCAGCATGGCTGCCAGAACATCAYTGGG GGCTACAGGTGCAGCTGCCCC'] |
| 2339 | NM_000371.3(TTR): c.190T > C (p.Phe64Leu) | 7276 | TTR | ['GGCTGCTGATGACACCTGGGAGCCAYTTGC CTCTGGGTAAGTTGCCAAAGA'] |
| 2340 | NM_000126.3(ETFA): c.2T > C (p.Met1Thr) | 2108 | ETFA | ['GAGGTTGCGGCGGAAGCGGAGACCAYGTTC CGAGCGGCGGCTCCGGGGCAG'] |
| 2341 | NM_006493.2(CLN5): c.2T > C (p.Met1Thr) | 1203 | CLN5 | ['GCGGGCCGGCGCGGGGAGGTGTCAYGCGC CGGAACCTGCGCTTGGGGCCA'] |
| 2342 | NM_000543.4(SMPD1): c.475T > C (p.Cys159Arg) | 6609 | SMPD1 | ['CTCAGTGCTGAGCCCATCTGAGGCCYGTGGC CTGCTCCTGGGCTCCACCTG'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 2343 | NM_000501.3(ELN): c.889 + 2T > C | 2006 | ELN | ['TTCCTGGAATTGGAGGCATCGCAGGYAACA TCTGTCCCAGCAGGGGCGGG'] |
| 2344 | NM_000169.2(GLA): c.758T > C (p.Ile253Thr) | -1 | — | ['TGGACATCTTTTAACCAGGAGAGAAYTGTTG ATGTTGCTGGACCAGGGGGT'] |
| 2345 | NM_152743.3(BRAT1): c.176T > C (p.Leu59Pro) | 221927 | BRAT1 | ['GAGCACCCCTGCCTGGTGGAGCTGCYGTCCC ATGTGCTGAAAGTCCAGGAC'] |
| 2346 | NM_000152.3(GAA): c.896T > C (p.Leu299Pro) | 2548 | GAA | ['CTCTACGGGTCTCACCCTTTCTACCBGGCGC TGGAGGACGGCGGGTCGGCA'] |
| 2347 | NM_015384.4(NIPBL): c.7637T > C (p.Leu2546Pro) | 25836 | N1PBL | ['AATGTGTCCCAGGGTATTTTATTACYTCTCA TGTTAAAACAACATTTGAAG'] |
| 2348 | NM_005641.3(TAF6): c.212T > C (p.Ile71Thr) | 6878 | TAF6 | ['ATTCTTTAGCTTCAAGGCGTAGTCADTGTCA CTGGTGGTGAGCTTCTGCCG'] |
| 2349 | NM_170707.3(LMNA): c.710T > C (p.Phe237Ser) | 4000 | LMNA | ['ATTGACAATGGGAAGCAGCGTGAGTYTGAG AGCCGGCTGGCGGATGCGCTG'] |
| 2350 | NM_000527.4(LDLR): c.1468T > C (p.Trp490Arg) | 3949 | LDLR | ['GGACTGGATCCACAGCAACATCTACYGGAC CGACTCTGTCCTGGGCACTGT'] |
| 2351 | NM_000081.3(LYST): c.772T > C (p.Cys258Arg) | 1130 | LYST | ['CATGAACAATTCTCCATTTGACTTAYGTCAT GTTTTGTTATCTTTATTAGA'] |
| 2352 | NM_000256.3(MYBPC3): c.3796T > C (p.Cys1266Arg) | 4607 | MYBPC3 | ['CTTACAGGGCGAGGCACGGTGTGAGYGCCG CCTGGAGGTGCGAGGTGAGGA'] |
| 2353 | NM_000256.3(MYBPC3): c.3713T > C (p.Leu1238Pro) | 4607 | MYBPC3 | ['TTCAGCAAGCAGGGAGTGTTGACTCYGGAG ATTAGAAAGCCCTGCCCCTTT'] |
| 2354 | NM_000256.3(MYBPC3): c.3330 + 2T > C | 4607 | MYBPC3 | ['CAGAAAGCCGACAAGAAGACCATGGBGAGC CCAGGGTCTGGGGTCCCCACG'] |
| 2355 | NM_000256.3(MYBPC3): c.1696T > C (p.Cys566Arg) | 4607 | MYBPC3 | ['CGCAAAGGACCAGGCGGTGTTCAAAYGTGA GGTCTCAGATGAGAATGTTCG'] |
| 2356 | NM_000256.3(MYBPC3): c.1456T > C (p.Trp486Arg) | 4607 | MYBPC3 | ['ATCGGAGGAGGGGCGCAAGTCAAABGGTG AGTTCCAGAAGCACGGGGCAT'] |
| 2357 | NM_000256.3(MYBPC3): c.709T > C (p.Tyr237His) | 4607 | MYBPC3 | ['TGCCCAGCCTGCCTTCACTGGCAGCYACCGC TGTGAGGTGTCCACCAAGGA'] |
| 2358 | NM_000256.3(MYBPC3): c.467T > C (p.Leu156Pro) | 4607 | MYBPC3 | ['GGAGCCCCCGATGACCCCATTGGCCYCTTCG TGATGCGGCCACAGGATGGC'] |
| 2359 | NM_000257.3(MYH7): c.2723T > C (p.Leu908Pro) | 4625 | MYH7 | ['GATGCTGAGGAGCGCTGTGATCAGCYGATC AAAAACAAGATTCAGCTGGAG'] |
| 2360 | NM_000257.3(MYH7): c.2479T > C (p.Trp827Arg) | 4625 | MYH7 | ['TCGGGCCTTCATGGGGTCAAGAATYGGCC CTGGATGAAGCTCTACTTCAA'] |
| 2361 | NM_000257.3(MYH7): c.1400T > C (p.Ile467Thr) | 4625 | MYH7 | ['GTCCTGGACATCGCTGGCTTCGAGAYCTTCG ATGTGAGTTGGGACCCCTGG'] |
| 2362 | NM_000257.3(MYH7): c.1048T > C (p.Tyr350His) | 4625 | MYH7 | ['CACTTCAGAGGAGAAAAACTCCATGYATAA GCTGACAGGCGCCATCATGCA'] |
| 2363 | NM_000257.3(MYH7): c.730T > C (p.Phe244Leu) | 4625 | MYH7 | ['CGTCCGGAACGACAACTCCTCCCGCYTCGTG AGTGGTCCCTGACCTTGGCC'] |
| 2364 | NM_005159.4(ACTC1): c.755T > C (p.Ile252Thr) | -1 | — | ['CTGCCTGATGGCCAAGTCATCACTAYTGGCA ATGAGCGCTTCCGCTGTCCT'] |
| 2365 | NM_030662.3(MAP2K2): c.169T > C (p.Phe57Leu) | 5605 | MAP2K2 | ['GCAGCAGAAGAAGCGGCTGGAAGCCNTTCT CACCCAGAAAGCCAAGGTCGG'] |
| 2366 | NM_000169.2(GLA): c.41T > C (p.Leu14Pro) | -1 | — | ['CCAGAACTACATCTGGGCTGCGCGCYTGCG CTTCGCTTCCTGGCCCTCGTT'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 2367 | NM_002294.2(LAMP2):c.864 + 2T > C | 3920 | LAMP2 | ['TATCTAGACTTTGTCTTTGCTGTGGYGAGTA ACAGATTTTTAAAGTTAGG'] |
| 2368 | NM_000551.3(VHL):c.227T > C (p.Phe76Ser) | 7428 | VHL | ['TCGCGCGAGCCCTCCCAGGTCATCTYCTGCA ATCGCAGTCCGCGCGTCGTG'] |
| 2369 | NM_000551.3(VHL):c.266T > C (p.Leu89Pro) | 7428 | VHL | ['CCGCGCGTCGTGCTGCCCGTATGGCHCAACT TCGACGGCGAGCCGCAGCCC'] |
| 2370 | NM_000551.3(VHL):c.473T > C (p.Leu158Pro) | 7428 | VHL | ['GTTTTTGCCCTTCCAGTGTATACTCHGAAAG AGCGATGCCTCCAGGTTGTC'] |
| 2371 | NM_000051.3(ATM):c.8584 + 2T > C | −1 | — | ['GCAGTGTAGCTACTTCTTCTATTGGYAATCT TCTTGTACATATAGTAGATT'] |
| 2372 | NM_058216.2(RAD51C):c.404 + 2T > C | 5889 | RAD51C | ['AGGTGTTGGAAAAACACAATTATGGYAAAA TAAAGTGTTCTCCTTTTAAGG'] |
| 2373 | NM_000455.4(STK11):c.545T > C (p.Leu182Pro) | 6794 | STK11 | ['CACAAGGACATCAAGCCGGGGAACCYGCTG CTCACCACCGGTGGCACCCTC'] |
| 2374 | NM_001199107.1(TBC1D24):c.313T > C (p.Cys105Arg) | 57465 | TBC1D24 | ['GGACAACACGCAGGTGCCCAGCTACYGCCT GAATGCACGCGGCGAGGGGGC'] |
| 2375 | NM_000899.4(KITLG):c.98T > C (p.Val33Ala) | 4254 | KITLG | ['ACTGAAGGGATCTGCAGGAATCGTGYGACT AATAATGTAAAAGACGTCACT'] |
| 2376 | NM_001195129.1(PRSS56):c.1183T > C (p.Cys395Arg) | 646960 | PRSS56 | ['GCAGTGCCTGCAGCGCCGGCGGCGAYGCGG TCAGTTCTGTTCACCCGGACC'] |
| 2377 | NM_006888.4(CALM1):c.268T > C (p.Phe90Leu) | 801 | CALM1 | ['TAGTGAAGAAGAAATCCGTGAGGCAYTCCG AGTCTTTGACAAGGTAATCCA'] |
| 2378 | NM_017534.5(MYH2):c.5609T > C (p.Leu1870Pro) | −1 | — | ['GAAGATAGAAAGAATATTCTCAGGCYTCAA GATTTGGTAGATAAACTTCAG'] |
| 2379 | NM_003000.2(SDHB):c.574T > C (p.Cys192Arg) | 6390 | SDHB | ['CTACGAGTGCATTCTCTGTGCCTGCYGTAGC ACCAGCTGCCCCAGCTACTG'] |
| 2380 | NM_000314.6(PTEN):c.406T > C (p.Cys136Arg) | 5728 | PTEN | ['AAAGGGACGAACTGGTGTAATGATAYGTGC ATATTTATTACATCGGGGCAA'] |
| 2381 | NM_000051.3(ATM):c.2T > C (p.Met1Thr) | 472 | ATM | ['ATGTGTGTTCTGAAATTGTGAACCAYGAGTC TAGTACTTAATGATCTGCTT'] |
| 2382 | NM_052867.2(NALCN):c.1526T > C (p.Leu509Ser) | 259232 | NALCN | ['GGTCCTGGAAAAAAGCTTGGGAGTTYGGTT GTATTTACTGCCAGCCTCTTG'] |
| 2383 | NM_000314.6(PTEN):c.545T > C (p.Leu182Ser) | 5728 | PTEN | ['TATGTGTATTATTATAGCTACCTGTYAAAGA ATCATCTGGATTATAGACCA'] |
| 2384 | NM_005957.4(MTHFR):c.1969T > C (p.Ter657Arg) | 4524 | MTHFR | ['ACGCAGGGCGTCAGGACGCAGGGTCRTGGA GCCTCCGTTTCTCTCGCATTC'] |
| 2385 | NM_005957.4(MTHFR):c.1883T > C (p.Leu628Pro) | 4524 | MTHFR | ['AACCTGGTGGACAATGACTTCCCACYGGAC AACTGCCTCTGGCAGGTGGTG'] |
| 2386 | NM_005957.4(MTHFR):c.1793T > C (p.Leu598Pro) | 4524 | MTHFR | ['CTGTGGATTGAGCGGTGGGGAAAGCYGTAT GAGGAGGAGTCCCCGTCCCGC'] |
| 2387 | NM_005957.4(MTHFR):c.1530 + 2T > C | 4524 | MTHFR | ['AGCGGGGCTATGTCTTCCAGAAGGYGTGG TAGGGAGGCACGGGGTGCCCC'] |
| 2388 | NM_005957.4(MTHFR):c.388T > C (p.Cys130Arg) | 4524 | MTHFR | ['CCTGGAGACCATCCTGCACATGACCYGCTGC CGTCAGCGCCTGGAGGAGAT'] |
| 2389 | NM_000264.3(PTCH1):c.3168 + 2T > C | 5727 | PTCH1 | ['AACCCCTGGACGGCCGGGATCATTGYGAGT GTATTATAAGGGGCTTTGTGG'] |
| 2390 | NM_000030.2(AGXT):c.302T > C (p.Leu101Pro) | 189 | AGXT | ['GTGCTGGAGCCTGGGGACTCCTTCCYGGTTG GGGCCAATGGCATTTGGGGG'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 2391 | NM_000030.2(AGXT): c.322T > C (p.Trp108Arg) | 189 | AGXT | ['CTTCCTGGTTGGGGCCAATGGCATTYGGGGG CAGCGAGCCGTGGACATCGG'] |
| 2392 | NM_000023.2(SGCA): c.371T > C (p.Ile124Thr) | 6442 | SGCA | ['ACTCGGCAGAGGCTGGTGCTGGAGAYTGGG GACCCAGAAGGTACCTCTAGC'] |
| 2393 | NM_016035.4(COQ4): c.155T > C (p.Leu52Ser) | 51117 | COQ4 | ['CGCCATCGCCGCGGAGCCGGCGGCCRACAG CCCTTTCTGCAGCGGGGAGGT'] |
| 2394 | NM_000510.2(FSHB): c.298T > C (p.Cys100Arg) | 2488 | FSHB | ['GTATACATACCCAGTGGCCACCCAGYGTCA CTGTGGCAAGTGTGACAGCGA'] |
| 2395 | NM_007374.2(SIX6): c.110T > C (p.Leu37Pro) | 4990 | SIX6 | ['CGCCTGGGTCGCTTCCTCTGGTCGCYGCCCG TGGCCCCTGCGGCCTGCGAG'] |
| 2396 | NM_000314.6(PTEN): c.202T > C (p.Tyr68His) | 5728 | PTEN | ['AAAGCATAAAAACCATTACAAGATAHACAA TCTGTAAGTATGTTTTCTTAT'] |
| 2397 | NM_001103.3(ACTN2): c.683T > C (p.Met228Thr) | 88 | ACTN2 | ['GAGAAGCACCTGGATATTCCTAAAAYGTTG GATGCTGAAGGTGAGATGAAA'] |
| 2398 | NM_005249.4(FOXG1): c.700T > C (p.Ser234Pro) | 2290 | FOXG1 | ['GCAGAACTCCATCCGCCACAATCTGYCCCTC AACAAGTGCTTCGTGAAGGT'] |
| 2399 | NM_001165963.1(SCN1A): c.4055T > C (p.Leu1352Pro) | -1 | — | ['ATTCCATCCATCATGAATGTGCTTCYGGTTT GTCTTATATTCTGGCTAATT'] |
| 2400 | NM_001165963.1(SCN1A): c.2690T > C (p.Leu897Ser) | 6323 | SCN1A | ['GCTCTGGGAAATTTAACCCTCGTCTYGGCCA TCATCGTCTTCATTTTTGCC'] |
| 2401 | NM_001165963.1(SCN1A): c.1265T > C (p.Val422Ala) | 6323 | SCN1A | ['CTAATAAATTTGATCCTGGCTGTGGHGGCCA TGGCCTACGAGGAACAGAAT'] |
| 2402 | NM_001165963.1(SCN1A): c.1033T > C (p.Cys345Arg) | 6323 | SCN1A | ['TTTCTTTTACCCCACTTGCAGCCAAYGTCCA GAGGGATATATGTGTGTGAA'] |
| 2403 | NM_001165963.1(SCN1A): c.769T > C (p.Cys257Arg) | 6323 | SCN1A | ['AGATGTAATGATCCTGACTGTGTTCYGTCTG AGCGTATTTGCTCTAATTGG'] |
| 2404 | NM_001165963.1(SCN1A): c.323T > C (p.Leu108Pro) | 6323 | SCN1A | ['TTCCGGTTCAGTGCCACCTCTGCCCYGTACA TTTTAACTCCCTTCAATCCT'] |
| 2405 | NM_000426.3(LAMA2): c.8282T > C (p.Ile2761Thr) | 3908 | LAMA2 | ['GCAGAATCAGAACCAGCTCTTTTGAYAGGG AGCAAGCAGTTCGGGCTTTCA'] |
| 2406 | NM_001199.3(BMP1): c.*241T > C | 649 | BMP1 | ['GTCTGTGACATTTCCTGTTGTGAAGYAAAAG AGGGACCCCTGCGTCCTGCT'] |
| 2407 | NM_001987.4(ETV6): c.1046T > C (p.Leu349Pro) | 2120 | ETV6 | ['CTTTGGGATTACGTCTATCAGTTGCYTTCTG ACAGCCGGTACGAAAACTTC'] |
| 2408 | NM_004974.3(KCNA2): c.788T > C (p.Ile263Thr) | 3737 | KCNA2 | ['ATGAACATCATTGACATTGTGGCCAYCATCC CCTACTTCATCACCCTGGGG'] |
| 2409 | NM_002055.4(GFAP): c.791T > C (p.Leu264Pro) | 2670 | GFAP | ['GTGTCCCCCACCTAGTTTGCAGACCYGACAG ACGCTGCTGCCCGCAACGCG'] |
| 2410 | NM_002055.4(GFAP): c.239T > C (p.Phe80Ser) | 2670 | GFAP | ['GAGATGATGGAGCTCAATGACCGCTYTGCC AGCTACATCGAGAAGGTTCGC'] |
| 2411 | NM_002055.4(GFAP): c.218T > C (p.Met73Thr) | 2670 | GFAP | ['ACCCGGGCCAGTGAGCGGGCAGAGADGATG GAGCTCAATGACCGCTTTGCC'] |
| 2412 | NM_001288953.1(TTC7A): c.1912T > C (p.Ser638Pro) | 57217 | TTC7A | ['TTTGCCTGATGCCCATGATGCAGACYCTGGT AAGAACGAGCTCCTTGGGCC'] |
| 2413 | NM_000257.3(MYH7): c.5117T > C (p.Leu1706Pro) | -1 | — | ['TCCCGGAAGCTGCGGAGCAGGAGCYGATT GAGACTAGTGAGCGGGTGCAG'] |
| 2414 | NM_000257.3(MYH7): c.4772T > C (p.Leu1591Pro) | -1 | — | ['ATGGAACAGGCCAAGCGCAACCACCWGCG GGTGGTGGACTCGCTGCAGACC'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 2415 | NM_016218.2(POLK): c.609T > C (p.Asn203=) | 51426 | POLK | ['TGAGTCTTGATGAAGCCTACTTGAAYATAAC AAAGCACTTAGAAGAAAGAC'] |
| 2416 | NM_016218.2(POLK): c.*66T > C | 51426 | POLK | ['TATTTTATAATCAATGAATTTGTTCYTTCTGA TTTTAAGTTTGCAGATTTA'] |
| 2417 | NM_015662.2(1FT172): c.770T > C (p.Leu257Pro) | 26160 | 1FT172 | ['AGTCCTGGGGGCCAGTCTGTTGTGCYAGGA AGTTATGACAGGTAAGTCCCC'] |
| 2418 | NM_178454.4(DRAM2): c.79T > C (p.Tyr27His) | 128338 | DRAM2 | ['GACATCTGCTGCTTTCATATTTTCAYACATT ACTGCAGTAACACTCCACCA'] |
| 2419 | NM_032790.3(ORAI1): c.581T > C (p.Leu194Pro) | 84876 | ORAI1 | ['CTCTTCCTAGCTGAGGTGGTGCTGCYCTGCT GGGTCAAGTTCTTGCCCCTC'] |
| 2420 | NM_001135669.1(XPR1): c.434T > C (p.Leu145Pro) | 9213 | XPR1 | ['GAGTTCTACCTCAGTCTAATCCTGCYGCAGA ACTATCAGGTACTTAGATTC'] |
| 2421 | NM_001135669.1(XPR1): c.419T > C (p.Leu140Pro) | 9213 | XPR1 | ['AAACTGGCCTTCAGTGAGTTCTACCYCAGTC TAATCCTGCTGCAGAACTAT'] |
| 2422 | NM_001135669.1(XPR1): c.653T > C (p.Leu218Ser) | 9213 | XPR1 | ['GACAGACAAAAGGCTATGAAGCGTTYACGT GTCCCCCCTTTGGGAGCTGCT'] |
| 2423 | NM_005859.4(PURA): c.218T > C (p.Phe73Ser) | 5813 | PURA | [CGGGTGGACATCCAGAACAAGCGCTYCTAC CTGGACGTGAAGCAGAACGCC'] |
| 2424 | NM_005859.4(PURA): c.563T > C (p.Ile 188Thr) | 5813 | PURA | ['CTGGGCTCCACGCAGGGCCAGACCAYTGCG CTGCCCGCGCAGGGGCTCATC'] |
| 2425 | NM_001399.4(EDA): c.396+2T > C | 1896 | EDA | ['TCTGACTCCCAGGACGGGCACCAGGKGAGT CACCTAGTAGGGGCGGCGCG'] |
| 2426 | NM_001848.2(COL6A1): c.957 + 2T > C | 1291 | COL6A1 | ['TCCAGGGGACCCAAGGGCTACAAGGYGAGC GTGGGCTGCTGGGAGGGGGA'] |
| 2427 | NM_000454.4(SOD1): c.341T > C (p.Ile114Thr) | 6647 | SOD1 | ['TCACTCTCAGGAGACCATTGCATCAYTGGCC GCACACTGGTGGTAAGTTTT'] |
| 2428 | NM_020451.2(SEPN1): c.872 + 2T > C | 57190 | SEPN1 | ['CTTCTACTACACTGTGATGTTCCGGYGAGTG GGCCACACTGGCTGGCCTGG'] |
| 2429 | NM_004453.3 (ETFDH): c.1001T > C (p.Leu334Pro) | 2110 | ETFDH | ['GGTCTAGACTATCAGAATCCATACCYGAGTC CATTTAGAGAGTTCCAAAGG'] |
| 2430 | NM_198056.2(SCN5A): c.4299 + 6T > C | 6331 | SCN5A | ['CAGCTGTGGACTCCAGGGGGGTAGGYTGCC ACAGTGGCTTCTTCCACCAAG'] |
| 2431 | NM_198056.2(SCN5A): c.2291T > C (p.Met764Thr) | 6331 | SCN5A | ['TTCAGGGGATTTTCACAGCAGAGABGACCT TCAAGATCATTGCCCTCGAC'] |
| 2432 | NM_198056.2(SCN5A): c.2047T > C (p.Cys683Arg) | 6331 | SCN5A | ['AGAGTTAGAGGAGTCTCGCCACAAGBGTCC ACCATGCTGGAACCGTCTCGC'] |
| 2433 | NM_004415.2(DSP): c.4961T > C (p.Leu1654Pro) | 1832 | DSP | ['GAAAAGCAGAGGACCCAGGAAGAGCYGAG GAGGCTCTCTTCTGAGGTCGAG'] |
| 2434 | NM_000238.3(KCNH2): c.2396T > C (p.Leu799Pro) | 3757 | KCNH2 | ['CGGGGCGACGTCGTCGTGGCCATCCYGGGT ATGGGGTGGGGGCGGGCACT'] |
| 2435 | NM_000238.3(KCNH2): c.2366T > C (p.Ile789Thr) | 3757 | KCNH2 | ['TTCATCTCCCGGGGCTCCATCGAGAYCCTGC GGGGCGACGTCGTCGTGGCC'] |
| 2436 | NM_000238.3(KCNH2): c.1945 + 6T > C | 3757 | KCNH2 | ['CTGCGTCATGCTCATTGGCTGTGAGYGTGCC CAGGGGCGGGCGGCGGGGAG'] |
| 2437 | NM_000238.3(KCNH2): c.1918T > C (p.Phe640Leu) | 3757 | KCNH2 | ['TCCCAACACCAACTCAGAGAAGATCBTCTCC ATCTGCGTCATGCTCATTGG'] |
| 2438 | NM_000238.3(KCNH2): c.1282T > C (p.Ser428Pro) | 3757 | KCNH2 | ['CTACACGGCTGTCTTCACACCCTACYCGGCT GCCTTCCTGCTGAAGGAGAC'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 2439 | NM_000238.3(KCNH2): c.125T > C (p.Ile42Thr) | 3757 | KCNH2 | ['GCTCGGGTGGAGAACTGCGCCGTCAHCTAC TGCAACGACGGCTTCTGCGAG'] |
| 2440 | NM_000218.2(KCNQ1): c.1025T > C (p.Leu342Pro) | 3784 | KCNQ1 | ['GTCTTTGCCATCTCCTTCTTTGCGCYCCCAGC GGTAGGTGCCCCGTGGGTG'] |
| 2441 | NM_000218.2(KCNQ1): c.1251 + 2T > C | 3784 | KCNQ1 | ['CCCAAACCCAAGAAGTCTGTGGTGGYGAGT AGCCCACCTGCCACCAGGGCA'] |
| 2442 | NM_130799.2(MEN1): c.547T > C (p.Trp183Arg) | 4221 | MEN1 | ['CCTCGCCCTGTCTGAGGATCATGCCYGGGTA GTGTTTGGGCCCAATGGGGA'] |
| 2443 | NM_000138.4(FBN1): c.7531T > C (p.Cys2511Arg) | 2200 | FBN1 | ['CACCATTGGCGGCTTCACATGCAAAYGTCCT CCCGGATTTACCCAACACCA'] |
| 2444 | NM_000138.4(FBN1): c.7111T > C (p.Trp2371Arg) | 2200 | FBN1 | ['ATGCTGCTGTGACGGAGGGAGAGGCYGGGG TCCCCACTGTGAGATCTGCCC'] |
| 2445 | NM_000138.4(FBN1): c.6274T > C (p.Trp2092Arg) | 2200 | FBN1 | ['CTGCTGTGCCTTGAAGGGAGAAGGCYGGGG AGACCCCTGCGAGCTCTGCCC'] |
| 2446 | NM_000138.4(FBN1): c.5746T > C (p.Cys1916Arg) | 2200 | FBN1 | ['CACAATTGGTTCCTTCAACTGCCGCYGCAAT CATGGTTTCATCCTTTCTCA'] |
| 2447 | NM_000138.4(FBN1): c.5726T > C (p.Ile1909Thr) | 2200 | FBN1 | ['GGGAATGGAACTTGCCGGAACACAAYTGGT TCCTTCAACTGCCGCTGCAAT'] |
| 2448 | NM_000138.4(FBN1): c.1468 + 2T > C | 2200 | FBN1 | ['TGGACCTCCGTGGGGAGTGTATTGGYACGT GATCCATCCTAGGTTGGCACC'] |
| 2449 | NM_004572.3(PKP2): c.2386T > C (p.Cys796Arg) | 5318 | PKP2 | ['TCTCATTGAAACTACAGCCTCTGCCYGTTAC ACATTGAACAACATAATCCA'] |
| 2450 | NM_004333.4(BRAF): c.1783T > C (p.Phe595Leu) | 673 | BRAF | ['AGACCTCACAGTAAAAATAGGTGATYTTGG TCTAGCTACAGTGAAATCTCG'] |
| 2451 | NM_000543.4(SMPD1): c.416T > C (p.Leu139Pro) | 6609 | SMPD1 | ['GCCGTGTGCCAATCCATTGTCCACCYCTTTG AGGATGACATGGTGGAGGTG'] |
| 2452 | NM_000016.5(ACADM): c.698T > C (p.Ile233Thr) | 34 | ACADM | ['GAAGCAGATACCCCAGGAATTCAGAHTGGG AGAAAGGTAAAGTATTTATTA'] |
| 2453 | NM_004453.3(ETFDH): c.1852T > C (p.Ter618Gln) | 2110 | ETFDH | ['AGGAGGACCTGCTTACAATGGAATGYAAAC TGCAGCTAGCCAGTTTCTTTC'] |
| 2454 | NM_000255.3(MUT): c.842T > C (p.Leu281Ser) | 4594 | MUT | [GCCATTCTGGAGCTGGCCTATACTTYAGCAG ATGGATTGGAGTACTCTAGA'] |
| 2455 | NM_000277.1(PAH): c.2T > C (p.Met1Thr) | 5053 | PAH | ['AGACCTCACTCCGGGGAGCCAGCABGTCC ACTGCGGTCCTGGAAACCCA'] |
| 2456 | NM_000017.3(ACADS): c.1057T > C (p.Ser353Pro) | 35 | ACADS | ['GGCAGCCATGGCCAAGCTGGCCGCCYCGGA GGCCGCGACCGCCATCAGCCA'] |
| 2457 | NM_002225.3(IVD): c.295 + 2T > C | 3712 | IVD | ['GCGTATTGGGCATCACAGCCCCTGGYGAGT ATAGTGTCTTTCCCTAAAAAG'] |
| 2458 | NM_000030.2(AGXT): c.2T > C (p.Met1Thr) | 189 | AGXT | ['CGAGCGGCAGGTTGGGTGCGGACCAYGGCC TCTCACAAGCTGCTGGTGACC'] |
| 2459 | NM_000030.2(AGXT): c.77T > C (p.Leu26Pro) | 189 | AGXT | ['CTCTCCATCCCCAACCAGCTCCTGCYGGGGC CTGGTCCTTCCAACCTGCCT'] |
| 2460 | NM_000030.2(AGXT): c.449T > C (p.Leu150Pro) | 189 | AGXT | ['GGCCTGGCCCAGCACAAGCCAGTGCYGCTG TTCTTAACCCACGGGGAGTCG'] |
| 2461 | NM_000030.2(AGXT): c.497T > C (p.Leu166Pro) | 189 | AGXT | ['TCGTCCACCGGCGTGCTGCAGCCCCHTGATG GCTTCGGGGAACTCTGCCAC'] |
| 2462 | NM_000030.2(AGXT): c.661T > C (p.Ser221Pro) | 189 | AGXT | ['CGCCCCTCCAGGGACCTCGCTCATCYCCTTC AGTGACAAGGCCAAGTGAGT'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 2463 | NM_000030.2(AGXT): c.757T > C (p.Cys253Arg) | 189 | AGXT | ['CAAGTGGCTGGCCAACTTCTGGGGCYGTGA CGACCAGCCCAGGATGTGAGG'] |
| 2464 | NM_000030.2(AGXT): c.806T > C (p.Leu269Pro) | 189 | AGXT | ['CATCACACAATCCCCGTCATCAGCCYGTACA GCCTGAGAGAGAGCCTGGCC'] |
| 2465 | NM_000030.2(AGXT): c.851T > C (p.Leu284Pro) | 189 | AGXT | ['CCAGCGCCATCTCCCACACAGGGCCYGGAG AACAGCTGGCGCCAGCACCGC'] |
| 2466 | NM_000030.2(AGXT): c.893T > C (p.Leu298Pro) | 189 | AGXT | ['CAGCACCGCGAGGCCGCGGCGTATCYGCAT GGGCGCCTGCAGGCACTGGGG'] |
| 2467 | NM_000030.2(AGXT): c.947T > C (p.Leu316Pro) | 189 | AGXT | ['TGAGCCAGGCCCCTCCTGCAGGCGCYCCGG CTTCCCACAGTCACCACTGTG'] |
| 2468 | NM_000030.2(AGXT): c.1076T > C (p.Leu359Pro) | 189 | AGXT | ['AGCCCGCCCTGTGCCCCCCAGGTGCYGCGG ATCGGCCTGCTGGGCTGCAAT'] |
| 2469 | NM_000030.2(AGXT): c.1151T > C (p.Leu384Pro) | 189 | AGXT | ['GTGACGGAGGCCCTGAGGGCGGCCCYGCAG CACTGCCCCAAGAAGAAGCTG'] |
| 2470 | NM_012203.1(GRHPR): c.203T > C (p.Leu68Pro) | 9380 | GRHPR | ['TCCGACCACGTGGACAAGAGGATCCYGGAT GCTGCAGGTGCACACTGGGTG'] |
| 2471 | NM_012203.1(GRHPR): c.965T > C (p.Met322Thr) | 9380 | GRHPR | ['CTGGCTGGCCTGAGAGGGGAGCCGABGCCT AGTGAACTCAAGCTGTAGCCA'] |
| 2472 | NM_138413.3(HOGA1): c.533T > C (p.Leu178Pro) | 112817 | HOGA1 | ['GTCCCAGCCAACACAGGGCTGGACCYGCCT GTGGATGCAGTGGTCACGCTT'] |
| 2473 | NM_138413.3(HOGA1): c.875T > C (p.Met292Thr) | 112817 | HOGA1 | ['GGGATCCCAGGGCTGAAGAAAATCAYGGAC TGGTTTGGCTACTATGGAGGC'] |
| 2474 | NM_004370.5(COL12A1): c.7001T > C (p.Ile2334Thr) | 1303 | COL12A1 | ['TTCTTGACTGATGCCTCCTGGAGCAYTGGGG ACGATAATTTTAACAAAGTT'] |
| 2475 | NM_019074.3(DLL4): c.583T > C (p.Phe195Leu) | 54567 | DLL4 | ['CCTGTGCAAGAAGCGCAATGACCACYTCGG CCACTATGTGTGCCAGCCAGA'] |
| 2476 | NM_019074.3(DLL4): c.1168T > C (p.Cys390Arg) | 54567 | DLL4 | ['CCAGGGGGCCAACTATGCTTGTGAAYGTCC CCCCAACTTCACCGGCTCCAA'] |
| 2477 | NM_015909.3(NBAS): c.3164T > C (p.Leu1055Pro) | 51594 | NBAS | ['TCAGAGCTTTTGGAAAAACATGGACYCGAG AAACCAATTTCATTTGTTAAA'] |
| 2478 | NM_000263.3(NAGLU): c.1208T > C (p.Ile403Thr) | 4669 | NAGLU | ['GCCTCCTTCCAGGGCCAGCCCTTCAYCTGGT GCATGCTGCACAACTTTGGG'] |
| 2479 | NM_203290.2(POLR1C): c.436T > C (p.Cys146Arg) | 9533 | POLR1C | ['TCACAGTTTCGTCTCCAGGTCAGAYGCACT CGGAACCCCCATGCTGCTAA'] |
| 2480 | NM_018359.3(UFSP2): c.868T > C (p.Tyr290His) | −1 | — | [CCAGGGCATATATGGCTATCATCATYATATG CAGGATCGCATAGATGACAA'] |
| 2481 | NM_000310.3(PPT1): c.2T > C (p.Met1Thr) | 5538 | PPT1 | ['CCGCGGTCATGTGACACAGCGAAGAYGGCG TCGCCCGGCTGCCTGTGGCTC'] |
| 2482 | NM_021007.2(SCN2A): c.1271T > C (p.Val424Ala) | 6326 | SCN2A | ['CTAATAAATTTGATCTTGGCTGTGGYGGCCA TGGCCTATGAGGAACAGAAT'] |
| 2483 | NM_021007.2(SCN2A): c.2306T > C (p.Ile769Thr) | 6326 | SCN2A | ['GTTGACCTGGCCATCACCATCTGCAYTGTCT TAAATACACTCTTCATGGCT'] |
| 2484 | NM_021007.2(SCN2A): c.4308+2T > C | 6326 | SCN2A | ['TATGCAGCTGTTGATTCACGAAATGYAAGTC TAGTTAGAGGGAAATTGTTT'] |
| 2485 | NM_021007.2(SCN2A): c.4718T > C (p.Leu1573Pro) | 6326 | SCN2A | ['TGGATTAATCTGGTGTTTATTGTTCYGTTCA CTGGAGAATGTGTGCTGAAA'] |
| 2486 | NM_001165963.1(SCN1A): c.5567T > C (p.Met1856Thr) | −1 | — | ['CAGCTCATTGCCATGGATTTGCCCAHGGTGA GTGGTGACCGGATCCACTGT'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 2487 | NM_001165963.1(SCN1A): c.1094T > C (p.Phe365Ser) | 6323 | SCN1A | ['AATCCCAATTATGGCTACACAAGCTYTGATA CCTTCAGTTGGGCTTTTTTG'] |
| 2488 | NM_001165963.1(SCN1A): c.662T > C (p.Leu221Pro) | 6323 | SCN1A | ['TCGGCATTGAGAACATTCAGAGTTCYCCGA GCATTGAAGACGATTTCAGTC'] |
| 2489 | NM_000806.5(GABRA1): c.788T > C (p.Met263Thr) | 2554 | GABRA1 | ['ATTCAAACATACCTGCCATGCATAAYGACA GTGATTCTCTCACAAGTCTCC'] |
| 2490 | NM_014191.3(SCN8A): c.4889T > C (p.Leu1630Pro) | 6334 | SCN8A | ['GCCCGTATTGGGCGCATCTTGCGTCYGATCA AAGGCGCCAAAGGGATTCGT'] |
| 2491 | NM_005249.4(FOXG1): c.673T > C (p.Trp225Arg) | 2290 | FOXG1 | ['TTACTACCGCGAGAACAAGCAGGGCYGGCA GAACTCCATCCGCCACAATCT'] |
| 2492 | NM_017882.2(CLN6): c.486 + 2T > C | 54982 | CLN6 | ['AAGAATCTCAAGCCGGAGACGCTGGYGAGG CCACCTCCTGCTCCCTGCCTG'] |
| 2493 | NM_002693.2(POLG): c.1808T > C (p.Met603Thr) | 5428 | POLG | ['AGGGAAGCCATCCCAGGTAAGTGCCRTGAG TTTAGGTGTGACCCGCATCTG'] |
| 2494 | NM_002693.2(POLG): c.1283T > C (p.Leu428Pro) | 5428 | POLG | ['AGGCAGGTAGGAGACACCCATCTCCRGCAT GCCGGCCAGAGTCACTGGGTG'] |
| 2495 | NM_018129.3(PNPO): c.2T > C (p.Met1Thr) | 55163 | PNPO | ['GGGTCACGTGGCCGGCGGCCCCCCAYGACG TGCTGGCTGCGGGGCGTCACG'] |
| 2496 | NM_007254.3(PNKP): c.1029 + 2T > C | 11284 | PNKP | ['ACCCCCACCCCGCCCAGGGCCTCRCCGGA TCAAAGGCTGGGAGCTCGAA'] |
| 2497 | NM_172107.2(KCNQ2): c.583T > C (p.Ser195Pro) | 3785 | KCNQ2 | ['CTCCCAGGGCAACGTCTTTGCCACAYCTGCG CTCCGGAGCCTGCGCTTCCT'] |
| 2498 | NM_000026.2(ADSL): c.340T > C (p.Tyr114His) | 158 | ADSL | ['TATTCACCTTGGTGCTACTTCTTGCYATGTTG GAGACAATACTGTAGGCGC'] |
| 2499 | NM_000026.2(ADSL): c.1339T > C (p.Ser447Pro) | 158 | ADSL | [CCAGTTGGATCATTTACTGGATCCTYCTTCT TTCACTGGTCGTGCCTCCCA'] |
| 2500 | NM_001356.4(DDX3X): c.704T > C (p.Leu235Pro) | 1654 | DDX3X | ['GGGTCTGGAAAAACTGCAGCATTTCYGTTGC CCATCTTGAGTCAGATTTAT'] |
| 2501 | NM_001356.4(DDX3X): c.1175T > C (p.Leu392Pro) | 1654 | DDX3X | ['TAAAAATTTTTTTCTTTCAGATGCYGGCTC GTGATTTCTTAGATGAATAT'] |
| 2502 | NM_001356.4(DDX3X): c.1541T > C (p.Ile514Thr) | 1654 | DDX3X | ['GACATTTCAAATGTGAAACATGTTAYCAATT TTGACTTGCCAAGTGATATT'] |
| 2503 | NM_020533.2(MCOLN1): c.317T > C (p.Leu106Pro) | 57192 | MCOLN1 | ['ACCATCGCCTTCCGACACCTCTTCCYGCTGG GCTACTCGGACGGAGCGGAT'] |
| 2504 | NM_020533.2(MCOLN1): c.1340T > C (p.Leu447Pro) | 57192 | MCOLN1 | ['TACTGCTTCTGTGGCTGGATCGTGCYGGGGC CCTATCATGTGAAGGTACAT'] |
| 2505 | NM_000083.2(CLCN1): c.1283T > C (p.Phe428Ser) | 1180 | CLCN1 | ['CCCCGCGAAGCCATCAGTACTTTGTYTGACA ACAATACATGGGTGAAACAC'] |
| 2506 | NM_003995.3(NPR2): c.226T > C (p.Ser76Pro) | 4882 | NPR2 | ['CAGCTCCGAACTGGAAGGCGCCTGCYCTGA GTACCTGGCACCGCTGAGCGC'] |
| 2507 | NM_004700.3(KCNQ4): c.808T > C (p.Tyr270His) | 9132 | KCNQ4 | ['GGACGCCAACTCCGACTTCTCCTCCYACGCC GACTCGCTCTGGTGGGGAC'] |
| 2508 | NM_004700.3(KCNQ4): c.823T > C (p.Trp275Arg) | 9132 | KCNQ4 | ['CTTCTCCTCCTACGCCGACTCGCTCYGGTGG GGGACGGTGCGTGAGGGTCT'] |
| 2509 | NM_005097.3(LGI1): c.124T > C (p.Cys42Arg) | 9211 | LGI1 | ['GGGGAAGAAACCAGCGAAGCCAAAABGCCC TGCCGTGTGTACTTGTACCAA'] |
| 2510 | NM_005572.3(LMNA): c.936 + 2T > C | 4000 | LMNA | ['CAGCTCAGCCAGCTCCAGAAGCAGGYGATA CCCCACCTCACCCCTCTCTCC'] |

TABLE 6-continued

Diseases/disorders containing T to C Changes. The table includes human gene mutations that may be corrected by changing a cytosine (C) to a thymine (T). The gene name, gene symbol, and Gene ID are indicated.

| SEQ ID NO: | Name | Gene ID | Gene Symbol | Flanks |
|---|---|---|---|---|
| 2511 | NM_006009.3(TUBA1A): c.1226T > C (p.Val409Ala) | 7846 | TUBA | ['AAACGTGCCTTTGTTCACTGGTACGYTGGGG ' AAGGGGATGGAGGAAGGTGAG'] |
| 2512 | NM_001081550.1(THOC2): c.1313T > C (p.Leu438Pro) | 57187 | THOC2 | ['GACGTGTTCAATATGTTCTGTTACCYTGGTC CTCACCTTTCTCACGATCCC'] |
| 2513 | NM_001081550.1(THOC2): c.3034T > C (p.Ser1012Pro) | 57187 | THOC2 | ['ACATCAACAGAAAACTCCAAATTTTYCCAC ACTTCTTTGCTATGATCGAGT'] |
| 2514 | NM_001081550.1(THOC2): c.2399T > C (p.Ile800Thr) | 57187 | THOC2 | ['GATTATATAAAGCGAGTGCCTTCAAYTGATG TACTCTGTAATGAATTTCAT'] |
| 2515 | NM_001356.4(DDX3X): c.1520T > C (p.Ile507Thr) | 1654 | DDX3X | ['CAGGTAGCAGCAAGAGGACTGGACAYTTCA AATGTGAAACATGTTATCAAT'] |
| 2516 | NM_000158.3(GBE1): c.691 + 2T > C | 2632 | GBE1 | ['TGAATAAAAATCACAGTTATTACTTRCCAAG GCCTTTGATTCTTGGTAGTA'] |
| 2517 | NM_000719.6(CACNA1C): c.3497T > C (p.Ile1166Thr) | 775 | CACNA1C | ['ATGAACATCTTCGTGGGCTTCGTCAYCGTCA CCTTTCAGGAGCAGGGGGAG'] |
| 2518 | NM_001105.4(ACVR1): c.587T > C (p.Leu196Pro) | 90 | ACVR1 | ['TGTACATCAGGAAGTGGCTCTGGTCYTCCTT TTCTGGTACAAAGAACAGTG'] |
| 2519 | NM_024531.4(SLC52A2): c.935T > C (p.Leu312Pro) | 79581 | SLC52A2 | ['CCCTACGGGCGTCTGGCCTACCACCYGGCTG TGGTGCTGGGCAGTGCTGCC'] |
| 2520 | NM_033409.3(SLC52A3): c.224T > C (p.Ile75Thr) | 113278 | SLC52A3 | ['AGCTGCCTTTCCGAAGTGCCCATCAYCTTCA CCCTGCTGGGCGTGGGAACC'] |
| 2521 | NM_033409.3(SLC52A3): c.49T > C (p.Trp17Arg) | 113278 | SLC52A3 | ['GGTCTGCGTCTTCGGAATGGGCTCCYGGGTG ACCATCAATGGGCTCTGGGT'] |
| 2522 | NM_133433.3(NIPBL): c.6108 + 2T > C | 25836 | NIPBL | ['CCATACCTTACCACTAAATGTAGTGYAAGTA TAGAGCTGTCTTATTCTTGT'] |
| 2523 | NM_002397.4(MEF2C): c.2T > C (p.Met1Thr) | 4208 | MEF2C | ['CGTAATCTGAATCTTTTTTCTCCCCDTAGTCC CCGTTTTTCTTCTCTCTCT'] |
| 2524 | NM_000124.3(ERCC6): c.2551T > C (p.Trp851Arg) | 2074 | ERCC6 | ['AATACTCGCTGACCCTGCTTGTGCCRTATTT TCAACAAAGACTCAACAACA'] |
| 2525 | NM_000208.2(INSR): c.1610 + 2T > C | 3643 | INSR | ['GTTCATGCTGTTCTACAAAGAGGCGYAAGT AGAAGAGTTAGAGAGACGCTG'] |
| 2526 | NM_000071.2(CBS): c.325T > C (p.Cys109Arg) | 875 | CBS | ['CTCCCGCCCGCGTTGAAGAACTCACRCTTGG CCACTGGGAGGCAGAGATGA'] |
| 2527 | NM_004550.4(NDUFS2): c.875T > C (p.Met292Thr) | 4720 | NDUFS2 | ['CATTATGCTCTCCACAGTGGAGTGAYGCTTC GGGGCTCAGGCATCCAGTGG'] |
| 2528 | NM_003119.3(SPG7): c.2228T > C (p.Ile743Thr) | 6687 | SPG7 | ['AAGGAAGTGATAAACTATGAGGACAYTGAG GCTCTCATTGGCCCGCCGCCC'] |
| 2529 | NM_000546.5(TP53): c.584T > C (p.Ile195Thr) | 7157 | TP53 | ['CACACGCAAATTTCCTTCCACTCGGRTAAGA TGCTGAGGAGGGGCCAGACC'] |
| 2530 | NM_018972.2(GDAP1): c.347T > C (p.Met116Thr) | 54332 | GDAP1 | ['AGGTTAATGCCTGATAAAGAAAGCAKGTAT TACCCACGGGTACAACATTAC'] |
| 2531 | NM_000070.2(CAPN3): c.566T > C (p.Leu189Pro) | 825 | CAPN3 | ['TGCCTGCCAACGTACAACAATCAACYGGTTT TCACCAAGTCCAACCACCGC'] |
| 2532 | NM_000070.2(CAPN3): c.1117T > C (p.Trp373Arg) | 825 | CAPN3 | ['TTAATTCCTCCATTTTCCCACCAGAYGGAAG GACTGGAGCTTTGTGGACAA'] |
| 2533 | NM_181534.3(KRT25): c.950T > C (p.Leu317Pro) | 147183 | KRT25 | ['AAATTGTTCTTTTCATACCGTGGCTGGAGA GACTGAAGTTCAATTTCCAG'] |
| 2534 | NM_001002294.2(FMO3): c.560T > C (p.Val187Ala) | 2328 | FMO3 | ['CCAGGTGTATTCAATGGAAAGCGTGBCCTG GTGGTTGGCCTGGGGAATTCG'] |

TABLE 6-continued

Diseases/disorders containing T to C Changes. The table includes human gene
mutations that may be corrected by changing a cytosine (C) to a thymine (T). The gene
name, gene symbol, and Gene ID are indicated.

| SEQ ID NO: | Name | Gene ID | Gene Symbol | Flanks |
| --- | --- | --- | --- | --- |
| 2535 | NM_001080522.2(CC2D2A): c.1676T > C (p.Leu559Pro) | 57545 | CC2D2A | ['GAAATTCAAGCTGAAATAAGTGAACYGTTA GAAGAGCACACGGAGGAGTAC'] |
| 2536 | NM_001080522.2(CC2D2A): c.3596T > C (p.Ile1199Thr) | 57545 | CC2D2A | ['TACCAAGTCATATTTTCTTCACAGAYTGATG GAACATTTAAAATAGATATT'] |
| 2537 | NM_025114.3(CEP290): c.2343T > C (p.Asn781=) | 80184 | CEP290 | ['CCTGTAACAAATGTATTAAATATTCRTTCTG AGAATTAATGATACTGGCAC'] |
| 2538 | NM_030578.3(B9D2): c.107T > C (p.Leu36Pro) | 80776 | B9D2 | ['CGTTTGGCCCTCCCGCACGCCTGACRGGAGC TTCCATGCCGCCCCTGCAGT'] |
| 2539 | NM_004304.4(ALK): c.3520T > C (p.Phe1174Leu) | 238 | ALK | ['ACATCCCTCTCTGCTCTGCAGCAAAKTCAAC CACCAGAACATTGTTCGCTG'] |

TABLE 7

Diseases/disorders containing A to G Changes. The table includes human gene
mutations that may be corrected by changing a guanine (G) to adenine (A). The gene name,
gene symbol, and Gene ID are indicated.

| SEQ ID NO: | Name | Gene ID | Gene Symbol | Flanks |
| --- | --- | --- | --- | --- |
| 3144 | NM_017547.3(FOXRED1): c.1289A > G (p.Asn430Ser) | 55572 | FOXRED1 | ['GTGGGCCCCCACCCGCTAGTTGTCAVCATG TACTTTGCTACTGGCTTCAGT'] |
| 3145 | NM_001006657.1(WDR35): c.25 - 2A > G | 57539 | WDR35 | ['CTAGTGCGGCTGTGGTTGCTTTTTCVGATT TCCATTCCCAATAACGTGAAG'] |
| 3146 | NM_001006657.1(WDR35): c.1877A > G (p.Glu626Gly) | 57539 | WDR35 | ['TATGTTTTCAGAAACTTGGATCCTGRGGTA AAAACAAGAAATGAGTGTTAA'] |
| 3147 | NM_000374.4(UROD): c.932A > G (p.Tyr311Cys) | 7389 | UROD | ['GGCAACCTGGACCCCTGTGCCTTGTRTGCA TCTGAGGTAACAGCCAGGGCC'] |
| 3148 | NM_004315.4(ASAH1): c.155A > G (p.Tyr52Cys) | 427 | ASAH1 | ['ACAGAGGACTGCAGAAAATCAACCTRTCC TCCTTCAGGACCAACGTGAGTA'] |
| 3149 | NM_004315.4(ASAH1): c.1006A > G (p.Asn336Asp) | 427 | ASAH1 | ['GGGTAGATGGTATGTGGTACAAACARATT ATGACCGTTGGAAACATCCCTT'] |
| 3150 | NM_000071.2(CBS): c.1150A > G (p.Lys384Glu) | 875 | CBS | ['GGTGACTCCCCCATCCCGCAGGACCRAGTT CCTGAGCGACAGGTGGATGCT'] |
| 3151 | NM_000274.2(OAT): c.734A > G (p.Tyr245Cys) | 4942 | OAT | ['GGCGTTGTTGTTCCGGATCCAGGTTRCCTA ATGGGAGTGCGAGAGCTCTGC] |
| 3152 | NM_001385.2(DPYS): c.1001A > G (p.Gln334Arg) | 1807 | DPYS | ['GATAACTGCACTTTCAACACCTGCCRGAA AGCTCTTGGGAAGGATGATTTT'] |
| 3153 | NN1_024598.3(USB1): c.502A > G (p.Arg168Gly) | 79650 | USB1 | ['GATTTACACCAATCAAGAGAAAACCRGGT GGGTCCTCCCAACCCCCAATCA'] |
| 3154 | NM_001194958.2(KCNJ18): c.1097A > G (p.Lys366Arg) | 100134444 | KCNJ18 | ['AGTGCGAAGGATCTGGTAGAGAACARGTT CCTGCTGCCCAGTGCCAACTCC'] |
| 3155 | NM_001914.3(CYB5A): c.130 - 2A > G | 1528 | CYB5A | ['TTTTTATTCTACCTCTCCTTTGAACRGCATC CTGGTGGGGAAGAAGTTTTA'] |
| 3156 | NM_000398.6(CYB5R3): c.719A > G (p.Asp240Gly) | 1727 | CYB5R3 | ['CGCTTCAAGCTCTGGTACACGCTGGRCAG AGCCCCTGAAGGTGAGTGAGGG'] |
| 3157 | NM_004628.4(XPC): c.413 - 24A > G | 7508 | XPC | ['ATTATTATTGTTATTACTATTACTGRTTTTT AAAAATGCTTGTTGATAGAA'] |
| 3158 | NM_001134363.2(RBM20): c.1909A > G (p.Ser637Gly) | 282996 | RBM20 | ['TGGCCCAGAAAGGCCGCGGTCTCGTRGTC CGGTGAGCCGGTCACTCTCCCC'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3159 | NM_000552.3(VWF): c.2384A > G (p.Tyr795Cys) | 7450 | VWF | ['GAGTGTACCAAAACGTGCCAGAACTRTGA CCTGGAGTGCATGAGCATGGGC'] |
| 3160 | NM_000552.3(VWF): c.1583A > G (p.Asn528Ser) | 7450 | VWF | ['ACCTGCGGCCTGTGTGGGAATTACARTGG CAACCAGGGCGACGACTTCCTT'] |
| 3161 | NM_144573.3(NEXN): c.1955A > G (p.Tyr652Cys) | 91624 | NEXN | ['ACTTTCCCAGAAGATGGAGGAGAGTRTAT GTGTAAAGCAGTCAACAATAAA'] |
| 3162 | NM_000267.3(NF1): c.4267A > G (p.Lys1423Glu) | 4763 | NF1 | ['CGAAAGGGGCTTGAAGTTAATGTCARAGG TGAATTATTTTGATAATCTAGC'] |
| 3163 | NM_000267.3(NF1): c.1642 − 8A > G | 4763 | NF1 | ['TCTCTTTGTCTTTCTCTTTTTTAAARAATTC AGGCTCTGCTGGTTCTTCAT'] |
| 3164 | NM_000267.3(NF1): c.1466A > G (p.Tyr489Cys) | 4763 | NF1 | ['CCTACAGACCTGGAGACAAGAAGCTRTAA GTATCTTCTCTTGTCCATGGTG'] |
| 3165 | NM_000267.3(NF1): c.5944 − 5A > G | 4763 | NF1 | ['AAAAACATGTTATTTTCCTTCTTCARCTAG ATTACAGATCTGCTTGATGTT'] |
| 3166 | NM_000308.2(CTSA): c.746 + 3A > G | 5476 | CTSA | ['TACCATGGCCTTCTGGGGAACAGGTRTGG GATAGGGCAGTTGGGCAATCTC'] |
| 3167 | NM_000308.2(CTSA): c.200A > G (p.Gln67Arg) | 5476 | CTSA | ['CTGGCCAAGCAGCCGTCTTTCCGCCRGTAC TCCGGCTACCTCAAAGGCTCC'] |
| 3168 | NM_000308.2(CTSA): c.1238A > G (p.Tyr413Cys) | 5476 | CTSA | ['CTTTAGAAATACCAGATCCTATTATRTAAT GGAGATGTAGACATGGCCTGC'] |
| 3169 | NM_000308.2(CTSA): c.1411A > G (p.Lys471Glu) | 5476 | CTSA | ['CTCCCACATCGCCTTTCTCACGATCRAGGT AGGGACTGGGCCTGCTGAGAG'] |
| 3170 | NM_000353.2(TAT): c.236 − 5A > G | 6898 | TAT | ['TTCCAAACACAGTAGGGTCCCCTTTYTATG GGAGGAAAACACAAAGGAGC'] |
| 3171 | NM_000097.5(CPOX): c.1210A > G (p.Lys404Glu) | 1371 | CPOX | ['TAATCTGCTGTATGATCGGGGCACARAGTT TGGCCTCTTCACTCCAGGATC'] |
| 3172 | NM_000317.2(PTS): c.155A > G (p.Asn52Ser) | 5805 | PTS | ['AACAATCCAAATGGCCATGGGCACARTTA TAAAGGTGAGAGAAAAACTGAT'] |
| 3173 | NM_000317.2(PTS): c.139A > G (p.Asn47Asp) | 5805 | PTS | ['ACTGTTTGGGAAATGCAACAATCCARATG GCCATGGGCACAATTATAAAGG'] |
| 3174 | NM_000317.2(PTS): c.347A > G (p.Asp116Gly) | 5805 | PTS | ['GAAAATGTAGCTGTTTATATCTGGGRCAAC CTCCAGAAAGTTCTTCCTGTA'] |
| 3175 | NM_000320.2(QDPR): c.449A > G (p.Tyr150Cys) | 5860 | QDPR | ['CCCCATTTCCCAGGTATGATCGGGTRCGGC ATGGCCAAGGGTGCTGTTCAC'] |
| 3176 | NM_173560.3(RFX6): c.224 − 12A > G | 222546 | RFX6 | ['TCTATTTTCTTTATCATCCCTTCARCTGGC AATCAGAAATGCACTTAAAC'] |
| 3177 | NM_001999.3(FBN2): c.3725 − 15A > G | 2201 | FBN2 | ['TTCATCAATATCTGTGAAAACAGCAYTGC AACCACATTGTCAGGTCTGCTT] |
| 3178 | NM_001040613.2(TMEM70): c.*7 − 2A > G | 54968 | TMEM70 | ['GATCCTCTCTCTTTTTTCCCATTTRGGTGT GAAATGTTTCTCTTATTCTA'] |
| 3179 | NM_152416.3(NDUFAF6): c.296A > G (p.Gln99Arg) | 137682 | NDUFAF6 | ['AGGGCCTTTAATGTGGAACTGGCTCRGGCT GGTATTAAGATACCTTAAAAT'] |
| 3180 | NM_000140.3(FECH): c.1137 + 3A > G | 2235 | FECH | ['ACTAAAACGATTGTAACACTGTAGAYACC TTAGAGAACAATGGATTTCCAT'] |
| 3181 | NM_000277.1(PAH): c.1A > G (p.Met1Val) | 5053 | PAH | ['GAGACCTCACTCCCGGGGAGCCAGCDTGT CCACTGCGGTCCTGGAAAACCC'] |
| 3182 | NM_000277.1(PAH): c.611A > G (p.Tyr204Cys) | 5053 | PAH | ['TCCTTGTATAAAACCCATGCTTGCTRTGAG TACAATCACATTTTTCCACTT] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3183 | NM_000277.1(PAH): c.1241A > G (p.Tyr414Cys) | 5053 | PAH | ['ATACCTCGGCCCTTCTCAGTTCGCTRCGAC CCATACACCCAAAGGATTGAG'] |
| 3184 | NM_000277.1(PAH): c.662A > G (p.Glu221Gly) | 5053 | PAH | ['CTTGAAAAGTACTGTGGCTTCCATGRAGAT AACATTCCCCAGCTGGAAGAC'] |
| 3185 | NM_000277.1(PAH): c.916A > G (p.Ile306Val) | 5053 | PAH | ['TTCTATTTTCCCCCAATTACAGGAARTTGG CCTTGCCTCTCTGGGTGCACC'] |
| 3186 | NM_000277.1(PAH): c.1169A > G (p.Glu390Gly) | 5053 | PAH | ['TTCCAGCCCCTGTATTACGTGGCAGRGAGT TTTAATGATGCCAAGGAGAAA'] |
| 3187 | NM_000277.1(PAH): c.1065 + 3A > G | 5053 | PAH | ['TGTCATCCTTTGGTGAATTACAGGTVTGAC CTTCACAGGAACCAAGGATAG'] |
| 3188 | NM_000277.1(PAH): c.227A > G (p.Glu76Gly) | 5053 | PAH | ['AGACCTTCTCGTTTAAAGAAAGATGVGTA TGAATTTTTCACCCATTTGGAT'] |
| 3189 | NM_000130.4(F5): c.1000A > G (p.Arg334Gly) | 2153 | F5 | ['CATTAAAAACTGCCCAAAGAAAACCRGGA ATCTTAAGAAAATAACTCGTGA'] |
| 3190 | NM_000130.4(F5): c.5189A > G (p.Tyr1730Cys) | 2153 | F5 | ['GGCTCTGCCTGTCGGGCTTGGGCCTRCTAC TCAGCTGTGAACCCAGTAGGT'] |
| 3191 | NM_000512.4(GALNS): c.1460A > G (p.Asn487Ser) | 2588 | GALNS | ['TTGGTCCCCGCGCAGCCCCAGCTCARCGTG TGCAACTGGGCGGTCATGGTA'] |
| 3192 | NM_015702.2(MMADHC): c.746A > G (p.Tyr249Cys) | 27249 | MMADHC | ['ACTCTTTTTGAAACTGATGAACGCTRCCGA CATTTAGGATTCTCTGTTGAT'] |
| 3193 | NM_015141.3(GPD1L): c.370A > G (p.Ile124Val) | 23171 | GPD1L | ['TAACTTCTTGGCATCCTTGTAGGGCRTAGA CGAGGGCCCCGAGGGGCTGAA'] |
| 3194 | NM_013319.2(UBIAD1): c.305A > G (p.Asn102Ser) | 29914 | UBIAD1 | ['GTGCACGGGGCCGGTAATTTGGTCARCAC TTACTATGACTTTTCCAAGGGC'] |
| 3195 | NM_013319.2(UBIAD1): c.355A > G (p.Arg119Gly) | 29914 | UBIAD1 | ['CATTGACCACAAAAAGAGTGATGACRGGA CACTTGTGGACCGAATCTTGGA'] |
| 3196 | NM_013319.2(UBIAD1): c.695A > G (p.Asn232Ser) | 29914 | UBIAD1 | ['AGCACCGAGGCCATTCTCCATTCCARCAAC ACCAGGGACATGGAGTCCGAC'] |
| 3197 | NM_013319.2(UBIAD1): c.335A > G (p.Asp112Gly) | 29914 | UBIAD1 | ['TACTATGACTTTTCCAAGGGCATTGRCCAC AAAAAGAGTGATGACAGGACA] |
| 3198 | NM_000046.3(ARSB): c.629A > G (p.Tyr210Cys) | 411 | ARSB | ['GTTGCAACAGGATATAAAAATATGTRTTC AACAAACATATTCACCAAAAGG] |
| 3199 | NM_006331.7(EMG1): c.257A > G (p.Asp86Gly) | 10436 | EMG1 | ['CGGGACCCTGGGGAAGCGCGGCCAGRTAT CACCCACCAGGTAACTCCAGGG'] |
| 3200 | NM_000181.3(GUSB): c.1484A > G (p.Tyr495Cys) | 2990 | GUSB | ['CTGCTGCTCTGGTCCTAGGCTCCGTRTGTG GATGTGATCTGTTTGAACAGC'] |
| 3201 | NM_000067.2(CA2): c.754A > G (p.Asn252Asp) | 760 | CA2 | ['CTGGCGCCCAGCTCAGCCACTGAAGRACA GGCAAATCAAAGCTTCCTTCAA'] |
| 3202 | NM_000067.2(CA2): c.52A > G (p.Lys18Glu) | 760 | CA2 | ['TCCCCCAGGACCTGAGCACTGGCATVAGG ACTTCCCCATTGCCAAGGGAGA'] |
| 3203 | NM_000404.2(GLB1): c.947A > G (p.Tyr316Cys) | 2720 | GLB1 | ['TTTATAGGTGGGACCAATTTTGCCTRTTGG AATGGTAAGAGCACTTTAATA'] |
| 3204 | NM_000404.2(GLB1): c.1498A > G (p.Thr500Ala) | 2720 | GLB1 | ['TTTGCAGGGTTTGGTTTCTAACCTGRCTCT CAGTTCCAATATCCTCACGGA'] |
| 3205 | NM_000404.2(GLB1): c.1480 − 2A > G | 2720 | GLB1 | ['GAGAGTCAGGTTAGAAACCAAACCCYGCA AAGCAGAAACAGAGCACAGTGA'] |
| 3206 | NM_000404.2(GLB1): c.1772A > G (p.Tyr591Cys) | 2720 | GLB1 | ['ATTAATGGCTTTAACCTTGGCCGCTRTTGG CCAGCCCGGGGCCCTCAGTTG'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3207 | NM_203447.3(DOCK8): c.1418A > G (p.Lys473Arg) | 81704 | DOCK8 | ['ACTCTGAGCGTTAGCAGCTTTTTCARGCAG GTATCTCTTCACATTACAGTG'] |
| 3208 | NM_000275.2(OCA2): c.1465A > G (p.Asn489Asp) | 4948 | OCA2 | ['TGCCACTGCCATCGGGGACCCTCCARATGT CATTATTGTTTCCAACCAAGA'] |
| 3209 | NM_152778.2(MFSD8): c.362A > G (p.Tyr121Cys) | 256471 | MFSD8 | ['ATTTCCGTGGCAGCCAACTGCCTCTVTGCA TATCTCCACATCCCAGCTTCT'] |
| 3210 | NM_139241.3(FGD4): c.1762 - 2A > G | 121512 | FGD4 | ['ACTGTTCATTTTCTTTTAAATTTARGGTGG TTTGTTGGAAATGCTCCGAC'] |
| 3211 | NM_020223.3(FAM20C): c.1364 - 2A > G | 56975 | FAM20C | ['TGTGACACTTTCTGCCTCTCTCCGCRGGAA ACATGGACCGTCACCACTACG'] |
| 3212 | NM_138387.3(G6PC3): c.346A > G (p.Met116Val) | 92579 | G6PC3 | ['GGCAGGCAGCCCTTCTGGACACTGCRTGA TCACAGGAGCAGCCCTCTGGCC'] |
| 3213 | NM_018122.4(DARS2): c.133A > G (p.Ser45Gly) | 55157 | DARS2 | ['TTTTTTTTTTTTTTTAAAGAATTCRGTAGC TTTGTTGTCCGGACCAACAC'] |
| 3214 | NM_000642.2(AGL): c.4260 - 12A > G | 178 | AGL | ['CATCTTTTATTTAACTTAAATTTCARTCATT TTGCAGTGATATGGTTTACT'] |
| 3215 | NM_000642.2(AGL): c.3439A > G (p.Arg1147Gly) | 178 | AGL | ['TCTACTGGGTGAAGGAATTTATGCCRGATA CAATTGTCGGGATGCTGTGTG'] |
| 3216 | NM_145014.2(HYLS1): c.632A > G (p.Asp211Gly) | -1 | - | ['TTAAGCCGAAACCGGGGCAAGACAGRCCG GGTAGCCCGGTATTTTGAGTAC'] |
| 3217 | NM_014362.3(HIBCH): c.365A > G (p.Tyr122Cys) | 26275 | HIBCH | ['GCTCCAGTTTTCTTCAGAGAAGAATRTATG CTGAATAATGCTGTTGGTATG'] |
| 3218 | NM_014846.3(KIAA0196): c.1411A > G (p.Asn471Asp) | 9897 | KIAA0196 | ['TTTTCTTATTTCTGTATTACTAGAARACCTT CAAGCTTGGTTCAGAGAGAT'] |
| 3219 | NM_000505.3(F12): c.158A > G (p.Tyr53Cys) | 2161 | F12 | ['GAGCCCTGCCACTTCCCCTTCCAGTRCCAC CGGCAGCTGTACCACAAATGT'] |
| 3220 | NM_001029871.3(RSPO4): c.194A > G (p.Gln65Arg) | 343637 | RSPO4 | ['TTCATCCGCCGGGAAGGCATCCGCCRGTA CGGCAAGTGCCTGCACGACTGT'] |
| 3221 | NM_017654.3(SAMD9): c.4483A > G (p.Lys1495Glu) | 54809 | SAMD9 | ['TAAAAGACTGGAAAGACTTGTTCACRAAG GAAAAATTGACCAGTGCTTTAA'] |
| 3222 | NM_152419.2(HGSNAT): c.372 - 2A > G | 138050 | HGSNAT | ['TGTCTTAATTTTACCTAATGTTTGTRGGTTG GAATACAGATTTGGAGAATT'] |
| 3223 | NM_001174089.1(SLC4A11): c.2518A > G (p.Met840Val) | 83959 | SLC4A11 | ['CATGAGCTCCCTGCCCTACATGAAGRTGAT CTTTCCCCTCATCATGATCGC'] |
| 3224 | NM_012073.4(CCT5): c.440A > G (p.His147Arg) | 22948 | CCT5 | ['CAGGCTGCTCGTGTTGCTATTGAACRCCTG GACAAGATCAGCGATAGCGTC'] |
| 3225 | NM_025114.3(CEP290): c.2991 + 1655A > G | 80184 | CEP290 | ['CACCTGGCCCCAGTTGTAATTGTGARTATC TCATACCTATCCCTATTGGCA'] |
| 3226 | NM_153704.5(TMEM67): c.870 - 2A > G | 91147 | TMEM67 | ['TATTAAAACAGTTGTAACTGTTTATRGGAG ACAGAATCTTCCTTGGCTGTT'] |
| 3227 | NM_153704.5(TMEM67): c.1538A > G (p.Tyr513Cys) | 91147 | TMEM67 | ['TATCAGGTTTCTTTCTCAGTCACATDTGAA ATGGATCATGGAGAAGCACAT'] |
| 3228 | NM_001041.3(SI): c.350A > G (p.Gln117Arg) | 6476 | SI | ['GTTGATAATCATGGTTATAACGTTCRAGAC ATGACAACAACAAGTATTGGT'] |
| 3229 | NM_015697.7(COQ2): c.890A > G (p.Tyr297Cys) | 27235 | COQ2 | ['TCTGGAGTTATGTGGACACTAATATRTGAT ACTATTTATGCCCATCAGGTA'] |
| 3230 | NM_015697.7(COQ2): c.683A > G (p.Asn228Ser) | 27235 | COQ2 | ['GCACTGGGTGTTCTTCTGTGTCTAARTTAC TACAGGTATATTAAACGTTTT'] |

TABLE 7-continued

Diseases/disorders containging A to G Changes. The table includes human gene
mutations that may be corrected by changing a guanine (G) to adenine (A). The gene name,
gene symbol, and Gene ID are indicated.

| SEQ ID NO: | Name | Gene ID | Gene Symbol | Flanks |
|---|---|---|---|---|
| 3231 | NM_000190.3(HMBS): c.1A > G (p.Met1Val) | 3145 | HMBS | ['CACAGCCTACTTTCCAAGCGGAGCCRTGTC TGGTAACGGCAATGCGGCTGC'] |
| 3232 | NM_004035.6(ACOX1): c.832A > G (p.Met278Val) | 51 | ACOX1 | ['GAGTAACAAGCTGACTTACGGGACCRTGG TGTTTGTCAGGTCCTTCCTTGT'] |
| 3233 | NM_004035.6(ACOX1): c.926A > G (p.Gln309Arg) | 51 | ACOX1 | ['ATCCGATACAGCGCTGTGAGGCACCRGTC TGAAATCAAGCCAGGGTAAGGA'] |
| 3234 | NM_000237.2(LPL): c.548A > G (p.Asp183Gly) | 4023 | LPL | ['TGCTTTTTTCCCTTTTAAGGCCTCGRTCCAG CTGGACCTAACTTTGAGTAT'] |
| 3235 | NM_000237.2(LPL): c.953A > G (p.Asn318Ser) | 4023 | LPL | ['TGCAACAATCTGGGCTATGAGATCARTAA AGTCAGAGCCAAAAGAAGCAGC'] |
| 3236 | NM_001171993.1(HPD): c.362A > G (p.Tyr121Cys) | 3242 | HPD | ['TACATCGGCCAATTCTTGCCTGGATRTGAG GCCCCAGCGTTCATGGACCCC'] |
| 3237 | NM_139281.2(WDR36): c.1064A > G (p.Asn355Ser) | 134430 | WDR36 | ['CTTCTTGTCACAAATGGCGCTGACARTGCT CTTAGGGTATTATGATTATTG'] |
| 3238 | NM_001127255.1(NLRP7): c.2738A > G (p.Asn913Ser) | -1 | — | ['CTCACAAACCTGGACTTGAGTATCARCCA GATAGCTCGTGGATTGTGGATT'] |
| 3239 | NM_016417.2(GLRX5): c.294A > G (p.Gln98=) | 51218 | GLRX5 | ['TGCTGGACGACCCGGAGCTCCGACARGGT CAGGCCAGTGTGCCGGGCAGGC'] |
| 3240 | NM_024884.2(L2HGDH): c.293A > G (p.His98Arg) | 79944 | L2HGDH | ['ACTGGACATAACAGTGGTGTCATACRTAG TGGAATTTATTATAAACCTGAG'] |
| 3241 | NM_000382.2(ALDH3A2): c.1157A > G (p.Asn386Ser) | 224 | ALDH3A2 | ['ACATCCAGTGGAGGTGTCACAGGCARTGA CGTCATTATGCACTTCACGCTC'] |
| 3242 | NM_018105.2(THAP1): c.266A > G (p.Lys89Arg) | 55145 | THAP1 | ['TTTCTTTGTACTGAGCCACATGACARGGTA ATATGCATTTTAAAATATTGG'] |
| 3243 | NM_000785.3(CYP27B1): c.566A > G (p.Glu189Gly) | 1594 | CYP27B1 | ['GCCCTGGTTCGGGACGTGGCGGGGGRATT TTACAAGTTCGGACTGGAAGGT'] |
| 3244 | NM_182548.3(LHFPL5): c.380A > G (p.Tyr127Cys) | 222662 | LHFPL5 | ['TTCATCTGCAACACGGCCACAGTCTRTAAG ATCTGTGCATGGATGCAGCTG'] |
| 3245 | NM_015040.3(PIKFYVE): c.3308A > G (p.Lys1103Arg) | 200576 | PIKFYVE | ['TTCAAAGAAATGGAACAGGAGGARGA AACAGCTGCTCAGGGATCTCTCT'] |
| 3246 | NM_138701.3(MPLKIP): c.430A > G (p.Met144Val) | 136647 | MPLKIP | ['GTTGGAAAATTATTTCAAGCCTTCARTGCT TGAAGATCCTTGGGCTGGCCT'] |
| 3247 | NM_152783.4(D2HGDH): c.1315A > G (p.Asn439Asp) | 728294 | D2HGDH | ['TGCCCTTGTCCCTCCAGGAGATGGTRACCT GCACCTCAATGTGACGGCGGA'] |
| 3248 | NM_022912.2(REEP1): c.183 - 2A > G | 65055 | REEP1 | ['AACTTGTGTTTTCATCTCTCTCTCCRGGTTT CCATTCTATTATGAACTAAA'] |
| 3249 | NM_000060.3(BTD): c.755A > G (p.Asp252Gly) | 686 | BTD | ['ACATGCTTTGATATATTGTTCTTTGRCCCT GCCATCAGAGTCCTCAGAGAC'] |
| 3250 | NM_022132.4(MCCC2): c.1309A > G (p.Ile437Val) | 64087 | MCCC2 | ['TGTGGCCTGTGCCCAAGTGCCTAAGDTAA CCCTCATCATTGGGGGCTCCTA'] |
| 3251 | NM_022132.4(MCCC2): c.569A > G (p.His190Arg) | 64087 | MCCC2 | ['GCAGATGTGTTTCCAGATCGAGACCRCTTT GGCCGTACATTCTATAATCAG'] |
| 3252 | NM_198578.3(LRRK2): c.5096A > G (p.Tyr1699Cys) | 120892 | LRRK2 | ['ATCATCCGACTATATGAAATGCCTTRTTTT CCAATGGGATTTTGGTCAAGA'] |
| 3253 | NM_198578.3(LRRK2): c.3364A > G (p.Ile1122Val) | 120892 | LRRK2 | ['TGTGACTAGAAATAAAATATCAGGGRTAT GCTCCCCCTTGAGACTGAAGGA'] |
| 3254 | NM_000022.2(ADA): c.219 - 2A > G | 100 | ADA | ['TTCCCAACCCCTTTCTTCCCTTCCCRGGGG CTGCCGGGAGGCTATCAAAAG'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3255 | NM_000022.2(ADA): c.290A > G (p.Tyr97Cys) | 100 | ADA | ['ATGAAGGCCAAAGAGGGCGTGGTGTDTGT GGAGGTGCGGTACAGTCCGCAC'] |
| 3256 | NM_017780.3(CHD7): c.3082A > G (p.Ile1028Val) | 55636 | CHD7 | ['TTTAGTAATTGCCCCATTGTCCACARTCCC CAACTGGGAAAGGGAATTCCG'] |
| 3257 | NM_017780.3(CHD7): c.164A > G (p.His55Arg) | 55636 | CHD7 | ['TTTGCCTCTTTACAGCCATCCCTTCRTCATC CTTCAACTAATCAAATCAA'] |
| 3258 | NM_152443.2(RDH12): c.677A > G (p.Tyr226Cys) | 145226 | RDH12 | ['GTCCCAGGCACCGGGGTCACCACCTRCGC AGTGCACCCAGGCGTCGTCCGC'] |
| 3259 | NM_015335.4(MED13L): c.752A > G (p.Glu251Gly) | 23389 | MED13L | ['TACCCGATGGTGCTAAAAAGAAAGRAGA ATCGAAAGAGGAAGACGAGTTG'] |
| 3260 | NM_015335.4(MED13L): c.6068A > G (p.Asp2023Gly) | 23389 | MED13L | ['GCTTTTTTTCCCCCCTTCCCTCTAGRTGATA TGTTTGTTGACCTTCCATTC'] |
| 3261 | NM_025265.3(TSEN2): c.926A > G (p.Tyr309Cys) | 80746 | TSEN2 | ['TATTTTCAGGCCTTTTTCTTGGTCTRTGCTC TGGGATGTTTAAGTATTTAC'] |
| 3262 | NM_015384.4(NIPBL): c.7289A > G (p.Tyr2430Cys) | 25836 | NIPBL | ['AAAACAGACGTGACTATGCTCTTGTRTATA GCAGACAATCTAGCCTGTTTT'] |
| 3263 | NM_207352.3(CYP4V2): c.1091 – 2A > G | 285440 | CYP4V2 | ['GTCATCTTATCTACTTGCTTTCATCRGGGA AGTCTGACCGTCCCGCTACAG'] |
| 3264 | NM_024006.5(VKORC1): c.172A > G (p.Arg58Gly) | 79001 | VKORC1 | ['CAGCTGTTCGCGCGTCTTCTCCTCCRGGTG TGCACGGGAGTGGGAGGCGTG'] |
| 3265 | NM_000551.3(VHL): c.491A > G (p.Gln164Arg) | 7428 | VHL | ['TATACTCTGAAAGAGCGATGCCTCCRGGTT GTCCGGAGCCTAGTCAAGCCT] |
| 3266 | NM_000101.3(CYBA): c.281A > G (p.His94Arg) | 1535 | CYBA | ['AATTACTATGTTCGGGCCGTCCTGCRTCTC CTGTGAGTCCCCGTCCCGCAC'] |
| 3267 | NM_014874.3(MFN2): c.827A > G (p.Gln276Arg) | 9927 | MFN2 | ['TTGTTTGGGCTCCAGGTGCGGCGGCRGCAC ATGGAGCGTTGTACCAGCTTC'] |
| 3268 | NM_015046.5(SETX): c.1807A > G (p.Asn603Asp) | 23064 | SETX | ['GCAGAAGTCAGATCCACAAAAGTGTYACA TGGAGGTGCTTTGAATTTTATG'] |
| 3269 | NM_005609.2(PYGM): c.1A > G (p.Met1Val) | 5837 | PYGM | ['CAGTCCGGCCCGCCCTCCTGCAGCCVTGTC CCGGCCCCTGTCAGACCAAGA'] |
| 3270 | NM_033071.3(SYNE1): c.15705 – 12A > G | 23345 | SYNE1 | ['ACTTCACTTCTGTTTTATCCCTGTARTGTTT CTGAAGCATGCAGGAGAAAG'] |
| 3271 | NM_130468.3(CHST14): c.878A > G (p.Tyr293Cys) | 113189 | CHST14 | ['CTGTGCCAGCCTTGTGCCGTGCACTRTGAC TTTGTGGGCTCCTATGAGAGG'] |
| 3272 | NM_206933.2(USH2A): c.14020A > G (p.Arg4674Gly) | 7399 | USH2A | ['AAAGTTTTGTATTACGAATTATACRGAAG ACAAATAGCAACTCAGCCTAG'] |
| 3273 | NM_000048.3(ASL): c.857A > G (p.Gln286Arg) | 435 | ASL | ['AGCACGGGAAGCAGCCTGATGCCCCRGAA GAAAAACCCCGACAGTTTGGAG'] |
| 3274 | NM_001875.4(CPS1): c.1010A > G (p.His337Arg) | 1373 | CPS1 | ['CAGGCTTTCATTACTGCTCAGAATCRTGGC TATGCCTTGGACAACACCCTC'] |
| 3275 | NM_001173464.1(KIF21A): c.2839A > G (p.Met947Val) | 55605 | KIF21A | ['GACCATTTCCAACATGGAGGCAGATRTGA ATAGACTCCTCAAGGTGTGGAA] |
| 3276 | NM_000026.2(ADSL): c.736A > G (p.Lys246Glu) | 158 | ADSL | ['CATCACAGGGCAGACATATACACGARAAG TGGATATTGAAGTACTGTCTGT'] |
| 3277 | NM_024577.3(SH3TC2): c.530 – 2A > G | 79628 | SH3TC2 | ['AGCCATTGCTTTTCTCATTATCCACRGGCC ACTTCTTCTGCAGAGCCCTGT'] |
| 3278 | NM_018249.5(CDK5RAP2): c.4005 – 15A > G | 55755 | CDK5RAP2 | ['AGCATGGGAGATGATTTATCTTTCARTCTC AATGGTTAAGGATTGAGGAAG'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3279 | NM_000346.3(SOX9): c.517A > G (p.Lys173Glu) | 6662 | SOX9 | ['GCACAAGAAGGACCACCCGGATTACRAGT ACCAGCCGCGGCGGAGGAAGTC'] |
| 3280 | NM_144596.3(TTC8): c.115 − 2A > G | 123016 | TTC8 | ['GTTTACTGCCTTCTTAATGCTTTCCRGGAA CCAGATCCTGAATTGCCAGTG'] |
| 3281 | NM_000243.2(MEFV): c.2080A > G (p.Met694Val) | 4210 | MEFV | ['GAATGGCTACTGGGTGGTGATAATGDTGA AGGAAAATGAGTACCAGGCGTC'] |
| 3282 | NM_000243.2(MEFV): c.2084A > G (p.Lys695Arg) | 4210 | MEFV | ['GGCTACTGGGTGGTGATAATGATGADGGA AAATGAGTACCAGGCGTCCAGC'] |
| 3283 | NM_006493.2(CLN5): c.1121A > G (p.Tyr374Cys) | 1203 | CLN5 | ['GTGCACAAACAGTTCTATTTGTTTTRTAAT TTTGAATATTGGTTTTTACCT'] |
| 3284 | NM_000483.4(APOC2): c.1A > G (p.Met1Val) | −1 | — | ['TCAATGTTCCAGGTCTCTGGACACTRTGGG CACACGACTCCTCCCAGCTCT'] |
| 3285 | NM_058172.5(ANTXR2): c.1142A > G (p.Tyr381Cys) | 118429 | ANTXR2 | ['TGGCCAACTGTGGATGCTTCCTATTDTGGT GGTCGAGGGGTTGGAGGAATT'] |
| 3286 | NM_001128085.1(ASPA): c.692A > G (p.Tyr231Cys) | −1 | — | ['TATAAAATTATAGAGAAAGTTGATTRCCCC CGGGATGAAAATGGAGAAATT'] |
| 3287 | NM_001128085.1(ASPA): c.71A > G (p.Glu24Gly) | −1 | — | ['ATCTTTGGAGGAACCCATGGGAATGRGCT AACCGGAGTATTTCTGGTTAAG'] |
| 3288 | NM_014365.2(HSPB8): c.421A > G (p.Lys141Glu) | 26353 | HSPB8 | ['TGGCATTGTTTCTAAGAACTTCACARAGAA AATCCAGTAAGTAACCTGGAG'] |
| 3289 | NM_000391.3(TPP1): c.857A > G (p.Asn286Ser) | 1200 | TPP1 | ['CAGTACCTGATGAGTGCTGGTGCCARCATC TCCACCTGGGTCTACAGTAGC'] |
| 3290 | NM_000391.3(TPP1): c.887 − 10A > G | 1200 | TPP1 | ['TGTCCCTCATGCCGGCCTGGATTTTYTTTT TTTTTTTTTGAGGGATGGG'] |
| 3291 | NM_182760.3(SUMF1): c.1A > G (p.Met1Val) | 285362 | SUMF1 | ['CGGGTCACATGGCCCGCGGGACAACRTGG CTGCGCCCGCACTAGGGCTGGT'] |
| 3292 | NM_031443.3(CCM2): c.1A > G (p.Met1Val) | 83605 | CCM2 | ['GGCCGCGGGAGCCGCACGCGGCGATRTGG AAGAGGAGGGCAAGAAGGGCAA'] |
| 3293 | NM_004183.3(BEST1): c.707A > G (p.Tyr236Cys) | 7439 | BEST1 | ['GACTGGATTAGTATCCCACTGGTGTRTACA CAGGTGAGGACTAGGCTGGTG'] |
| 3294 | NM_004183.3(BEST1): c.680A > G (p.Tyr227Cys) | 7439 | BEST1 | ['ACTCAGTGTGGACACCTGTATGCCTRCGAC TGGATTAGTATCCCACTGGTG'] |
| 3295 | NM_000158.3(GBE1): c.1634A > G (p.His545Arg) | 2632 | GBE1 | ['TGTAATGCAGGTAATGAATTTGGGCRTCCT GAATGGTTAGACTTCCCAAGA'] |
| 3296 | NM_000158.3(GBE1): c.1883A > G (p.His628Arg) | 2632 | GBE1 | ['GGTCTTCTTTTCATTTTCAACTTCCRTCCAA GCAAGAGCTACACTGACTAC'] |
| 3297 | NM_017890.4(VPS13B): c.8978A > G (p.Asn2993Ser) | 157680 | VPS13B | ['CTTCTGCCCTGGGCCCTGCTTATCARTGAA TCCAAATGGGACCTCTGGCTA'] |
| 3298 | NM_000019.3(ACAT1): c.278A > G (p.Asn93Ser) | 38 | ACAT1 | ['GAAGTGAAAGAAGCATACATGGGTARTGT TCTACAAGGAGGTGAAGGACAA'] |
| 3299 | NM_173076.2(ABCA12): c.4139A > G (p.Asn1380Ser) | 26154 | ABCA12 | ['CATATTACTTCATTGCTGGGGCCCARTGGA GCTGGGAAAACTACTACCATG'] |
| 3300 | NM_030665.3(RAH): c.4685A > G (p.Gln1562Arg) | 10743 | RAH | ['AAGGGGCGTGCCAAGCGACGACGACRGCA GCAGGTGCTGCCCCTGGATCCC] |
| 3301 | NM_000271.4(NPC1): c.3467A > G (p.Asn1156Ser) | 4864 | NPC1 | ['AGTCTGAACGCTGTATCCTTGGTCARCCTG GTGATGGTGAGTCCTCATACA'] |
| 3302 | NM_000271.4(NPC1): c.3263A > G (p.Tyr1088Cys) | 4864 | NPC1 | ['CCCTCCAGTGTGTTTTATGTCTTCTRCGAA CAGTACCTGACCATCATTGAC'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3303 | NM_000543.4(SMPD1): c.1154A > G (p.Asn385Ser) | 6609 | SMPD1 | ['CTCCGCCTCATCTCTCTCAATATGARTTTTT GTTCCCGTGAGAACTTCTGG'] |
| 3304 | NM_000226.3(KRT9): c.469A > G (p.Met157Val) | 3857 | KRT9 | ['TCTGACTGCTAATGAGAAGAGCACCRTGC AGGAACTCAATTCTCGGCTGGC'] |
| 3305 | NM_000226.3(KRT9): c.482A > G (p.Asn161Ser) | 3857 | KRT9 | ['GAGAAGAGCACCATGCAGGAACTCADTTC TCGGCTGGCCTCTTACTTGGAT'] |
| 3306 | NM_176824.2(BBS7): c.968A > G (p.His323Arg) | 55212 | BBS7 | ['ACAGGTCTGACAACAGAGCCCATTCRTAA GGAAAGTGGACCAGGAGAAGAA'] |
| 3307 | NM_000051.3(ATM): c.3118A > G (p.Met1040Val) | 472 | ATM | ['GAGGAAATATATATTCTCTGTAAGARTGG CCCTAGTAAATTGCCTTAAAAC'] |
| 3308 | NM_000051.3(ATM): c.7268A > G (p.Glu2423Gly) | 472 | ATM | ['GCTCTCCTGAAAAGAGCCAAAGAGGRAGT AGGTCTCCTTAGGGAACATAAA'] |
| 3309 | NM_000051.3(ATM): c.8030A > G (p.Tyr2677Cys) | -1 | — | ['TATTAGGTGGACCACACAGGAGAATRTGG AAATCTGGTGACTATACAGTCA] |
| 3310 | NM_000487.5(ARSA): c.*96A > G | 410 | ARSA | ['GAGGGGGTTTGTGCCTGATAACGTARTAA CACCAGTGGAGACTTGCAGATG'] |
| 3311 | NM_000487.5(ARSA): c.1055A > G (p.Asn352Ser) | 410 | ARSA | ['GCCCTGGCTGGGGCCCCACTGCCCARTGTC ACCTTGGATGGCTTTGACCTC'] |
| 3312 | NM_000218.2(KCNQ1): c.418A > G (p.Ser140Gly) | 3784 | KCNQ1 | ['CATCGTCCTGGTCTGCCTCATCTTCRGCGT GCTGTCCACCATCGAGCAGTA'] |
| 3313 | NM_172250.2(MMAA): c.620A > G (p.Tyr207Cys) | 166785 | MMAA | ['GAGTTATCAAGAGATATGAATGCATRCAT CAGGCCATCTCCTACTAGAGGA'] |
| 3314 | NM_000187.3(HGD): c.1112A > (p.His371Arg) | 3081 | HGD | ['AGTCTACACAGCACAATGACCCCCCRTGG ACCTGATGCTGACTGCTTTGAG'] |
| 3315 | NM_000187.3(HGD): c.1102A > (p.Met368Val) | 3081 | HGD | ['AGGGGGAGGGAGTCTACACAGCACARTGA CCCCCCATGGACCTGATGCTGA'] |
| 3316 | NM_138477.2(CDAN1): c.1796A > G (p.Asn599Ser) | 146059 | CDAN1 | ['CTGAGCTTGAAGATCCAGGAGCTCARTGG TCTTGCCCTGCCCCAGCATGAG'] |
| 3317 | NM_001079802.1(FKTN): c.1112A > G (p.Tyr371Cys) | 2218 | FKTN | ['GTAAAACTTGATGTTTTTTCTTCRTGAA GAAACTGATCACATGTGGAAT'] |
| 3318 | NM_013382.5(POMT2): c.1997A > G (p.Tyr666Cys) | 29954 | POMT2 | ['GCTTGAGAAGAGCATGGCTGGGAAGYAGT GGTGGAAGTAGAGGACCCGGCC'] |
| 3319 | NM_000529.2(MC2R): c.761A > G (p.Tyr254Cys) | 4158 | MC2R | ['CCAAGTAACCCCTACTGCGCCTGCTRCATG TCTCTCTTCCAGGTGAACGGC] |
| 3320 | NM_000383.3(AIRE): c.247A > G (p.Lys83Glu) | 326 | AIRE | ['CCTGGACTTCTGGAGGGTGCTGTTCRAGGA CTACAACCTGGAGCGCTATGG'] |
| 3321 | NM_020436.3(SALL4): c.2663A > G (p.His888Arg) | 57167 | SALL4 | ['TCGTCTGCTAGCGCTCTTCAGATCCRCGAG CGGACTCACACTGGAGAGAAG'] |
| 3322 | NM_203288.1(RP9): c.509A > G (p.Asp170Gly) | 6100 | RP9 | ['CAGTTACTGGAGGATTCTACCTCAGRTGAA GATAGGAGCAGCTCCAGTTCC'] |
| 3323 | NM_000348.3(SRD5A2): c.692A > G (p.His231Arg) | 6716 | SRD5A2 | ['TTCCTTGGGCTGCGAGCTTTTCACCRCCAT AGGTAAATTTTCAATAAAAG'] |
| 3324 | NM_006445.3(PRPF8): c.6926A > G (p.His2309Arg) | 10594 | PRPF8 | ['CCCAAAGAGTTCTACCACGAGGTGCVCAG GCCCTCTCACTTCCTCAACTTT'] |
| 3325 | NM_018319.3(TDP1): c.1478A > G (p.His493Arg) | 55775 | TDP1 | ['TCTGGCCGCAGCAATGCCATGCCACRTATT AAGACATATATGAGGCTTCT'] |
| 3326 | NM_144773.2(PROKR2): c.629A > G (p.Gln210Arg) | 128674 | PROKR2 | ['AGCCAGGAGAAGATCTTCTGTGGCCRGAT CTGGCCTGTGGATCAGCAGCTC'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3327 | NM_001604.5(PAX6): c.1075 - 2A > G | 5080 | PAX6 | ['ACCACAGGTTTGCCTCTCTCCTCACRGCCC CCAGTCCCCAGCCAGACCTCC'] |
| 3328 | NM_000280.4(PAX6): c.1171A > G (p.Thr391Ala) | 5080 | PAX6 | ['CAGTCAGCCAATGGGCACCTCGGGCRCCA CTTCAACAGGTGAGCCACTGCT'] |
| 3329 | NM_024426.4(WT1): c.1391A > G (p.Asp464Gly) | 7490 | WT1 | ['TGTCAGCGAAAGTTCTCCCGGTCCGRCCAC CTGAAGACCCACACCAGGACT'] |
| 3330 | NM_024426.4(WT1): c.1021A > G (p.Ser341Gly) | 7490 | WT1 | ['TTGCAGCCACAGCACAGGGTACGAGRGCG ATAACCACACAACGCCCATCCT'] |
| 3331 | NM_005957.4(MTHFR): c.971A > G (p.Asn324Ser) | 4524 | MTHFR | ['CCAGGCCTCCACTTCTACACCCTCARCCGC GAGATGGCTACCACAGAGGTG'] |
| 3332 | NM_001127328.2(ACADM): c.997A > G (p.Lys333Glu) | 34 | ACADM | ['TAACTCATTCTAGCTAGTTCAACTTYCATT GCCATTTCAGCCAGCATAAAT'] |
| 3333 | NM_001127328.2(ACADM): c.589A > G (p.Thr197Ala) | 34 | ACADM | ['TATTAATGGTCAGAAGATGTGGATARCCA ACGGAGGAAAAGCTAATTGGTA'] |
| 3334 | NM_000155.3(GALT): c.940A > G (p.Asn314Asp) | 2592 | GALT | ['AGGATCAGAGGCTGGGGCCAACTGGRACC ATTGGCAGCTGCACGCTCATTA'] |
| 3335 | NM_000155.3(GALT): c.563A > G (p.Gln188Arg) | 2592 | GALT | ['TGTTCTAACCCCCACCCCCACTGCCRGGTA AGGGTGTCAGGGGCTCCAGTG'] |
| 3336 | NM_000250.1(MPO): c.518A > G (p.Tyr173Cys) | 4353 | MPO | ['GTTGCACATCCCGGTGATGGTGCGYATTT GTCCTGCTCCGGGCAAGTCAC'] |
| 3337 | NM_020247.4(ADCK3): c.1541A > G (p.Tyr514Cys) | 56997 | ADCK3 | ['TTGGATTTTGGGGCAACGCGGGAATRTGA CAGATCCTTCACCGACCTCTAC'] |
| 3338 | NM_000229.1(LCAT): c.463A > G (p.Asn155Asp) | 3931 | LCAT | ['CACACTGGTGCAGAACCTGGTCAACRATG GCTACGTGCGGGACGAGACTGT'] |
| 3339 | NM_000403.3(GALE): c.101A > G (p.Asn34Ser) | 2582 | GALE | ['GGCTACTTGCCTGTGGTCATCGATARCTTC CATAATGCCTTCCGTGGTGAG'] |
| 3340 | NM_001008216.1(GALE): c.308A > G (p.Asp103Gly) | 2582 | GALE | ['GGCGAGTCGGTGCAGAAGCCTCTGGRTTA TTACAGAGTTAACCTGACCGGG'] |
| 3341 | NM_000403.3(GALE): c.770A > G (p.Lys257Arg) | 2582 | GALE | ['AAGGGCCACATTGCAGCCTTAAGGARGCT GAAAGAACAGTGTGGCTGCCGG'] |
| 3342 | NM_000527.4(LDLR): c.2483A > G (p.Tyr828Cys) | 3949 | LDLR | ['AGCATCAACTTTGACAACCCCGTCTRTCAG AAGACCACAGAGGATGAGGTC'] |
| 3343 | NM_024740.2(ALG9): c.860A > G (p.Tyr287Cys) | 79796 | ALG9 | ['ATTGCACCACTCAACATTGTTTTGTRTAAT GTCTTTACTCCTCATGGACCT'] |
| 3344 | NM_000375.2(UROS): c.184A > G (p.Thr62Ala) | 7390 | UROS | ['TGAAGATTACGGGGACTCATTTTTRCCAG CCCCAGAGCAGTGGAAGCAGC'] |
| 3345 | NM_000372.4(TYR): c.125A > G (p.Asp42Gly) | 7299 | TYR | ['GAATGCTGTCCACCGTGGAGCGGGRCAG GAGTCCCTGTGGCCAGCTTTCA'] |
| 3346 | NM_000372.4(TYR): c.1A > G (p.Met1Val) | 7299 | TYR | ['AGACTTGTGAGGACTAGAGGAAGARTGC TCCTGGCTGTTTTGTACTGCCT'] |
| 3347 | NM_000053.3(ATP7B): c.3809A > G (p.Asn1270Ser) | 540 | ATP7B | ['GTCGCCATGGTGGGGATGGGGTCADTGA CTCCCCGGCCTTGGCCCAGGCA'] |
| 3348 | NM_000520.4(HEXA): c.1A > G (p.Met1Val) | 3073 | HEXA | ['CTCCGAGAGGGGAGACCAGCGGGCCVTGA CAAGCTCCAGGCTTTGGTTTTC'] |
| 3349 | NM_000520.4(HEXA): c.611A > G (p.His204Arg) | 3073 | HEXA | ['AATAAATTGAACGTGTTCCACTGGCRTCTG GTAGATGATCCTTCCTTCCCA'] |
| 3350 | NM_000356.3(TCOF1): c.149A > G (p.Tyr50Cys) | 6949 | TCOF1 | ['CAGCCCGTAACCCTTCTGGACATCTRTACA CACTGGCAACAGTAAGTGGTG'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3351 | NM_000144.4(FXN): c.385 - 2A > G | 2395 | FXN | ['ATGCTTTTTTCCACCTAATCCCCTRGAGT GGTGTCTTAACTGTCAAACTG'] |
| 3352 | NM_016335.4(PRODH): c.1562A > G (p.Gln521Arg) | 5625 | PRODH | ['GCCTAGCAGCTGTCCAAAGTACACCYGGT GGTCAGCAGGATGCAGGCCCAG'] |
| 3353 | NM_015474.3(SAMHD1): c.760A > G (p.Met254Val) | 25939 | SAMHD1 | ['TAATTCTAATGGAATTAAGCCTGTCRTGGA ACAATATGGTCTCATCCCTGA'] |
| 3354 | NM_012464.4(TLL1): c.1885A > G (p.Ile629Val) | 7092 | TLL1 | ['ACTTCTTACCAAACTTAACGGCACCRTAAC CACCCCTGGCTGGCCCAAGGA'] |
| 3355 | NM_000112.3(SLC26A2): c.1273A > G (p.Asn425Asp) | 1836 | SLC26A2 | ['GGAAATGTATGCCATTGGCTTTTGTRTATAT CATCCCTTCCTTCTTCCACTGT'] |
| 3356 | NM_138691.2(TMC1): c.1960A > G (p.Met654Val) | 117531 | TMC1 | ['CCTGTCCACAATGCCTGTCTTGTACRTGAT CGTGTCCCTCCCACCATCTTT'] |
| 3357 | NM_000173.6(GP1BA): c.763A > G (p.Met255Val) | 2811 | GP1BA | ['GAAGCAAGGTGTGGACGTCAAGGCCRTGA CCTCTAATGTGGCCAGTGTGCA'] |
| 3358 | NM_024996.5(GFM1): c.521A > G (p.Asn174Ser) | 85476 | GFM1 | ['AACGTTCCGTTTCTAACTTTTATTARCAAA TTGGACCGAATGGGCTCCAAC'] |
| 3359 | NM_024301.4(FKRP): c.926A > G (p.Tyr309Cys) | 79147 | FKRP | ['GTGGGCGACACGCCCGCCTACCTCTRCGA GGAGCGCTGGACGCCCCCTGC'] |
| 3360 | NM_024301.4(FKRP): c.1387A > G (p.Asn463Asp) | 79147 | FKRP | ['TGCCGGCTTCGTGGCGCAGGCGCCTRACA ACTACCGCCGCTTCCTGGAGCT'] |
| 3361 | NM_021020.3(LZTS1): c.355A > G (p.Lys119Glu) | 11178 | LZTS1 | ['TCCTTTTCCTCTACAGGGCTCCGAGRAGGG TGCAGTGAGGCCCACAGCCTT'] |
| 3362 | NM_001005741.2(GBA): c.1226A > G (p.Asn409Ser) | 2629 | GBA | ['CCAGCCGACCACATGGTACAGGAGGBTCT AGGGTAAGGACAAAGGCAAAGA'] |
| 3363 | NM_000157.3(GBA): c.680A > G (p.Asn227Ser) | 2629 | GBA | ['ACATCACCCACTTGGCTCAAGACCARTGG AGCGGTGAATGGGAAGGGGTCA'] |
| 3364 | NM_001005741.2(GBA): c.1049A > G (p.His350Arg) | 2629 | GBA | ['AAATATGTTCATGGCATTGCTGTACRTTGG TACCTGGACTTTCTGGCTCCA'] |
| 3365 | NM_014239.3(E1F2B2): c.638A > G (p.Glu213Gly) | 8892 | EIF2B2 | ['GTGAATTTGTCCAAAGCAGGTATTGRGAC AACTGTCATGACTGATGCTGCC'] |
| 3366 | NM_015915.4(ATL1): c.773A > G (p.His258Arg) | 51062 | ATL1 | ['CTACAGAACGTCAGAAAACACATCCRTTC CTGTTTCACCAACATTTCCTGT'] |
| 3367 | NM_015915.4(ATL1): c.1222A > G (p.Met408Val) | 51062 | ATL1 | ['GAAGCTATTCCGAGGGGTGAAGAAGRTGG GTGGGGAAGAATTTAGCCGGCG'] |
| 3368 | NM_022051.2(EGLN1): c.1121A > G (p.His374Arg) | 54583 | EGLN1 | ['TTCTGGTCTGACCGTCGCAACCCTCRTGAA GTACAACCAGCATATGCTACA'] |
| 3369 | NM_015629.3(PRPF31): c.527 + 3A > G | 26121 | PRPF31 | ['GTCACCGCCTCCACCACCCAGGGGTRTGTC CGCTTCGAGGGAGGCGCCGGG'] |
| 3370 | NM_001243133.1(NLRP3): c.1880A > G (p.Glu627Gly) | 114548 | NLRP3 | ['CTGCAGATCCAGCCCAGCCAGCTGGRATT GTTCTACTGTTTGTACGAGATG'] |
| 3371 | NM_020919.3(ALS2): c.2980 - 2A > G | 57679 | ALS2 | ['CTTATTGACGTTACTTTTTGCTCCTRGACA AAGTGGCTACGAGCTATAAGC'] |
| 3372 | NM_175073.2(APTX): c.602A > G (p.His201Arg) | 54840 | APTX | ['GATAAATACCCAAAGGCCCGTTACCRTTG GCTGGTCTTACCGTGGACCTCC'] |
| 3373 | NM_001002010.2(NT5C3A): c.686A > G (p.Asn229Ser) | 51251 | NT5C3A | ['CATCCCAATGTCAAAGTTGTGTCCARTTTT ATGGATTTTGATGAAACTGTA'] |
| 3374 | NM_020451.2(SEPN1): c.1A > G (p.Met1Val) | 57190 | SEPN1 | ['CCGGCAGCCGCCGCCAGCCGCAGCCRTGG GCCGGGCCCGGCCGGGCCAACG'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3375 | NM_032667.6(BSCL2): c.263A > G (p.Asn88Ser) | -1 | — | ['TCACTCTGCTCCTTCCCTGTTGCCARTGTCT CGCTGACTAAGGGTGGACGT'] |
| 3376 | NM_153638.2(PANK2): c.700A > G (p.Thr234Ala) | 80025 | PANK2 | ['GGTATATTTTGAACCCAAAGACATCRCTGC TGAAGAAGAAGAGGAAGAAGT'] |
| 3377 | NM_025243.3(SLC19A3): c.1264A > G (p.Thr422Ala) | 80704 | SLC19A3 | ['TGCCTTGGTGATTCAGACCATCATGRCTGT GATTGTAGTAGATCAGAGAGG'] |
| 3378 | NM_025243.3(SLC19A3): c.130A > G (p.Lys44Glu) | 80704 | SLC19A3 | ['TATCCCATATTTATCTGGACCAGATRAAAA CCTGACCAGTGCAGAGGTAAG'] |
| 3379 | NM_031885.3(BBS2): c.209A > G (p.Asn70Ser) | 583 | BBS2 | ['CAGACAGCTGACTGCCTGGTTAATGYTGA GAAGAGAAACATCAGATTCCAG'] |
| 3380 | NM_032383.4(HPS3): c.2482 − 2A > G | -1 | — | ['TTTATGAGAAATTCTTTTATGTTTTRGATA AATGCCTGTAGTCATTATGGC'] |
| 3381 | NM_021830.4(C10orf2): c.955A > G (p.Lys319Glu) | 56652 | C10orf2 | ['TGACCTTCGGTCCTGGGAAGCCGCCVAGTT GTTTGCACGAAAACTGAACCC'] |
| 3382 | NM_021830.4(C10orf2): c.1523A > G (p.Tyr508Cys) | 56652 | C10orf2 | ['ACAATGCAACATGCAGTCTACGTCTRTGAC ATTTGTCATGTGATCATCGAC'] |
| 3383 | NM_006492.2(ALX3): c.608A > G (p.Asn203Ser) | 257 | ALX3 | ['ACCTGCCCCAGGTCTGGTTCCAGACCGC AGAGCCAAGTGGCGGAAGCGC'] |
| 3384 | NM_174916.2(UBR1): c.407A > G (p.His136Arg) | 197131 | UBR1 | ['TTCCAGGACAGTGTTCATAAAAATCRTCGT TACAAGGTAAGAAAATATAAC'] |
| 3385 | NM_015166.3(MLC1): c.422A > G (p.Asn141Ser) | 23209 | MLC1 | ['CTAGTCCTGAACCCATCAGCAATAACGT GAGTTCACACGAGCTTCGCGCA'] |
| 3386 | NM_013391.3(DMGDH): c.326A > G (p.His109Arg) | 29958 | DMGDH | ['CCTGGAATAAACTTGAAGAAAATACRTTA TGATAGCATCAAACTTTATGAG'] |
| 3387 | NM_014795.3(ZEB2): c.3356A > G (p.Gln1119Arg) | 9839 | ZEB2 | ['GCTTACTTGCAGAGCATTACCCCTCRGGGG TACTCTGACTCGGAGGAGAGG'] |
| 3388 | NM_000441.1(SLC26A4): c.1151A > G (p.Glu384Gly) | 5172 | SLC26A4 | ['GTTGTCATCCAGTCTCTTCCTTAGGRATTC ATTGCCTTTGGGATCAGCAAC'] |
| 3389 | NM_000441.1(SLC26A4): c.1105A > G (p.Lys369Glu) | 5172 | SLC26A4 | ['TTATGCTATTGCAGTGTCAGTAGGARAAGT ATATGCCACCAAGTATGATTA'] |
| 3390 | NM_000441.1(SLC26A4): c.2168A > G (p.His723Arg) | 5172 | SLC26A4 | ['AAGGACACATTCTTTTTGACGGTCCRTGAT GCTATACTCTATCTACAGAAC'] |
| 3391 | NM_000441.1(SLC26A4): c.919 − 2A > G | 5172 | SLC26A4 | ['TTTTTAACATCTTTTGTTTTATTTCRGACGA TAATTGCTACTGCCATTTCA'] |
| 3392 | NM_000197.1(HSD17B3): c.703A > G (p.Met235Val) | 3293 | HSD17B3 | ['GACCCCATATGCTGTCTCGACTGCARTGAC AAAGTATCTAAATACAAATGT'] |
| 3393 | NM_000197.1(HSD17B3): c.389A > G (p.Asn130Ser) | 3293 | HSD17B3 | ['TTGTTTTGCTTCTTTCTGCCAGTCARCAATG TCGGAATGCTTCCAAACCTT'] |
| 3394 | NM_022458.3(LMBR1): c.423 + 5252A > G | 64327 | LMBR1 | ['GTTTTGATCTTAGTGTTTATTACAGRAAAT GAAGCCATATCTCACTAACTA'] |
| 3395 | NM_020366.3(RPGRIP1): c.3341A > G (p.Asp1114Gly) | 57096 | RPGRIP1 | ['CTAAATAAACATTTTCCTTATCAGGRTTCA GAGAAGATGTGCATTGAAATT'] |
| 3396 | NM_021625.4(TRPV4): c.998A > G (p.Asp333Gly) | 59341 | TRPV4 | ['CTGCATGCGCTGGTGGCCATTGCTGRCAAC ACCCGTGAGAACACCAAGTTT'] |
| 3397 | NM_004897.4(MINPP1): c.809A > G (p.Gln270Arg) | 9562 | MINPP1 | ['TTAAAAAAGTTGCAGCTACTTTGCRAGTG CCAGTAAATGATTTAAATGCA'] |
| 3398 | NM_020638.2(FGF23): c.211A > G (p.Ser71Gly) | 8074 | FGF23 | ['TGGCGCACCCCATCAGACCATCTACRGTG AGTAGGGCTTCAGGCTGGGAAG'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3399 | NM_015071.4(ARHGAP26): c.1250A > G (p.Asn417Ser) | 23092 | ARHGAP26 | ['GGGCTGTATCGAATTGTGGGTGTCAVCTCC AGAGTGCAGAAGTTGCTGAGT'] |
| 3400 | NM_021615.4(CHST6): c.521A > G (p.Lys174Arg) | 4166 | CHST6 | ['CGCTCCTACAGCCACGTGGTGCTCARGGA GGTGCGCTTCTTCAACCTGCAG'] |
| 3401 | NM_021615.4(CHST6): c.329A > G (p.Tyr110Cys) | 4166 | CHST6 | ['TGCGACATGGACGTGTTTGATGCCTRTCTG CCTTGGCGCCGCAACCTGTCC'] |
| 3402 | NM_015560.2(OPA1): c.1745A > G (p.Tyr582Cys) | 4976 | OPA1 | ['CTTGAAACTGAATGGAAGAATAACTRTCC TCGCCTGCGGGAACTTGACCGG] |
| 3403 | NM_000368.4(TSC1): c.1760A > G (p.Lys587Arg) | 7248 | TSC1 | ['AGTATCTTCACTCCCAGTCCTTGTARAATT CCACCTCCGACGAGAGTGGGC'] |
| 3404 | NM_020661.2(AICDA): c.415A > G (p.Met139Val) | 57379 | AICDA | ['CCGCGCCGGGGTGCAAATAGCCATCRTGA CCTTCAAAGGTGCGAAAGGGCC'] |
| 3405 | NM_020533.2(MCOLN1): c.406 - 2A > G | 57192 | MCOLN1 | ['ACAGGCCCTCCCCTTCTCTGCCCACRGTAC CTGGCGTTGCCTGACGTGTCA'] |
| 3406 | NM_021102.3(SPINT2): c.488A > G (p.Tyr163Cys) | 10653 | SPINT2 | ['AGGAACTCCTGCAATAACTTCATCTRTGGA GGCTGCCGGGGCAATAAGAAC'] |
| 3407 - 3410 | NM_006610.3(MASP2): c.359A > G (p.Asp120Gly) | 10747 | MASP2 | ['GGGAGGGCTGGGGTTTCTCAGGGTCRGGG GGTCCCCAAGGAGTAGCCAGGG', 'AGGGGCCAGGCTTGGCCAGGAGGGASATC AGGCCTGGGTCTTGCCTTCACT', 'GGGCAGGAGAGCACAGACACGGAGCRGGC CCTGGCAAGGACACTTTCTAC', 'AGCCTGGACATTACCTTCCGCTCCGRCTAC TCCAACGAGAAGCYGTTCACG'] |
| 3411 | NM_018965.3(TREM2): c.401A > G (p.Asp134Gly) | 54209 | TREM2 | ['GCTCTGCCTCCCATAGACCCCCTGGRTCAC CGGGATGCTGGAGATCTCTGG'] |
| 3412 | NM_007375.3(TARDBP): c.1009A > G (p.Met337Val) | 23435 | TARDBP | ['AGCACTACAGAGCAGTTGGGGTATGRTGG GCATGTTAGCCAGCCAGCAGAA'] |
| 3413 | NM_007375.3(TARDBP): c.506A > G (p.Asp169Gly) | 23435 | TARDBP | ['GTAATGTCACAGCGACATATGATAGRTGG ACGATGGTGTGACTGCAAACTT'] |
| 3414 | NM_007375.3(TARDBP): c.1028A > G (p.Gln343Arg) | 23435 | TARDBP | ['GGTATGATGGGCATGTTAGCCAGCCRGCA GAACCAGTCAGGCCCATCGGGT'] |
| 3415 | NM_007375.3(TARDBP): c.787A > G (p.Lys263Glu) | 23435 | TARDBP | ['CGTTCATATATCCAATGCCGAACCTRAGCA CAATAGCAATAGACAGTTAGA'] |
| 3416 | NM_015247.2(CYLD): c.2240A > G (p.Glu747Gly) | 1540 | CYLD | ['ATCAACAGTAACCTGAAATTTGCAGRGGT TAGTGATACTCACCTGTGGTAT'] |
| 3417 | NM_001128425.1(MUTYH): c.536A > G (p.Tyr179Cys) | 4595 | MUTYH | ['AATCAACTCTGGGCTGGCCTGGGCTRCTAT TCTCGTGGCCGGCGGCTGCAG'] |
| 3418 | NM_001128425.1(MUTYH): c.1241A > G (p.Gln414Arg) | 4595 | MUTYH | ['TCCGTGACCTGGGAGCCCTCAGAGCRGCTT CAGCGCAAGGCCCTGCTGCAG'] |
| 3419 | NM_170784.2(MKKS): c.110A > G (p.Tyr37Cys) | 8195 | MKKS | ['TTGAAAAGAATTGTAACATCATGCTRTGGC CCTCAGGTAGGCTGAAGCAG'] |
| 3420 | NM_170784.2(MKKS): c.169A > G (p.Thr57Ala) | 8195 | MKKS | ['TGGCTTTGGAGGTTACGTGTGTACARCCTC ACAGTCCTCAGCTCTGCTCAG'] |
| 3421 | NM_004795.3(KL): c.578A > G (p.His193Arg) | 9365 | KL | ['GTGCAGCCCGTGGTCACCCTGTACCRCTGG GACCTGCCCCAGCGCCTGCAG'] |
| 3422 | NM_014625.3(NPHS2): c.479A > G (p.Asp160Gly) | 7827 | NPHS2 | ['CTTTTCTTTTTTTGCCCTGCCTGGRTACCT ACCACAAGGTTGACCTTCGT'] |
| 3423 | NM_015713.4(RRM2B): c.322 - 2A > G | 50484 | RRM2B | ['CACCTCCTGACTAAAGCGCTCCACCBAAG AAGATAAGGAAAATAGATATAT'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3424 | NM_006343.2(MERTK): c.1605 - 2A > G | 10461 | MERTK | ['GAAGTATCTTTGTTTTCATTCACCCRGGAA TGCATTCACAGAGGAGGATTC'] |
| 3425 | NM_014585.5(SLC40A1): c.470A > G (p.Asp157Gly) | 30061 | SLC40A1 | ['GCTACTGCAATCACAATCCAAAGGGRTTG GATTGTTGTTGTTGCAGGAGAA'] |
| 3426 | NM_004924.4(ACTN4): c.763A > G (p.Lys255Glu) | 81 | ACTN4 | ['CGTGAACACGGCCCGGCCCGACGAGRAGG CCATAATGACCTATGTGTCCAG'] |
| 3427 | NM_012193.3(FZD4): c.1024A > G (p.Met342Val) | -1 | — | ['CAAATGGGGTCATGAAGCCATTGAARTGC ACAGCTCTTATTTCCACATTGC'] |
| 3428 | NM_012193.3(FZD4): c.766A > G (p.Ile256Val) | -1 | — | ['GTTTTCCTACCCTGAGCGCCCCATCRTATT TCTCAGTATGTGCTATAATAT'] |
|  | NM_004239.3(TRIP11): c.202 - 2A > G | 9321 | TRIP11 |  |
| 3429 | NM_004239.3(TRIP11): c.2102A > G (p.Asn701Ser) | 9321 | TRIP11 | ['AGTGTTTTTTTCCAGAGAAAGCTGAYTGTT ACCAGCAAGACATTCTTCTAA'] |
| 3430 | NM_012434.4(SLC17A5): c.548A > G (p.His183Arg) | 26503 | SLC17A5 | ['CAGGGTGTTACATTTCCAGCCATGCRTGCC ATGTGGTCTTCTTGGGCTCCC'] |
| 3431 | NM_001099274.1(TINF2): c.838A > G (p.Lys280Glu) | 26277 | TINF2 | ['ATGGGCCTCCACTAGGGGAGGCCATRAGG AGCGCCCCACAGTCATGCTGTT'] |
| 3432 | NM_012415.3(RAD54B): c.1778A > G (p.Asn593Ser) | 25788 | RAD54B | ['AGAGTTGAACAAAAGGCAGGGGTGAYTGC ACAGTTTTTAAGAGCTCCTAT'] |
| 3433 | NM_014946.3(SPAST): c.1688 - 2A > G | 6683 | SPAST | ['TAAGTGCCTGACTTTTATGTTTTACRGAAC TAAAACCAGAACAGGTGAAGA'] |
| 3434 | NM_014946.3(SPAST): c.1322A > G (p.Asp441Gly) | 6683 | SPAST | ['AGTCTTATACTTGTATTTCCTCTAGRTGAA GTTGATAGCCTTTTGTGTGAA'] |
| 3435 | NM_014946.3(SPAST): c.1245 + 4A > G | 6683 | SPAST | ['TGCAAGTTTAACTTCAAAATACGTGRGTGC TCTGTTTCCAATATTGTCGTA'] |
| 3436 | NM_014946.3(SPAST): c.1157A > G (p.Asn386Ser) | 6683 | SPAST | ['CTGTTACTCTTTGGTCCACCTGGGARTGGG AAGACAATGCTGGTAAGGGTT'] |
| 3437 | NM_014946.3(SPAST): c.1216A > G (p.Ile406Val) | 6683 | SPAST | ['AGAATCGAATGCAACCTTCTTTAATRTAAG TGCTGCAAGTTTAACTTCAAA'] |
| 3438 | NM_182643.2(DLC1): c.2875A > G (p.Thr959Ala) | 10395 | DLC1 | ['ACACCTGGATGTGGACAACGACCGARCCA CACCCAGCGACCTGGACAGCAC'] |
| 3439 | NM_194456.1(KRIT1): c.410A > G (p.Asp137Gly) | 889 | KRIT1 | ['TGCCCAATTTTTTACTGCTTACAAGRTATT ATGCGAGTCTGTAGTGAATCC'] |
| 3440 | NM_005094.3(SLC27A4): c.899A > G (p.Gln300Arg) | 10999 | SLC27A4 | ['CCAGGAAACATCGTGGGAATCGGCCRGTG CCTGCTGCATGGCATGACGGTG'] |
| 3441 | NM_004211.3(SLC6A5): c.1472A > G (p.Tyr491Cys) | 9152 | SLC6A5 | ['GGAGGCCTGATCACTCTCTCTTCTTRCAAC AAATTCCAACAACTGCTAC'] |
| 3442 | NM_004211.3(SLC6A5): c.1526A > G (p.Asn509Ser) | 9152 | SLC6A5 | ['GACACTCTAATTGTCACCTGCACCARCAGT GCCACAAGCATCTTTGCCGGC'] |
| 3443 | NM_014270.4(SLC7A9): c.695A > G (p.Tyr232Cys) | 11136 | SLC7A9 | ['GCGTTTTACAATGGACTCTGGGCCRTGAT GGATGGTGAGGTGTCCTGAGA'] |
| 3444 | NM_139025.4(ADAMTS13): c.1582A > G (p.Arg528Gly) | 11093 | ADAMTS13 | ['GAGCCTGTGTGTGTCGGGCAGCTGCRGGG TAGGCGTGTGTGGACATTGGCG'] |
| 3445 | NM_002894.2(RBBP8): c.1009A > G (p.Lys337Glu) | 5932 | RBBP8 | ['TGTATTTGGAGCTACCTCTAGTATCRAAAG TGGTTTAGATTTGAATACAAG'] |
| 3446 | NM_005682.6(ADGRG1): c.263A > G (p.Tyr88Cys) | 9289 | ADGRG1 | ['TCCTTCCCTGACCCCAGGGGCCTCTRCCAC TTCTGCCTCTACTGGAACCGA'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3447 | NM_006502.2(POLH): c.1603A > G (p.Lys535Glu) | 5429 | POLH | ['AGGAACTGAGCCCTTCTTTAAGCAGRAAA GTCTGCTTCTAAAGCAGAAACA'] |
| 3448 | NM_000334.4(SCN4A): c.4774A > G (p.Met1592Val) | 6329 | SCN4A | ['CATCTCCTTCCTCATCGTGGTCAACRTGTA CATCGCCATCATCCTGGAGAA'] |
| 3449 | NM_000334.4(SCN4A): c.3478A > G (p.Ile1160Val) | 6329 | SCN4A | ['CGCCCTCCTAGGCGCCATCCCCTCCRTCAT GAATGTGCTGCTTGTCTGCCT'] |
| 3450 | NM_000334.4(SCN4A): c.421A > G (p.Ile141Val) | 6329 | SCN4A | ['GTTCAGCATGTTCATCATGATCACCRTCTT GACCAACTGCGTATTCATGAC'] |
| 3451 | NM_003907.2(EIF2B5): c.271A > G (p.Thr91Ala) | 8893 | EIF2B5 | ['CCTGACTGCCACAGGTGTACAGGAARCAT TTGTCTTTTGTTGCTGGAAAGC'] |
| 3452 | NM_001128227.2(GNE): c.604A > G (p.Met202Val) | 10020 | GNE | ['CAGTGCAGAGCAGCACCTGATATCCRTGT GTGAGGACCATGATCGCATCCT'] |
| 3453 | NM_001029.3(RPS26): c.1A > G (p.Met1Val) | 6231 | RPS26 | ['CCTCTCTCCGGTCCGTGCCTCCAAGDTGGT GAGTCTTCTTGCGTGGTGAGG'] |
| 3454 | NM_012082.3(ZFPM2): c.1969A > G (p.Ser657Gly) | -1 | — | ['TCAAACTAAGAAGCTCTCCACCTCCRGTAA CAATGATGACAAAATTAATGG'] |
| 3455 | NM_012082.3(ZFPM2): c.89A > G (p.Glu30Gly) | 23414 | ZFPM2 | ['GATGAGGAAGAAGAATGTCCATCAGRGGA AACAGACATCATCTCCAAAGGA'] |
| 3456 | NM_012082.3(ZFPM2): c.2527A > G (p.Thr843Ala) | -1 | — | ['AAAGTGTTTATCTCAGTCTGAGCGGRCGAC CACGTCTCCCAAAAGGCTGCT'] |
| 3457 | NM_194248.2(OTOF): c.766 - 2A > G | 9381 | OTOF | ['TCTGGCTCCCCCTTCTCCTGCCTGCRGGTC AGCATCACGGTGATCGAGGCC'] |
| 3458 | NM_003705.4(SLC25A12): c.1769A > G (p.Gln590Arg) | 8604 | SLC25A12 | ['GCTCGAGTGTTTCGATCCTCTCCCCRGTTT GGTGTTACCTTGGTCACTTAT'] |
| 3459 | NM_004621.5(TRPC6): c.428A > G (p.Asn143Ser) | 7225 | TRPC6 | ['AATGCCCTACAGTTGGCAGTGGCCARTGA GCATCTGGAAATTACAGAACTT'] |
| 3460 | NM_152384.2(BBS5): c.522 + 3A > G | 129880 | BBS5 | ['TTTGGAATTTATCCAGTGATCAGGTRTTGT GCAAAGAGCTAGTGAACCTTT'] |
| 3461 | NM_152384.2(BBS5): c.547A > G (p.Thr183Ala) | 129880 | BBS5 | ['GGGCAATTTAGGAACCTTTTTTATTRCCAA TGTGAGAATTGTGTGGCATGC'] |
| 3462 | NM_001257342.1(BCS1L): c.232A > G (p.Ser78Gly) | 617 | BCS1L | ['CCACAGTACCCGTACTCAGCACCTCRGTGT CGAGACTTCGTACCTTCAGCA'] |
| 3463 | NM_004328.4(BCS1L): c.148A > G (p.Thr50Ala) | 617 | BCS1L | ['GGCATTCCGGCGCCATTACATGATCRCACT GGAAGTCCCTGCTCGAGACAG'] |
| 3464 | NM_003839.3(TNFRSF11A): c.508A > G (p.Arg170Gly) | 8792 | TNFRSF11A | ['TGCCTTTTCCTCCACGGACAAATGCRGACC CTGGACCAAGTAAGTAACAAC'] |
| 3465 | NM_030761.4(WNT4): c.647A > G (p.Glu216Gly) | 54361 | WNT4 | ['TGCCACGGGTGTCAGGCTCCTGTGRGGT AAAGACGTGCTGGCGAGCCGTG'] |
| 3466 | NM_022817.2(PER2): c.1984A > G (p.Ser662Gly) | 8864 | PER2 | ['GCTGGCACTGCCGGGCAAGGCAGAGRGTG TGGCGTCGCTCACCAGCCAGTG'] |
| 3467 | NM_002977.3(SCN9A): c.1964A > G (p.Lys655Arg) | -1 | — | ['TAGGGCACGACCAATCAAATACACARGAA AAGGCGTTGTAGTTCCTATCTC'] |
| 3468 | NM_002977.3(SCN9A): c.184A > G (p.Ile62Val) | 6335 | SCN9A | ['GGAAGCTGGCAAACAGCTGCCCTTCRTCT ATGGGGACATTCCTCCCGGCAT'] |
| 3469 | NM_002977.3(SCN9A): c.29A > G (p.Gln10Arg) | 6335 | SCN9A | ['GCAATGTTGCCTCCCCCAGGACCTCRGAGC TTTGTCCATTTCACAAACAG'] |
| 3470 | NM_001457.3(FLNB): c.604A > G (p.Met202Val) | 2317 | FLNB | ['GCCTGTGGATAATGCACGAGAAGCCRTGC AGCAGGCAGATGACTGGCTGGG'] |

TABLE 7-continued

Diseases/disorders containging A to G Changes. The table includes human gene
mutations that may be corrected by changing a guanine (G) to adenine (A). The gene name,
gene symbol, and Gene ID are indicated.

| SEQ ID NO: | Name | Gene ID | Gene Symbol | Flanks |
|---|---|---|---|---|
| 3471 | NM_003060.3(SLC22A5): c.632A > G (p.Tyr211Cys) | 6584 | SLC22A5 | ['GTAGGCATGGGCCAGATCTCCAACTRTGT GGCAGCATTTGTCCTGGGTATG'] |
| 3472 | NM_000369.2(TSHR): c.1856A > G (p.Asp619Gly) | 7253 | TSHR | ['CCGCAGTACAACCCAGGGGACAAAGRTAC CAAAATTGCCAAGAGGATGGCT'] |
| 3473 | NM_000369.2(TSHR): c.548A > G (p.Lys183Arg) | 7253 | TSHR | ['TCTCTTCTCTCTGTTGGTTGTAGGARGCTG TACAACAATGGCTTTACTTCA'] |
| 3474 | NM_001430.4(EPAS1): c.1603A > G (p.Met535Val) | 2034 | EPAS1 | ['GGAGACACTGGCACCCTATATCCCCRTGG ACGGGGAAGACTTCCAGCTAAG'] |
| 3475 | NM_024009.2(GJB3): c.421A > G (p.Ile141Val) | 2707 | GJB3 | ['GTTCAGCCTCATCTTCAAGCTCATCRTTGA GTTCCTCTTCCTCTACCTGCT'] |
| 3476 | NM_024009.2(GJB3): c.497A > G (p.Asn166Ser) | 2707 | GJB3 | ['ATGCCGCGCCTGGTGCAGTGTGCCADCGT GGCCCCCTGCCCCAACATCGTG'] |
| 3477 | NM_001080463.1(DYNC2H1): c.11284A > G (p.Met3762Val) | 79659 | DYNC2H1 | ['TGTTTTTTTGCTTTTGTAGGTTGCCRTGGGT CAAGGTCAAGCTGATTTAGC'] |
| 3478 | NM_001080463.1(DYNC2H1): c.9044A > G (p.Asp3015Gly) | 79659 | DYNC2H1 | ['CGCATGCCACCTGATGTAATTAGAGRTATT CTTGAAGGAGTTTTAAGGTTG'] |
| 3479 | NM_001080463.1(DYNC2H1): c.4610A > G (p.Gln1537Arg) | 79659 | DYNC2H1 | ['GTTGACCCATCTCTGTTCCCTTCACRGGTA AGGGGGCTTACGTGTAGAAGC'] |
| 3480 | NM_001080463.1(DYNC2H1): c.5959A > G (p.Thr1987Ala) | 79659 | DYNC2H1 | ['TGGTCCAAGTGGTGCTGGAAAATCARCGC TTTGGAGAATGTTAAGGGCTGC'] |
| 3481 | NM_007035.3(KERA): c.740A > G (p.Asn247Ser) | 11081 | KERA | ['GTGGCCTTTTTGAGACTAAATCACARCAAA CTGTCAGATGAGGGTCTCCCA'] |
| 3482 | NM_003722.4(TP63): c.697A > G (p.Lys233Glu) | 8626 | TP63 | ['TATCCGCGCCATGCCTGTCTACAAARAAGC TGAGCACGTCACGGAGGTGGT'] |
| 3483 | NM_003722.4(TP63): c.1052A > G (p.Asp351Gly) | 8626 | TP63 | ['CGGATCTGTGCTTGCCCAGGAAGAGRCAG GAAGGCGGATGAAGATAGCATC'] |
| 3484 | NM_003722.4(TP63): c.1054A > G (p.Arg352Gly) | 8626 | TP63 | ['GATCTGTGCTTGCCCAGGAAGAGACRGGA AGGCGGATGAAGATAGCATCAG'] |
| 3485 | NM_003742.2(ABCB11): c.890A > G (p.Glu297Gly) | 8647 | ABCB11 | ['AGAACAGTGGCTGCTTTTGGTGGTGRGAA AAGAGAGGTTGAAAGGTTGGTT'] |
| 3486 | NM_006702.4(PNPLA6): c.3034A > G (p.Met1012Val) | 10908 | PNPLA6 | ['GGACCTCACGTACCCAGTCACCTCCRTGTT CACTGGGTCTGCCTTTAACCG'] |
| 3487 | NM_006412.3(AGPAT2): c.589 - 2A > G | 10555 | AGPAT2 | ['GTACACCACGGGGACGATGGGCACCYGCA GGCAGGGAGACGCACAGCTGAG'] |
| 3488 | NM_001084.4(PLOD3): c.668A > G (p.Asn223Ser) | 8985 | PLOD3 | ['AAGTCTCGGATCTTTCAGAACCTCARCGGG GCTTTAGGTGAGGAGGAAGAC'] |
| 3489 | NM_138554.4(TLR4): c.896A > G (p.Asp299Gly) | 7099 | TLR4 | ['GCATACTTAGACTACTACCTCGATGRTATT ATTGACTTATTTAATTGTTTG'] |
| 3490 | NM_001130978.1(DYSF): c.3892A > G (p.Ile1298Val) | 8291 | DYSF | ['GGGCCAGGTGCAGGAGACATCAAGGRTCC TGGATGAGGTGAGCTGGGCGTG'] |
| 3491 | NM_001130978.1(DYSF): c.5264A > G (p.Glu1755Gly) | 8291 | DYSF | ['CTTTTTTGTCTTCTCTCTGGGGCAGRGGCT GGCAGGATCCCAAACCCACAC'] |
| 3492 | NM_003494.3(DYSF): c.3443 - 33A > G | 8291 | DYSF | ['CAGCTCTTAACCACTCCAGCCACTCRCTCT GGCACCTCTGTTTTTTCCCTT'] |
| 3493 | NM_003494.3(DYSF): c.1285 - 2A > G | 8291 | DYSF | ['AACTTGTCCCCTCCCTGTGTCTTCTRGCTGT GCAGCAAGATCTTGGAGAAG'] |
| 3494 | NM_005450.4(NOG): c.665A > G (p.Tyr222Cys) | 9241 | NOG | ['CGCTGCGGCTGGATTCCCATCCAGTRCCCC ATCATTTCCGAGTGCAAGTGC'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3495 | NM_004629.1(FANCG): c.925 - 2A > G | 2189 | FANCG | ['GATACAATTTTTTCTTTCTCTTTTRGGCCT TGAATGTCCCATGCAGTTCC'] |
| 3496 | NM_001701.3(BAAT): c.226A > G (p.Met76Val) | 570 | BAAT | ['AGGGGATTATATGGGAGTCCACCCCRTGG GTCTCTTCTGGTCTCTGAAACC'] |
| 3497 | NM_006892.3(DNMT3B): c.2450A > G (p.Asp817Gly) | 1789 | DNMT3B | ['TTTGGCTTTCCTGTGCACTACACAGRCGTG TCCAACATGGGCCGTGGTGCC'] |
| 3498 | NM_001360.2(DHCR7): c.839A > G (p.Tyr280Cys) | 1717 | DHCR7 | ['GCTGCTTCTGTCTTGCAGGCCATCTRCGTG ATTGACTTCTTCTGGAACGAA'] |
| 3499 | NM_001360.2(DHCR7): c.1A > G (p.Met1Val) | 1717 | DHCR7 | ['AAGGTTCTCTTTCTTGCAGGGCCCARTGGC TGCAAAATCGCAACCCAACAT'] |
| 3500 | NM_032119.3(ADGRV1): c.18131A > G (p.Tyr6044Cys) | 84059 | ADGRV1 | ['TATCATCAGAGCATGTCACAGATCTRTGGA CTCATTCATGGTGACCTGTAA'] |
| 3501 | NM_004984.2(KIF5A): c.767A > G (p.Asn256Ser) | 3798 | KIF5A | ['GTGCTGGACGAGGCAAAGAATATCARCAA GTCACTGTCAGCTCTGGGCAAT'] |
| 3502 | NM_004984.2(KIF5A): c.827A > G (p.Tyr276Cys) | 3798 | KIF5A | ['GTCTCCTTCCTCCCCCAGAAAAGCTRTGTT CCATATCGTGACAGCAAAATG'] |
| 3503 | NM_007373.3(SHOC2): c.4A > G (p.Ser2Gly) | 8036 | SHOC2 | ['TTTTGTCCAGGCTTGAGTCACCATGRGTAG TAGTTTAGGAAAAGAAAAGA'] |
| 3504 | NM_016203.3(PRKAG2): c.1148A > G (p.His383Arg) | 51422 | PRKAG2 | ['TACTCCTTGATCAAAAATAAAATCCRCAG ATTGCCCGTTATTGACCCTATC'] |
| 3505 | NM_016203.3(PRKAG2): c.1589A > G (p.His530Arg) | 51422 | PRKAG2 | ['GTCCTGCTTTTCTCTTTGCAGGTCCRTCGG CTGGTGGTGGTAAATGAAGCA'] |
| 3506 | NM_003816.2(ADAM9): c.411 - 8A > G | 8754 | ADAM9 | ['TTAAAATTTGTATACGTGTAATGCARCATT CAGAGGATTGCTGCATTTAGA'] |
| 3507 | NM_003002.3(SDHD): c.341A > G (p.Tyr114Cys) | 6392 | SDHD | ['GGCCTTGGACAAGTTGTTACTGACTRTGTT CATGGGGATGCCTTGCAGAAA'] |
| 3508 | NM_003002.3(SDHD): c.149A > G (p.His50Arg) | 6392 | SDHD | ['GAATGGTGTGGAGTGCAGCACATACRCTT GTCACCGAGCCACCATTGTATG'] |
| 3509 | NM_003002.3(SDHD): c.1A > G (p.Met1Val) | 6392 | SDHD | ['ATGACCTTGAGCCCTCAGGAACGAGDTGG CGGTTCTCTGGAGGCTGAGTGC'] |
| 3510 | NM_002485.4(NBN): c.511A > G (p.Ile171Val) | 4683 | NBN | ['TCAGTAAAATATTCTGGCTTTACAAYTGGA CGTCCACAAATGAGTGCACAT'] |
| 3511 | NM_170695.3(TGIF1): c.838A > G (p.Thr280Ala) | 7050 | TGIF1 | ['TTCCTGTACAGCTGGGCCAAACCCARCCCT AGGGAGGCCACTGTCTCCTAA'] |
| 3512 | NM_002408.3(MGAT2): c.785A > G (p.His262Arg) | 4247 | MGAT2 | ['CTTATACTTTTCCTAGAAGAGGATCRCTAC TTAGCCCCAGACTTTTACCAT'] |
| 3513 | NM_002408.3(MGAT2): c.952A > G (p.Asn318Asp) | 4247 | MGAT2 | ['GAAAACTTGGAAATCCACAGAGCACRATA TGGGTCTAGCCTTGACCCGGAA'] |
| 3514 | NM_005422.2(TECTA): c.5609A > G (p.Tyr1870Cys) | 7007 | TECTA | ['CAGTCCAATGGCACGCATATCATGTRTAA AAACACACTCTGGATCGAAAGC'] |
| 3515 | NM_012233.2(RAB3GAP1): c.649 - 2A > G | 22930 | RAB3GAP1 | ['GGTATTGTCTTTGCATGTATTTCCTRGGGA TGTCCTTTAACTCCATTGCCT'] |
| 3516 | NM_005025.4(SERPINI1): c.1013A > G (p.His338Arg) | 5274 | SERPINI1 | ['GAGATTTTCTTTCCAAAGCAATTCRCAAG TCCTTCCTAGAGGTTAATGAA'] |
| 3517 | NM_001040667.2(HSF4): c.256A > G (p.Ile86Val) | 3299 | HSF4 | ['AGACGGTTTTCGGAAGGTGGTGAGCRTCG AGCAGGGCGGCCTGCTTAGGCC'] |
| 3518 | NM_001008211.1(OPTN): c.1433A > G (p.Glu478Gly) | 10133 | OPTN | ['GTTTACTGTTCTGATTTTCATGCTGRAAGA GCAGCGAGAGAGAAAATTCAT'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3519 | NM_000492.3(CFTR): c.2738A > G (p.Tyr913Cys) | 1080 | CFTR | ['GTGATTATCACCAGCACCAGTTCGTRTTAT GTGTTTTACATTTACGTGGGA'] |
| 3520 | NM_000492.3(CFTR): c.3717 + 4A > G | 1080 | CFTR | ['CTCAATAAGTCCTGGCCAGAGGGTGRGAT TTGAACACTGCTTGCTTTGTTA'] |
| 3521 | NM_000492.3(CFTR): c.1666A > G (p.Ile556Val) | 1080 | CFTR | ['ACTGAGTGGAGGTCAACGAGCAAGARTTT CTTTAGCAAGGTGAATAACTAA'] |
| 3522 | NM_000492.3(CFTR): c.326A > G (p.Tyr109Cys) | 1080 | CFTR | ['TTACTGGGAAGAATCATAGCTTCCTRTGAC CCGGATAACAAGGAGGAACGC'] |
| 3523 | NM_000492.3(CFTR): c.273 + 4A > G | 1080 | CFTR | ['TGGAATCTTTTTATATTTAGGGGTARGGAT CTCATTTGTACATTCATTATG'] |
| 3524 | NM_000492.3(CFTR): c.3254A > G (p.His1085Arg) | 1080 | CFTR | ['CTGTTCCACAAAGCTCTGAATTTACRTACT GCCAACTGGTTCTTGTACCTG'] |
| 3525 | NM_000492.3(CFTR): c.3700A > G (p.Ile1234Val) | 1080 | CFTR | ['CATATTAGAGAACATTTCCTTCTCANTAAG TCCTGGCCAGAGGGTGAGATT'] |
| 3526 | NM_000492.3(CFTR): c.650A > G (p.Glu217Gly) | 1080 | CFTR | ['GCACTCCTCATGGGGCTAATCTGGGRGTTG TTACAGGCGTCTGCCTTCTGT'] |
| 3527 | NM_001005360.2(DNM2): c.1684A > G (p.Lys562Glu) | 1785 | DNM2 | ['CCTCCACCCTCAGGAGAAAGAGAAGRAGT ACATGCTGCCTCTGGACAACCT'] |
| 3528 | NM_001814.4(CTSC): c.857A > G (p.Gln286Arg) | 1075 | CTSC | ['TCTCAGACCCCAATCCTAAGCCCTCRGGAG GTTGTGTCTTGTAGCCAGTAT'] |
| 3529 | NM_001814.4(CTSC): c.1235A > G (p.Tyr412Cys) | 1075 | CTSC | ['AATCATGCTGTTCTGCTTGTGGGCRTGGC ACTGACTCAGCCTCTGGGATG] |
| 3530 | NM_001814.4(CTSC): c.1040A > G (p.Tyr347Cys) | 1075 | CTSC | ['CGTTATTACTCCTCTGAGTACCACTRTGTA GGAGGTTTCTATGGAGGCTGC'] |
| 3531 | NM_005144.4(HR): c.-218A > G | 55806 | HR | ['TCCGACCCCTCCAACCTGCGGCCCTRGAGC GCCCCCGCCGCCCCGGGGAA'] |
| 3532 | NM_172107.2(KCNQ2): c.851A > G (p.Tyr284Cys) | 3785 | KCNQ2 | ['ACCACCATTGGCTACGGGGACAAGTRCCC CCAGACCTGGAACGGCAGGCTC'] |
| 3533 | NM_001303.3(COX10): c.1007A > G (p.Asp336Gly) | 1352 | COX10 | ['GCCCTGAGCTGGGGCCTCCGTGAAGDCTA CTCCCGGGGCGGCTACTGCATG'] |
| 3534 | NM_006214.3(PHYH): c.135 - 2A > G | 5264 | PHYH | ['AGAACGTTATTATCCAGAGTATACCYAAA GGAGAAAAGAATCCCAAATA'] |
| 3535 | NM_002284.3(KRT86): c.340A > G (p.Asn114Asp) | -1 | — | ['GGAGAAGGAGCAGATCAAGTCCCTCVACA GCAGGTTCGCGGCCTTCATCGA'] |
| 3536 | NM_003865.2(HESX1): c.541A > G (p.Thr181Ala) | 8820 | HESX1 | ['TCTAATGGCGAAAAAAAATTTCAACRCAA ATCTGCTGGAATAGATAGAAAA'] |
| 3537 | NM_000303.2(PMM2): c.563A > G (p.Asp188Gly) | 5373 | PMM2 | ['TTTGATGTCTTTCCTGATGGATGGRCAAG AGATACTGTCTGCGACATGTG'] |
| 3538 | NM_000288.3(PEX7): c.340 - 10A > G | 5191 | PEX7 | ['TCTTTTGCTTTCTAAACACTTTTCARTGTTT TTAGGTGTATAGTGTTGATT'] |
| 3539 | NM_004044.6(ATIC): c.1277A > G (p.Lys426Arg) | 471 | ATIC | ['CTCATCGTAGCCACCATTGCTGTCARGTAC ACTCAGTCTAACTCTGTGTGC'] |
| 3540 | NM_000314.6(PTEN): c.368A > G (p.His123Arg) | 5728 | PTEN | ['GATGACAATCATGTTGCAGCAATTCRCTGT AAAGCTGGAAAGGGACGAACT'] |
| 3541 | NM_000314.6(PTEN): c.278A > G (p.His93Arg) | 5728 | PTEN | ['GTTGCACAATATCCTTTTGAAGACCRTAAC CCACCACAGCTAGAACTTATC'] |
| 3542 | NM_000314.6(PTEN): c.755A > G (p.Asp252Gly) | 5728 | PTEN | ['CCTCAGCCGTTACCTGTGTGTGGTGRTATC AAAGTAGAGTTCTTCCACAAA'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3543 | NM_018488.2(TBX4): c.1592A > G (p.Gln531Arg) | 9496 | TBX4 | ['TCCTTGTCCCGAGAATCTTCCTTACRGTAC CATTCAGGAATGGGGACTGTG'] |
| 3544 | NM_000223.3(KRT12): c.403A > G (p.Arg135Gly) | 3859 | KRT12 | ['AGAAACTATGCAAAATCTTAATGATRGAT TAGCTTCCTACCTGGATAAGGT'] |
| 3545 | NM_000503.5(EYA1): c.1639A > G (p.Arg547Gly) | 2138 | EYA1 | ['TGAGAGAATAATTCAAAGGTTTGGARGAA AAGTGGTGTATGTTGTTATAGG'] |
| 3546 | NM_000261.1(MYOC): c.1010A > G (p.Gln337Arg) | 4653 | MYOC | ['GTGTACTCGGGGAGCCTCTATTTCCRGGGC GCTGAGTCCAGAACTGTCATA'] |
| 3547 | NM_000261.1(MYOC): c.1267A > G (p.Lys423Glu) | 4653 | MYOC | ['ACAAACCTGGGAGACAAACATCCGTRAGC AGTCAGTCGCCAATGCCTTCAT'] |
| 3548 | NM_000474.3(TWIST1): c.466A > G (p.Ile156Val) | 7291 | TWIST1 | ['GACCCTCAAGCTGGCGGCCAGGTACRTCG ACTTCCTCTACCAGGTCCTCCA'] |
| 3549 | NM_001089.2(ABCA3): c.1702A > G (p.Asn568Asp) | 21 | ABCA3 | ['ACAGATCACCGTCCTGCTGGGCCACRACG GTGCCGGGAAGACCACCACCCT'] |
| 3550 | NM_005055.4(RAPSN): c.-210A > G | 5913 | RAPSN | ['ATTCCTCAGAGGCCATGTGGCCCCARCTGG CAGCGACAGCTGCAGACGGGC'] |
| 3551 | NM_198217.2(ING1): c.515A > G (p.Asn172Ser) | 3621 | ING1 | ['AACGAACCCACGTACTGTCTGTGCARCCA GGTCTCCTATGGGGAGATGATC'] |
| 3552 | NM_000430.3(PAFAH1B1): c.446A > G (p.His149Arg) | 5048 | PAFAH1B1 | ['GATTTTGAACGAACTCTTAAAGGACRTAC AGACTCTGTACAGGACATTTCA'] |
| 3553 | NM_000579.3(CCR5): c.-301 + 246A > G | -1 | — | ['TACGGGGAGAGTGGAGAAAAAGGGGRCA CAGGGTTAATGTGAAGTCCAGGA'] |
| 3554 | NM_000264.3(PTCH1): c.2479A > G (p.Ser827Gly) | -1 | — | ['ACTTTACGACCTACACAGGAGTTTCRGTAA CGTGAAGTATGTCATGTTGGA'] |
| 3555 | NM_001184.3(ATR): c.2022A > G (p.Gly674=) | 545 | ATR | ['TCTGCTGCTGCAATAAGATAAAAAAYCCA CTAACACAACTAGCCCGGATTA'] |
| 3556 | NM_005982.3(SIX1): c.386A > G (p.Tyr129Cys) | 6495 | SIX1 | ['ATCTGGGACGGCGAGGAGACCAGCTRCTG CTTCAAGGAGAAGTCGAGGGGT'] |
| 3557 | NM_006267.4(RANBP2): c.1966A > G (p.Ile656Val) | 5903 | RANBP2 | ['AGAAGACGCACACATAACTTTTGCTRTATT GGATGCAGTAAATGGAAATAT'] |
| 3558 | NM_001001557.2(GDF6): c.1271A > G (p.Lys424Arg) | 392255 | GDF6 | ['CCGCCCAGCTGCTGCGTGCCCACCARATTG ACTCCCATCAGCATTCTATAC'] |
| 3559 | NM_000557.4(GDF5): c.517A > G (p.Met173Val) | 8200 | GDF5 | ['ACCCCCCATCACACACCCCACGAGTACVTGCT CTCGCTGTACAGGACGCTGTC'] |
| 3560 | NM_000392.4(ABCC2): c.4145A > G (p.Gln1382Arg) | 1244 | ABCC2 | ['CGAGAGAAGCTGACCATCATCCCCCRGGT GAGCTCTAGAACTTACTCGGGC'] |
| 3561 | NM_000396.3(CTSK): c.990A > G (p.Ter330Trp) | 1513 | CTSK | ['ACCTGGCCAGCTTCCCCAAGATGTGRCTCC AGCCAGCCAAATCCATCCTGC'] |
| 3562 | NM_001127221.1(CACNA1A): c.4151A > G (p.Tyr1384Cys) | 773 | CACNA1A | ['AACGTCTTCAACATCCTCATCGTCTRCATG CTATTCATGTTCATCTTCGCC'] |
| 3563 | NM_000178.2(GSS): c.656A > G (p.Asp219Gly) | 2937 | GSS | ['CAAGAGAAGGAAAGAAACATATTTGRCCA GCGTGCCATAGAGAATGAGCTA'] |
| 3564 | NM_000901.4(NR3C2): c.2327A > G (p.Gln776Arg) | 4306 | NR3C2 | ['ACGCTCAACCGCTTAGCAGGCAAACRGAT GATCCAAGTCGTGAAGTGGGCA'] |
| 3565 | NM_000901.4(NR3C2): c.2915A > G (p.Glu972Gly) | 4306 | NR3C2 | ['ATCAGCGACCAGCTGCCCAAGGTGGRGTC GGGGAACGCCAAGCCGCTCTAC'] |
| 3566 | NM_004407.3(DMP1): c.1A > G (p.Met1Val) | 1758 | DMP1 | ['CCAGGTAGAGGTATCACACCCAACTRTGA AGATCAGCATCCTGCTCATGTT'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3567 | NM_004999.3(MYO6): c.737A > G (p.His246Arg) | 4646 | MYO6 | ['CAAGGCAAAGAGGAAAGAAATTATCRTAT CTTTTATAGGTTGTGTGCTGGT'] |
| 3568 | NM_000256.3(MYBPC3): c.175A > G (p.Thr59Ala) | 4607 | MYBPC3 | ['CGCCAGCAACAAGTACGGCCTGGCCRCAG AGGGCACACGGCATACGCTGAC'] |
| 3569 | NM_000163.4(GHR): c.594A > G (p.Glu198=) | 2690 | GHR | ['TGGAGTATGAACTTCAATACAAAGARGTA AATGAAACTAAATGGAAAATGG'] |
| 3570 | NM_000525.3(KCNJ11): c.509A > G (p.Lys170Arg) | 3767 | KCNJ11 | ['ATCATGCTTGGCTGCATCTTCATGARGACT GCCCAAGCCCACCGCAGGGCT'] |
| 3571 | NM_000525.3(KCNJ11): c.776A > G (p.His259Arg) | 3767 | KCNJ11 | ['CTGGTGGCCCCGCTGATCATCTACCRTGTC ATTGATGCCAACAGCCCACTC'] |
| 3572 | NM_000182.4(HADHA): c.180 + 3A > G | 3030 | HADHA | ['GAAAAAACTGCAAATTAAATGAGAYACC TTTGAATTGGGAGAGTTAATTC'] |
| 3573 | NM_005263.3(GFI1): c.1145A > G (p.Asn382Ser) | 2672 | GFI1 | ['GGCAAGGCATTCAGCCAGAGCTCCARCCT CATCACCCACAGCCGCAAACAC'] |
| 3574 | NM_005263.3(GFI1): c.1208A > G (p.Lys403Arg) | 2672 | GFI1 | ['CCCTTCGGCTGCGACCTCTGTGGGARGGGT TTCCAGAGGAAGGTGGACCTC'] |
| 3575 | NM_001893.4(CSNK1D): c.130A > G (p.Thr44Ala) | 1453 | CSNK1D | ['TGCCATCAAGCTTGAATGTGTCAAARCCA AACACCCTCAGCTCCACATTGA'] |
| 3576 | NM_006204.3(PDE6C): c.1363A > G (p.Met455Val) | 5146 | PDE6C | ['AAACAGAAAGGACATTGCTCAGGAARTGC TCATGAACCAAACCAAAGCCAC'] |
| 3577 | NM_006204.3(PDE6C): c.1483 - 2A > G | 5146 | PDE6C | ['TGAAACAACCCATCCTTATTTCAACRGAAA GAGGACTTGCCAGACCCACGC'] |
| 3578 | NM_003476.4(CSRP3): c.206A > G (p.Lys69Arg) | 8048 | CSRP3 | ['TGCTATGGGCGCAGATATGGCCCCARAGG GATCGGGTATGGACAAGGCGCT'] |
| 3579 | NM_005591.3(MRE11A): c.350A > G (p.Asn117Ser) | 4361 | MRE11A | ['GTGAACTATCAAGATGGCAACCTCARCAT TTCAATTCCAGTGTTTAGTATT'] |
| 3580 | NM_000107.2(DDB2): c.730A > G (p.Lys244Glu) | 1643 | DDB2 | ['TTGGAATCTCAGAATGCACAAAAAGRAAG TGACGCATGTGGCCCTGAACCC'] |
| 3581 | NM_001204.6(BMPR2): c.1454A > G (p.Asp485Gly) | 659 | BMPR2 | ['AAGGAGACAATCGAAGACTGTTGGGRCCA GGATGCAGAGGCTCGGCTTACT'] |
| 3582 | NM_000336.2(SCNN1B): c.863A > G (p.Asn288Ser) | 6338 | SCNN1B | ['ACAGAGAAGGCACTTCCTTCGGCCRCCC TGGAACTGAATTCGGTGAGTTT'] |
| 3583 | NM_000447.2(PSEN2): c.715A > G (p.Met239Val) | 5664 | PSEN2 | ['CTACCTCATCATGATCAGTGCGCTCRTGGC CCTAGTGTTCATCAAGTACCT'] |
| 3584 | NM_002181.3(IHH): c.284A > G (p.Glu95Gly) | 3549 | IHH | ['CCAGACATCATCTTCAAGGACGAGGRGAA CACAGGCGCCGACCGCCTCATG'] |
| 3585 | NM_000310.3(PPT1): c.236A > G (p.Asp79Gly) | 5538 | PPT1 | ['ACTTCTCTCTGGCTTCTTTTTTAGGRCGTGG AGAACAGCTTCTTCTTGAAT'] |
| 3586 | NM_003051.3(SLC16A1): c.610A > G (p.Lys204Glu) | 6566 | SLC16A1 | ['GCGACCAATCGGGCCCAAGCCAACCRAGG CAGGGAAAGATAAGTCTAAAGC'] |
| 3587 | NM_005587.2(MEF2A): c.788A > G (p.Asn263Ser) | 4205 | MEF2A | ['TCTCCCCCTCCACCAGGTGGTGGTARTCTT GGAATGAACAGTAGGAAACCA'] |
| 3588 | NM_000098.2(CPT2): c.638A > G (p.Asp213Gly) | 1376 | CPT2 | ['TACCTGGTCAATGCGTATCCCCTGGRTATG TCCCAGTATTTTCGGCTTTTC'] |
| 3589 | NM_000098.2(CPT2): c.359A > G (p.Tyr120Cys) | 1376 | CPT2 | ['TTTTTAGGACCCTGGTTTGATATGTRCCTA TCTGCTCGAGACTCCGTTGTT'] |
| 3590 | NM_001079668.2(NKX2-1): c.464 - 2A > G | 7080 | NKX2-1 | ['TCGCCGGGCCCATGAAGCGGGAGACHGTA AGCGACAAACGCACAGCGTCGG'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3591 | NM_004387.3(NKX2-5): c.896A > G (p.Asp299Gly) | 1482 | NKX2-5 | ['AACTTCGTGAACTTCGGCGTCGGGGRCTTG AATGCGGTTCAGAGCCCCGGG'] |
| 3592 | NM_004387.3(NKX2-5): c.547A > G (p.Lys183Glu) | 1482 | NKX2-5 | ['GCTGAAACTCACGTCCACGCAGGTCRAGA TCTGGTTCCAGAACCGGCGCTA'] |
| 3593 | NM_178138.4(LHX3): c.332A > G (p.Tyr111Cys) | 8022 | LHX3 | ['GTGCGCCGCGCCCAGGACTTCGTGTRCCAC CTGCACTGCTTTGCCTGCGTC'] |
| 3594 | NM_001698.2(AUH): c.263 − 2A > G | 549 | AUH | ['CTTGTACTTTTTTTCCCCTTTAACTRGGAAT TGTGGTGCTTGGAATAAACA'] |
| 3595 | NM_001698.2(AUH): c.943 − 2A > G | 549 | AUH | ['ACATATTTAATATTTTGTTTTTCTTRGACCA TTCCAACAAAAGACAGACTT'] |
| 3596 | NM_001876.3(CPT1A): c.1361A > G (p.Asp454Gly) | 1374 | CPT1A | ['ATGTGTGTTTCACGTAGGTGGTTTGRCAAG TCGTTCACGTTTGTTGTCTTC'] |
| 3597 | NM_001876.3(CPT1A): c.1079A > G (p.Glu360Gly) | 1374 | CPT1A | ['CGGCTGCTGAAGCCCCGGGAGATGGRGCA GCAGATGCAGAGGATCCTGGAC'] |
| 3598 | NM_001876.3(CPT1A): c.1493A > G (p.Tyr498Cys) | 1374 | CPT1A | ['TCCATTGACAGCCTCCAGCTGGGCRTGCG GAGGATGGGCACTGCAAAGGC'] |
| 3599 | NM_000352.4(ABCC8): c.4270A > G (p.Ile1424Val) | 6833 | ABCC8 | ['CACCCTGCGCTCACGCCTCTCCATCRTCCT GCAGGACCCCGTCCTCTTCAG'] |
| 3600 | NM_000352.4(ABCC8): c.215A > G (p.Asn72Ser) | 6833 | ABCC8 | ['ACATGGCTTCATTTCCCTGGGCACARCCTG CGGTGGATCCTGACCTTCATG'] |
| 3601 | NM_002180.2(IGHMBP2): c.638A > G (p.His213Arg) | 3508 | IGHMBP2 | ['TCTCAGAAAGAACTTGCCATCATCCRTGGA CCTCCTGGCACTGGGAAAACC'] |
| 3602 | NM_033163.3(FGF8): c.298A > G (p.Lys100Glu) | 2253 | FGF8 | ['GAAGCACGTGCAGGTCCTGGCCAACRAGC GCATCAACGCCATGGCAGAGGA'] |
| 3603 | NM_006180.4(NTRK2): c.2165A > G (p.Tyr722Cys) | 4915 | NTRK2 | ['TCCCGGGACGTGTACAGCACTGACTRCTAC AGGGTGAGTAGCTGTGCAGAT'] |
| 3604 | NM_033028.4(BBS4): c.157 − 2A > G | 585 | BBS4 | ['TCAGAAGCATTTTTCTCCCTCTTTCRGGCT GTTATCAAAGAACAGCTTCAA'] |
| 3605 | NM_000409.3(GUCA1A): c.296A > G (p.Tyr99Cys) | 2978 | GUCA1A | ['AAGCTCCGCTGGTACTTCAAGCTCTRTGAT GTAGATGGCAACGGCTGCATT'] |
| 3606 | NM_000344.3(SMN1): c.815A > G (p.Tyr272Cys) | 6606 | SMN1 | ['TTAATTTCATGGTACATGAGTGGCTRTCAT ACTGGCTATTATATGTAAGT'] |
| 3607 | NM_000344.3(SMN1): c.784A > G (p.Ser262Gly) | 6606 | SMN1 | ['TCTTGATGATGCTGATGCTTTGGARGTAT GTTAATTTCATGGTACATGAG'] |
| 3608 | NM_000095.2(COMP): c.1358A > G (p.Asn453Ser) | 1311 | COMP | ['CGGGACAACTGTCCCACGGTGCCTARCAG TGCCCAGGAGGACTCAGACCAC] |
| 3609 | NM_000095.2(COMP): c.1418A > G (p.Asp473Gly) | 1311 | COMP | ['GGTGATGCCTGCGACGACGACGACGRCAA TGACGGAGTCCCTGACAGTCGG] |
| 3610 | NM_002047.2(GARS): c.374A > G (p.Glu125Gly) | 2617 | GARS | ['GATATTGTAGACCGAGCAAAAATGGRAGA TACCCTGAAGAGGAGGTTTTTC'] |
| 3611 | NM_001166107.1(HMGCS2): c.500A > G (p.Tyr167Cys) | 3158 | HMGCS2 | ['GGCATAGATACCACCAATGCCTGCTRCGG TGGTACTGCCTCCCTCTTCAAT'] |
| 3612 | NM_000161.2(GCH1): c.671A > G (p.Lys224Arg) | 2643 | GCH1 | ['CGAGGTGTACAGAAAATGAACAGCARAAC TGTGACCAGCACAATGTTGGGT'] |
| 3613 | NM_001024630.3(RUNX2): c.598A > G (p.Thr200Ala) | 860 | RUNX2 | ['ATCTGCAGGCAAGAGTTTCACCTTGRCCAT AACCGTCTTCACAAATCCTCC'] |
| 3614 | NM_000423.2(KRT2): c.556A > G (p.Asn186Asp) | 3849 | KRT2 | ['AGAGCGTGAGCAGATCAAAACTCTDACA ACAAATTTGCCTCCTTCATTGA'] |

TABLE 7-continued

Diseases/disorders containg A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3615 | NM_000215.3(JAK3): c.299A > G (p.Tyr100Cys) | 3718 | JAK3 | ['GATGCCAGCACCCAAGTCCTGCTGTRCAG GATTCGGTAGGAAGTGCCCCCC'] |
| 3616 | NM_000335.4(SCN5A): c.3971A > G (p.Asn1324Ser) | 6331 | SCN5A | ['CTCTGTCCACTTGAGGTGGTGGTCARTGCC CTGGTGGGCGCCATCCCGTCC'] |
| 3617 | NM_000335.4(SCN5A): c.5381A > G (p.Tyr1794Cys) | 6331 | SCN5A | ['AGTGAGGACGACTTCGATATGTTCTRTGAG ATCTGGGAGAAATTTGACCCA] |
| 3618 | NM_001014797.2(KCNMA1): c.1301A > G (p.Asp434Gly) | 3778 | KCNMA1 | ['AAGGACTTTCTGCACAAGGACCGGGRTGA CGTCAATGTGGAGATCGTTTTT'] |
| 3619 | NM_004380.2(CREBBP): c.3524A > G (p.Tyr1175Cys) | 1387 | CREBBP | ['TATAATCGCAAGACATCCCGAGTCTRTAA GTTTTGCAGTAAGCTTGCAGAG'] |
| 3620 | NM_000023.2(SGCA): c.410A > G (p.Glu137Gly) | 6442 | SGCA | ['GGCCCCCTGCTGCCATACCAAGCCGRGTTC CTGGTGCGCAGCCACGATGCG'] |
| 3621 | NM_002835.3(PTPN12): c.182A > G (p.Lys61Arg) | 5782 | PTPN12 | ['GGAGAAAAGAAGAAAATGTTAAAARGA ACAGATACAAGGACATACTGCCA'] |
| 3622 | NM_000211.4(ITGB2): c.1052A > G (p.Asn351Ser) | 3689 | ITGB2 | ['GGGGAGCTGTCTGAGGACTCCAGCARTGT GGTCCAACTCATTAAGAATGCT'] |
| 3623 | NM_005502.3(ABCA1): c.1790A > G (p.Gln597Arg) | 19 | ABCA1 | ['GTCTGGGGGGCTTCGCCTACTTGCRGGAT GTGGTGGAGCAGGCAATCATC'] |
| 3624 | NM_005502.3(ABCA1): c.2804A > G (p.Asn935Ser) | 19 | ABCA1 | ['CAGATCACCTCCTTCCTGGGCCACARTGGA GCGGGGAAGACGACCACCATG'] |
| 3625 | m.5843A > G | 4579 | MT-TY | ['CTCGGAGCTGGTAAAAAGAGGCCTARCCC CTGTCTTTAGATTTACAGTCCA'] |
| 3626 | m.7445A > G | -1 | — | ['AAGAACCCGTATACATAAAATCTAGVCAA AAAAGGAAGGAATCGAACCCCC'] |
| 3627 | m.8344A > G | 4566 | MT-TK | ['ACCTTTTAAGTTAAAGATTAAGAGARCCA ACACCTCTTTACAGTGAAATGC'] |
| 3628 | m.8296A > G | 4566 | MT-TK | ['ACCCCCTCTACCCCCTCTAGAGCCCRCTGT AAAGCTAACTTAGCATTAACC'] |
| 3629 | m.12320A > G | 4568 | MT-TL2 | ['TCTTAGGCCCCAAAAATTTTGGTGCRACTC CAAATAAAAGTAATAACCATG'] |
| 3630 | m.3243A > G | 4567 | MT-TL1 | ['AGAACAGGGTTTGTTAAGATGGCAGRGCC CGGTAATCGCATAAAACTTAAA'] |
| 3631 | m.3252A > G | 4567 | MT-TL1 | ['TTTGTTAAGATGGCAGAGCCCGGTARTCGC ATAAAACTTAAAACTTTACAG'] |
| 3632 | m.3251A > G | 4567 | MT-TL1 | ['GTTTGTTAAGATGGCAGAGCCCGGTRATC GCATAAAACTTAAAACTTTACA'] |
| 3633 | m.3260A > G | 4567 | MT-TL1 | ['GATGGCAGAGCCCGGTAATCGCATARAAC TTAAAACTTTACAGTCAGAGGT'] |
| 3634 | m.3274A > G | 4567 | MT-TL1 | ['GTAATCGCATAAAACTTAAAACTTTRCAGT CAGAGGTTCAATTCCTCTTCT'] |
| 3635 | m.4317A > G | 4565 | MT-TI | ['GATAGAGTAAATAATAGGAGCTTAARCCC CCTTATTTCTAGGACTATGAGA'] |
| 3636 | m.4269A > G | 4565 | MT-TI | ['GCATTCCCCCTCAAACCTAAGAAATRTGTC TGATAAAAGAGTTACTTTGAT'] |
| 3637 | m.4295A > G | 4565 | MT-TI | ['TGTCTGATAAAAGAGTTACTTTGATRGAGT AAATAATAGGAGCTTAAACCC'] |
| 3638 | m.4300A > G | 4565 | MT-TI | ['GATAAAAGAGTTACTTTGATAGAGTRAAT AATAGGAGCTTAAACCCCCTTA'] |

TABLE 7-continued

Diseases/disorders containging A to G Changes. The table includes human gene
mutations that may be corrected by changing a guanine (G) to adenine (A). The gene name,
gene symbol, and Gene ID are indicated.

| SEQ ID NO: | Name | Gene ID | Gene Symbol | Flanks |
|---|---|---|---|---|
| 3639 | m.10044A > G | 4563 | MT-TG | ['CTTCCAATTAACTAGTTTTGACAACRTTCA AAAAAGAGTAATAAACTTCGC'] |
| 3640 | m.7526A > G | 4555 | MT-TD | ['TCCATGACTTTTTCAAAAAGGTATTRGAAA AACCATTTCATAACTTTGTCA'] |
| 3641 | m.10438A > G | 4573 | MT-TR | ['AGTTTAAACAAAACGAATGATTTCGRCTC ATTAAATTATGATAATCATATT'] |
| 3642 | m.1555A > G | 4549 | MT-RNR1 | ['ACCCCTACGCATTTATATAGAGGAGRCAA GTCGTAACATGGTAAGTGTACT'] |
| 3643 | m.827A > G | 4549 | MT-RNR1 | ['CACCCCCACGGGAAACAGCAGTGATNARC CTTTAGCAATAAACGAAAGTTT'] |
| 3644 | m.15579A > G | 4519 | MT-CYB | ['CCCGAATGATATTTCCTATTCGCCTRCACA ATTCTCCGATCCGTCCCTAAC'] |
| 3645 | m.14495A > G | 4541 | MT-ND6 | ['TCCAAAGACAACCATCATTCCCCCTRAATA AATTAAAAAAACTATTAAACC'] |
| 3646 | m.12770A > G | 4540 | MT-ND5 | ['CTATTCCAACTGTTCATCGGCTGAGRGGGC GTAGGAATTATATCCTTCTTG'] |
| 3647 | m.11084A > G | 4538 | MT-ND4 | ['CTCCCTACAAATCTCCTTAATTATARCATT CACAGCCACAGAACTAATCAT'] |
| 3648 | m.3397A > G | 4535 | MT-ND1 | ['TACCGAACGAAAAATTCTAGGCTATRTAC AACTACGCAAAGGCCCCAACGT'] |
| 3649 | m.4136A > G | 4535 | MT-ND1 | ['CTGTTCTTATGAATTCGAACAGCATRCCCC CGATTCCGCTACGACCAACTC'] |
| 3650 - 3654 | m.3796A > G | 4535 | MT-ND1 | ['CCGTTTACTCAATCCTCTGATCAGGNTGAG CATCAAACTCAAACTACGCCC', 'AATAAGTGGCTCCTTTAACCTCTCCDCCCTT ATCACAACACAAGAACACCT', 'ACCCCCTTGACCTTGCCGAAGGGGANTCCG AACTAGTCTCAGGCTTCAACA', 'CGAATACGCCGCAGGCCCCTTCGCCNTATT CTTCATAGCCGAATACACAAA', 'ATTTTGTCACCAAGACCCTACTTCTNACCTC CCTGTTCTTATGAATTCGAA'] |
| 3655 | NM_003334.3(UBA1): c.1639A > G (p.Ser547Gly) | 7317 | UBA1 | ['AATGAATCCACATATCCGGGTGACARGCC ACCAGAACCGTGTGGGTCCTGA'] |
| 3656 | NM_000354.5(SERPINA7): c.623 - 2A > G | 6906 | SERPINA7 | ['GATCAAAAGGATTTGCCCACTGGGCYTAA AATACAAAGAAAAGAGAGGTGT'] |
| 3657 | NM_000044.3(AR): c.2291A > G (p.Tyr764Cys) | 367 | AR | ['ACCAATGTCAACTCCAGGATGCTRCTTC GCCCCTGATCTGGTTTTCAAT'] |
| 3658 | NM_000044.3(AR): c.2362A > G (p.Met788Val) | 367 | AR | ['CCGGATGTACAGCCAGTGTGTCCGARTGA GGCACCTCTCTCAAGAGTTTGG'] |
| 3659 | NM_000044.3(AR): c.2632A > G (p.Thr878Ala) | 367 | AR | ['GATTGCGAGAGAGCTGCATCAGTTCRCTTT TGACCTGCTAATCAAGTCACA'] |
| 3660 | NM_000044.3(AR): c.2708A > G (p.Gln903Arg) | 367 | AR | ['ATGATGCAGAGATCATCTCTGTGCRAGT GCCCAAGATCCTTTCTGGGAAA'] |
| 3661 | NM_002764.3(PRPS1): c.341A > G (p.Asn114Ser) | 5631 | PRPS1 | ['CCAATCTCAGCCAAGCTTGTTGCAARTATG CTATCTGTAGCAGGTGCAGAT'] |
| 3662 | NM_000194.2(HPRT1): c.602A > G (p.Asp201Gly) | 3251 | HPRT1 | ['CTTGACTATAATGAATACTTCAGGGRTTTG AATGTAAGTAATTGCTTCTTT'] |
| 3663 | NM_000194.2(HPRT1): c.155A > G (p.Asp52Gly) | 3251 | HPRT1 | ['TGTAGGACTGAACGTCTTGCTCGAGRTGTG ATGAAGGAGATGGGAGGCCAT'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3664 | NM_000132.3(F8): c.872A > G (p.Glu291Gly) | 2157 | F8 | ['CCTGAAGTGCACTCAATATTCCTCGRAGGT CACACATTTCTTGTGAGGAAC'] |
| 3665 | NM_000132.3(F8): c.5183A > G (p.Tyr1728Cys) | 2157 | F8 | ['GCTGCAGTGGAGAGGCTCTGGGATTRTGG GATGAGTAGCTCCCCACATGTT'] |
| 3666 | NM_000132.3(F8): c.5821A > G (p.Asn1941Asp) | 2157 | F8 | ['TTCTCTGTGTCCTTCTCCAGCAATCRATGG CTACATAATGGATACACTACC] |
| 3667 | NM_000132.3(F8): c.328A > G (p.Met110Val) | 2157 | F8 | ['TACAGTGGTCATTACACTTAAGAACRTGGC TTCCCATCCTGTCAGTCTTCA'] |
| 3668 | NM_000132.3(F8): c.398A > G (p.Tyr133Cys) | 2157 | F8 | ['TTTCTTCCTGCTATAGGAGCTGAATRTGAT GATCAGACCAGTCAAAGGGAG'] |
| 3669 | NM_000132.3(F8): c.404A > G (p.Asp135Gly) | 2157 | F8 | ['CCTGCTATAGGAGCTGAATATGATGRTCA GACCAGTCAAAGGGAGAAAGAA'] |
| 3670 | NM_000132.3(F8): c.940A > G (p.Thr314Ala) | 2157 | F8 | ['GGAAATCTCGCCAATAACTTTCCTTRCTGC TCAAACACTCTTGATGGACCT'] |
| 3671 | NM_000132.3(F8): c.1226A > G (p.Glu409Gly) | 2157 | F8 | ['TGGGTACATTACATTGCTGCTGAAGRGGA GGACTGGGACTATGCTCCCTTA'] |
| 3672 | NM_000132.3(F8): c.1331A > G (p.Lys444Arg) | 2157 | F8 | ['CAGCGGATTGGTAGGAAGTACAAAARAGT CCGATTTATGGCATACACAGAT'] |
| 3673 | NM_000132.3(F8): c.1418A > G (p.Tyr473Cys) | 2157 | F8 | ['TCAGGAATCTTGGGACCTTTACTTTRTGGG GAAGTTGGAGACACACTGTTG'] |
| 3674 | NM_000132.3(F8): c.1660A > G (p.Ser554Gly) | 2157 | F8 | ['TCGGTGCCTGACCCGCTATTACTCTRGTTT CGTTAATATGGAGAGAGATCT'] |
| 3675 | NM_000132.3(F8): c.1682A > G (p.Asp561Gly) | 2157 | F8 | ['TCTAGTTTCGTTAATATGGAGAGAGRTCTA GCTTCAGGACTCATTGGCCCT'] |
| 3676 | NM_000132.3(F8): c.1892A > G (p.Asn631Ser) | 2157 | F8 | ['GAGGATCCAGAGTTCCAAGCCTCCARCAT CATGCACAGTGAGTAAAGCAGC'] |
| 3677 | NM_000132.3(F8): c.5600A > G (p.His1867Arg) | 2157 | F8 | ['TTCCCTCCCTAGGAAAAAGATGTGCRCTCA GGCCTGATTGGACCCCTTCTG'] |
| 3678 | NM_000132.3(F8): c.5822A > G (p.Asn1941Ser) | 2157 | F8 | ['TCTCTGTGTCCTTCTCCAGCAATCARTGGC TACATAATGGATACACTACCT'] |
| 3679 | NM_000132.3(F8): c.6113A > G (p.Asn2038Ser) | 2157 | F8 | ['AGCACACTTTTTCTGGTGTACAGCARTAGT GAGTAGCAATGTGGGCAGAGG'] |
| 3680 | NM_000132.3(F8): c.6278A > G (p.Asp2093Gly) | 2157 | F8 | ['AAGTGTTATTTTAATTGGTAGGTGGRTCTG TTGGCACCAATGATTATTCAC'] |
| 3681 | NM_000132.3(F8): c.6371A > G | 2157 | F8 | ['TACATCTCTCAGTTATCATCATGTRTAGT CTTGATGGGAAGAAGTGGCAG'] |
| 3682 | NM_000132.3(F8): c.6794A > G (p.Gln2265Arg) | 2157 | F8 | ['ATGAAAGTCACAGGAGTAACTACTCRGGG AGTAAAATCTCTGCTTACCAGC'] |
| 3683 | NM_000132.3(F8): c.104A > G (p.Tyr35Cys) | 2157 | F8 | ['GGTGCAGTGGAACTGTCATGGGACTRTAT GCAAAGTGATCTCGGTGAGCTG'] |
| 3684 | NM_000402.4(G6PD): c.466A > G (p.Asn156Asp) | 2539 | G6PD | ['CAACTCCTATGTGGCTGGCCAGTACRTGA TGCAGCCTCCTACCAGCGCCT'] |
| 3685 | NM_000402.4(G6PD): c.583A > G (p.Asn195Asp) | 2539 | G6PD | ['GCTCCGGGCTCCCAGCAGAGGCTGGRACC GCATCATCGTGGAAGCCCTT'] |
| 3686 | NM_002049.3(GATA1): c.653A > G (p.Asp218Gly) | 2623 | GATA1 | ['ACAGCCACTCCACTGTGGCGGAGGGRCAG GACAGGCCACTACCTATGCAAC'] |
| 3687 | NM_001097642.2(GJB1): c.194A > G (p.Tyr65Cys) | 2705 | GJB1 | ['CAGCCTGGCTGCAACAGCGTTTGCTRTGAC CAATTCTTCCCCATCTCCCAT'] |

TABLE 7-continued

Diseases/disorders containging A to G Changes. The table includes human gene
mutations that may be corrected by changing a guanine (G) to adenine (A). The gene name,
gene symbol, and Gene ID are indicated.

| SEQ ID NO: | Name | Gene ID | Gene Symbol | Flanks |
|---|---|---|---|---|
| 3688 | NM_000166.5(GJB1): c.614A > G (p.Asn205Ser) | 2705 | GJB1 | ['GCCTCTGGCATCTGCATCATCCTCARTGTG GCCGAGGTGGTGTACCTCATC'] |
| 3689 | NM_000032.4(ALAS2): c.1702A > G (p.Ser568Gly) | 212 | ALAS2 | ['CCGTCCTGTACACTTTGAGCTCATGRGTGA GTGGGAACGTTCCTACTTCGG'] |
| 3690 | NM_000202.6(IDS): c.404A > G (p.Lys135Arg) | 3423 | IDS | ['GGCTATGTGACCATGTCGGTGGGAARAGT CTTTCACCCTGGTACTGCTCCA'] |
| 3691 | NM_000292.2(PHKA2): c.896A > G (p.Asp299Gly) | 5256 | PHKA2 | ['TATGGATGCTGTCGCTTCCTTCGAGRTGGT TATAAAACTCCAAGAGAGGTT'] |
| 3692 | NM_000292.2(PHKA2): c.565A > G (p.Lys189Glu) | 5256 | PHKA2 | ['TTATGGAATGTGGGAGCGTGGAGATRAGA CTAATCAGGGCATCCCGGAATT'] |
| 3693 | NM_000351.4(STS): c.1331A > G (p.His444Arg) | 412 | STS | ['CGCTCCGATCATGAGTTTCTCTTCCRTTAC TGCAACGCCTACTTAAATGCT'] |
| 3694 | NM_000133.3(F9): c.278A > G (p.Asp93Gly) | 2158 | F9 | ['TTCAATTTCTTAACCTATCTCAAAGRTGGA GATCAGTGTGAGTCCAATCCA'] |
| 3695 | NM_000133.3(F9): c.329A > G (p.Asp110Gly) | 2158 | F9 | ['TGTTTAAATGGCGGCAGTTGCAAGGRTGA CATTAATTCCTATGAATGTTGG'] |
| 3696 | NM_000133.3(F9): c.917A > G (p.Asn306Ser) | 2158 | F9 | ['CGAATTATTCCTCACCACAACTACARTGCA GCTATTAATAAGTACAACCAT'] |
| 3697 | NM_000133.3(F9): c.1180A > G (p.Met394Val) | 2158 | F9 | ['TACAAAGTTCACCATCTATAACAACRTGTT CTGTGCTGGCTTCCATGAAGG'] |
| 3698 | NM_000133.3(F9): c.1231A > G (p.Ser411Gly) | 2158 | F9 | ['AGGTAGAGATTCATGTCAAGGAGATRGTG GGGGACCCCATGTTACTGAAGT'] |
| 3699 | NM_000266.3(NDP): c.131A > G (p.Tyr44Cys) | 4693 | NDP | ['CCTCGACGCTGCATGAGGCACCACTRTGTG GATTCTATCAGTCACCCATTG'] |
| 3700 | NM_000266.3(NDP): c.1A > G (p.Met1Val) | 4693 | NDP | ['TCTAGAGAAGTTTTTCCTTACAACARTGAG AAAACATGTACTAGCTGCATC'] |
| 3701 | NM_000266.3(NDP): c.125A > G (p.His42Arg) | 4693 | NDP | ['TCGGACCCTCGACGCTGCATGAGGCRCCA CTATGTGGATTCTATCAGTCAC'] |
| 3702 | NM_000169.2(GLA): c.886A > G (p.Met296Val) | -1 | — | ['GGCTATCATGGCTGCTCCTTTATTCRTGTC TAATGACCTCCGACACATCAG'] |
| 3703 | NM_000169.2(GLA): c.101A > G (p.Asn34Ser) | -1 | — | ['ATCCCTGGGGCTAGAGCACTGGACARTGG ATTGGCAAGGACGCCTACCATG'] |
| 3704 | NM_000169.2(GLA): c.644A > G (p.Asn215Ser) | -1 | — | ['GAGTCATATCTGTTTTCACAGCCCARTTAT ACAGAAATCCGACAGTACTGC'] |
| 3705 | NM_000169.2(GLA): c.1228A > G (p.Thr410Ala) | -1 | — | ['AAGGTTAAGAAGTCACATAAATCCRCAG GCACTGTTTTGCTTCAGCTAGA'] |
| 3706 | NM_000169.2(GLA): c.815A > G (p.Asn272Ser) | -1 | — | ['TCTTTTTCTCAGTTAGTGATTGGCARCTTTG GCCTCAGCTGGAATCAGCAA'] |
| 3707 | NM_153252.4(BRWD3): c.4786A > G (p.Lys1596Glu) | 254065 | BRWD3 | ['AGAAGATAAAGAGAAAAAGAAACARAA GAGAAATCTCATTTATCCACCTC'] |
| 3708 | NM_004463.2(FGD1): c.1396A > G (p.Met466Val) | 2245 | FGD1 | ['GCAGAAACTGGCCCCCTTCCTCAAGRTGTA TGGTGAGTATGTGAAGAACTT'] |
| 3709 | NM_000054.4(AVPR2): c.614A > G (p.Tyr205Cys) | 554 | AVPR2 | ['GCGGAGCCCTGGGGCCGTCGCACCTRTGT CACCTGGATTGCCCTGATGGTG'] |
| 3710 | NM_000054.4(AVPR2): c.839A > G (p.Tyr280Cys) | 554 | AVPR2 | ['ATGACGCTAGTGATTGTGGTCGTCTRTGTG CTGTGCTGGGCACCCTTCTTC'] |
| 3711 | NM_000276.3(OCRL): c.1436A > G (p.Tyr479Cys) | 4952 | OCRL | ['ATCAAGTTCATCCCCACTTATAAGTRTGAC TCTAAAACAGACCGGTGGGAT] |

TABLE 7-continued

Diseases/disorders containging A to G Changes.The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
| --- | --- | --- | --- | --- |
| 3712 | NM_000397.3(CYBB): c.302A > G (p.His101Arg) | 1536 | CYBB | ['CAACTGGACAGGAATCTCACCTTTCRTAAA ATGGTGGCATGGATGATTGCA'] |
| 3713 | NM_000397.3(CYBB): c.1499A > G (p.Asp500Gly) | 1536 | CYBB | ['GCTGTGCACCATGATGAGGAGAAAGRTGT GATCACAGGCCTGAAACAAAAG'] |
| 3714 | NM_001205019.1(GK): c.880A > G (p.Asn294Asp) | 2710 | GK | ['TGGAACAGGATGTTTCTTACTATGTRATAC AGGCCATAAGGTTGGTTTTTT'] |
| 3715 | NM_005710.2(PQBP1): c.194A > G (p.Tyr65Cys) | 10084 | PQBP1 | ['CGGCCCCACAGCGGGCTCCCTTACTRCTGG AATGCAGACACAGACCTTGTA'] |
| 3716 | NM_198270.3(NHS): c.853 − 2A > G | 4810 | NHS | ['CTGAACCTGATTGTACTTTGTTTGCRGTCC CATCCCCCAGAGGATGAAGAT'] |
| 3717 | NM_000252.2(MTM1): c.566A > G (p.Asn189Ser) | 4534 | MTM1 | ['CACCATTGGAGAATAACTTTTATTARTAAG TGCTATGAGCTCTGTGACACT'] |
| 3718 | NM_000252.2(MTM1): c.1190A > G (p.Tyr397Cys) | 4534 | MTM1 | ['GCCATGCTGATGTTGGATAGCTTCTRTAGG AGCATTGAAGGGTTCGAAATA'] |
| 3719 | NM_000252.2(MTM1): c.1261 − 10A > G | 4534 | MTM1 | ['TAATTAAAACAAATTATCTTCATCARTTTA TTCAGCGAATAGGTCATGGTG'] |
| 3720 | NM_001015877.1(PHF6): c.700A > G (p.Lys234Glu) | 84295 | PHF6 | ['AGGAAAACTGCATATATTTAATGCCRAGA AGGCAGCTGCCCATTATAAAGTG'] |
| 3721 | NM_001015877.1(PHF6): c.686A > G (p.His229Arg) | 84295 | PHF6 | ['GAAAATGAAGCACGAGGAAAACTGCRTAT ATTTAATGCCAAGAAGGCAGCT'] |
| 3722 | NM_001015877.1(PHF6): c.769A > G (p.Arg257Gly) | 84295 | PHF6 | ['CACAGTCCAGCTCACAACAACATCARGAG CAGAATTTGGAGACTTTGATAT'] |
| 3723 | NM_000117.2(EMD): c.1A > G (p.Met1Val) | 2010 | EMD | ['GCCTCCGCCTGAGCCCGCACCCGCCRTGG ACAACTACGCAGATCTTTCGGA'] |
| 3724 | NM_004006.2(DMD): c.2317A > G (p.Lys773Glu) | 1756 | DMD | ['GGCCATAGAGCGAGAAAAAGCTGAGRAGT TCAGAAAACTGCAAGATGCCAG'] |
| 3725 | NM_004006.2(DMD): c.8734A > G (p.Asn2912Asp) | 1756 | DMD | ['TCTACGAAAGCAGGCTGAGGAGGTCRATA CTGAGTGGGAAAAATTGAACCT'] |
| 3726 | NM_004006.2(DMD): c.8762A > G (p.His2921Arg) | 1756 | DMD | ['ACTGAGTGGGAAAAATTGAACCTGCRCTC CGCTGACTGGCAGAGAAAAATA'] |
| 3727 | NM_004006.2(DMD): c.835A > G (p.Thr279Ala) | 1756 | DMD | ['TCCCCCAAACCCTTCTCTGCAGATCRCGGT CAGTCTAGCACAGGGATATGA'] |
| 3728 | NM_004006.2(DMD): c.9225 − 285A > G | 1756 | DMD | ['TCGATCGCACTTCAGTTATGATAAAYTGAC CTTGTTATGTGATCAATAATC'] |
| 3729 | NM_000033.3(ABCD1): c.443A > G (p.Asn148Ser) | 215 | ABCD1 | ['ATCGCCCTCCCTGCTACCTTCGTCARCAGT GCCATCCGTTACCTGGAGGGC'] |
| 3730 | NM_003588.3(CUL4B): c.901 − 2A > G | 8450 | CUL4B | ['TTTGATTTCTTTTTTTTTCATTGGCRGATCA TGATCAGGAGCATTTTTTTG'] |
| 3731 | NM_000061.2(BTK): c.1288A > G (p.Lys430Glu) | 695 | BTK | ['GAGAGGCCAGTACGACGTGGCCATCRAGA TGATCAAAGAAGGCTCCATGTC'] |
| 3732 | NM_000061.2(BTK): c.1082A > G (p.Tyr361Cys) | 695 | BTK | ['AGCACCATCCCTGAGCTCATTAACTRCCAT CAGCACAACTCTGCAGGTGAG'] |
| 3733 | NM_000061.2(BTK): c.919A > G (p.Arg307Gly) | 695 | BTK | ['GGGGAAAGAAGGAGGTTTCATTGTCRGAG ACTCCAGCAAAGCTGGCAAATA'] |
| 3734 | NM_000061.2(BTK): c.1766A > G (p.Glu589Gly) | 695 | BTK | ['CACCTTCTAGGGGTTTTGATGTGGGRAATT TACTCCCTGGGGAAGATGCCA'] |
| 3735 | NM_003413.3(ZIC3): c.1213A > G (p.Lys405Glu) | 7547 | ZIC3 | ['CTACACGCACCCGAGCTCCCTGCGCRAAC ACATGAAGGTAATTACCTCTTT'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3736 | NM_001037811.2(HSD17B10): c.713A > G (p.Asn238Ser) | 3028 | HSD17B10 | ['GCCATCATCGAGAACCCATTCCTCARTGGA GAGGTCATCCGGCTGGATGGG'] |
| 3737 | NM_003639.4(IKBKG): c.1219A > G (p.Met407Val) | 8517 | IKBKG | ['CAAGTGCCAGTATCAGGCCCCTGATRTGG ACACCCTGCAGATACATGTCAT'] |
| 3738 | NM_003639.4(IKBKG): c.1259A > G (p.Ter420Trp) | 8517 | IKBKG | ['ATACATGTCATGGAGTGCATTGAGTRGGG CCGGCCAGTGCAAGGCCACTGC'] |
| 3739 | NM_005448.2(BMP15): c.704A > G (p.Tyr235Cys) | 9210 | BMP15 | ['TTGGACATTGCCTTCTTGTTACTCTRTTTCA ATGATACTCATAAAAGCATT'] |
| 3740 | NM_005120.2(MED12): c.3020A > G (p.Asn1007Ser) | 9968 | MED12 | ['AAGGTGAAGAACACCATCTACTGCARCGT GGAGCCATCGGAATCAAATATG'] |
| 3741 | NM_003688.3(CASK): c.2129A > G (p.Asp710Gly) | 8573 | CASK | ['GGCAAGAAAAAGAAGCAGTACAAAGRTA AATATTTGGCAAAGCACAATGCA'] |
| 3742 | NM_001363.4(DKC1): c.361A > G (p.Ser121Gly) | 1736 | DKC1 | ['ACTTCGGGTGGAGAAGACAGGGCACRGTG GTACTCTGGATCCCAAGGTGAC'] |
| 3743 | NM_001363.4(DKC1): c.1069A > G (p.Thr357Ala) | 1736 | DKC1 | ['ATTAATGACCACAGCGGTCATCTCTRCCTG CGACCATGGTATAGTAGCCAA'] |
| 3744 | NM_000307.4(POU3F4): c.1000A > G (p.Lys334Glu) | 5456 | POU3F4 | ['GTTCTGTAATCGAAGACAAAAAGAGRAAA GAATGACTCCGCCAGGGGATCA'] |
| 3745 | NM_004429.4(EFNB1): c.472A > G (p.Met158Val) | 1947 | EFNB1 | ['GGGCGGTGTGTGCCGCACACGCACCRTGA AGATCATCATGAAGGTTGGGCA'] |
| 3746 | NM_000489.4(ATRX): c.4826A > G (p.His1609Arg) | 546 | ATRX | ['TTCTTATAGGTGGTAAGTTTTCTTCRTACA GTTCTTTTGTGTGACAAACTG'] |
| 3747 | NM_000489.4(ATRX): c.5579A > G (p.Asn1860Ser) | 546 | ATRX | ['TTCTTTTGATCAGGTGTGGGCAATAVTAGT GAAGGTGGAAGAGGAAAGGCA'] |
| 3748 | NM_000489.4(ATRX): c.6488A > G (p.Tyr2163Cys) | 546 | ATRX | ['GGACAAACTAAGCCTGTTTATGTATRTAGG TTCTTAGCTCAGGTAGGTTTA] |
| 3749 | NM_000489.4(ATRX): c.6811A > G (p.Arg2271Gly) | 546 | ATRX | ['AGAAGAAGAGTTGACTGAAGAAGAAGA AAAGCAGCTTGGGCTGAGTATGA'] |
| 3750 | NM_000052.6(ATP7A): c.3911A > G (p.Asn1304Ser) | 538 | ATP7A | ['GTAGCAATGGTGGGAGATGGAATCARTGA CTCCCCAGCTCTGGCAATGGCT'] |
| 3751 | NM_004992.3(MECP2): c.410A > G (p.Glu137Gly) | 4204 | MECP2 | ['GGAAAAGCCTTTCGCTCTAAAGTGGRGTT GATTGCGTACTTCGAAAAGGTA'] |
| 3752 | NM_000137.2(FAH): c.1141A > G (p.Arg381Gly) | 2184 | FAH | ['CATAGACCTGGGGAATGGTCAGACCRGGA AGTTTCTGCTGGACGGGGATGA'] |
| 3753 | NM_000137.2(FAH): c.836A > G (p.Gln279Arg) | 2184 | FAH | ['CCCTTTGCTGTGCCCAACCCGAAGCRGGTA AGCACATTCTCTGCAGGAAGC'] |
| 3754 | NM_002769.4(PRSS1): c.68A > G (p.Lys23Arg) | -1 | — | ['GCTGCCCCCTTTGATGATGATGACARGATC GTTGGGGGCTACAACTGTGAG'] |
| 3755 | NM_002769.4(PRSS1): c.161A > G (p.Asn54Ser) | -1 | — | ['CACTTCTGTGGTGGCTCCCTCATCARCGAA CAGTGGGTGGTATCAGCAGGC'] |
| 3756 | NM_000373.3(UMPS): c.286A > G (p.Arg96Gly) | 7372 | UMPS | ['AACCAATCAAATTCCAATGCTTATTRGAAG GAAAGAAACAAAGGATTATGG'] |
| 3757 | NM_001918.3(DBT): c.1355A > G (p.His452Arg) | 1629 | DBT | ['ATGAATGTGAGCTGGTCAGCTGATCRCAG AGTTATTGATGGTGCTACAATG'] |
| 3758 | NM_000108.4(DLD): c.214A > G (p.Lys72Glu) | 1738 | DLD | ['TTGGTTGTAGACAGTCTGCATTGAGRAAA ATGAAACACTTGGTGGAACATG'] |
| 3759 | NM_000108.4(DLD): c.1483A > G (p.Arg495Gly) | 1738 | DLD | ['CTTGCAGACCTTATCAGAAGCTTTTRGAGA AGCAAATCTTGCTGCGTCATT'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3760 | NM_000108.4(DLD): c.1081A > G (p.Met361Val) | 1738 | DLD | ['CATTGGTGATGTAGTTGCTGGTCCARTGCT GGCTCACAAAGCAGAGGATGA'] |
| 3761 | NM_000481.3(AMT): c.125A > G (p.His42Arg) | 275 | AMT | ['CGCAGGACACCGCTCTATGACTTCCRCCTG GCCCACGGCGGGAAAATGGTG'] |
| 3762 | NM_000151.3(G6PC): c.230 + 4A > G | 2538 | G6PC | ['GGCTCAACCTCGTCTTTAAGTGGTARGAAC CATATAGAGAGGAGATCAGCA'] |
| 3763 | NM_000532.4(PCCB): c.1304A > G (p.Tyr435Cys) | 5096 | PCCB | ['CAGCATTTGGATCTGTTTTAGGCCRTGGA GGTGCCTATGATGTCATGAGC'] |
| 3764 | NM_000387.5(SLC25A20): c.713A > G (p.Gln238Arg) | 788 | SLC25A20 | ['CCAGATGTGCTCAAGTCTCGATTCCRGACT GGTGAGTGGAAGGTAGTGGGG'] |
| 3765 | NM_004360.3(CDH1): c.2512A > G (p.Ser838Gly) | 999 | CDH1 | ['TCTGCTCGTGTTTGACTATGAAGGARGCGG TTCCGAAGCTGCTAGTCTGAG'] |
| 3766 | NM_004360.3(CDH1): c.1018A > G (p.Thr340Ala) | 999 | CDH1 | ['GTCGATCTCTCTGCAGAGTTTCCCTDCGTA TACCCTGGTGGTTCAAGCTGC'] |
| 3767 | NM_003361.3(UMOD): c.383A > G (p.Asn128Ser) | 7369 | UMOD | ['TGCCACGCCCTGGCCACATGTGTCARTGTG GTGGGCAGCTACTTGTGCGTA'] |
| 3768 | NM_000463.2(UGT1A1): c.992A > G (p.Gln331Arg) | -1 | — | ['GCTGATGCTTTGGGCAAAATCCCTCRGACA GTAAGAAGATTCTATACCATG'] |
| 3769 | NM_000463.2(UGT1A1): c.1085 - 2A > G | -1 | — | ['TGACATCCTCCCTATTTTGCATCTCRGGTC ACCCGATGACCCGTGCCTTTA'] |
| 3770 | NM_000463.2(UGT1A1): c.1070A > G (p.Gln357Arg) | -1 | — | ['ACGATACTTGTTAAGTGGCTACCCCRAAAC GATCTGCTTGGTATGTTGGGC'] |
| 3771 | NM_000463.2(UGT1A1): c.1198A > G (p.Asn400Asp) | -1 | — | ['GCCCTTGTTTGGTGATCAGATGGACVATGC AAAGCGCATGGAGACTAAGGG'] |
| 3772 | NM_001382.3(DPAGT1): c.509A > G (p.Tyr170Cys) | 1798 | DPAGT1 | ['TCTCTCCCCGCAGGAATCCTGTACTRTGTC TACATGGGCTGCTGGCAGTG'] |
| 3773 | NM_001007792.1(NTRK1): c.986A > G (p.Tyr329Cys) | 4914 | NTRK1 | ['CCCACCCACGTCAACAACGGCAACTRCAC GCTGCTGGCTGCCAACCCCTTC'] |
| 3774 | NM_001007792.1(NTRK1): c.1651A > G (p.Met551Val) | 4914 | NTRK1 | ['CTGCACCGAGGGCCGCCCCCTGCTCRTGGT CTTTGAGTATATGCGGCACGG'] |
| 3775 | NM_000363.4(TNNI3): c.569A > G (p.Asp190Gly) | 7137 | TNNI3 | ['CTCCAGGAAAACCGGGAGGTGGGAGRCTG GCGCAAGAACATCGATGCACTG'] |
| 3776 | NM_000363.4(TNNI3): c.532A > G (p.Lys178Glu) | 7137 | TNNI3 | ['GCGGGCCCACCTCAAGCAGGTGAAGRAGG AGGACACCGAGAAGGTGAGTGT'] |
| 3777 | NM_001018005.1(TPM1): c.539A > G (p.Glu180Gly) | 7168 | TPM1 | ['ATTGAGAGCGACCTGGAACGTGCAGDGGA GCGGGCTGAGCTCTCAGAAGGG'] |
| 3778 | NM_001159287.1(TPI1): c.622A > G (p.Ile208Val) | 7167 | TPI1 | ['CCTGGCCTATGAGCCTGTGTGGGCCRTTGG TACTGGCAAGACTGCAACACC'] |
| 3779 | NM_000359.2(TGM1): c.1469A > G (p.Asp490Gly) | 7051 | TGM1 | ['AATGGCCTGGTCTACATGAAGTACGRCAC GCCTTTCATTTTTGCTGAGGTG'] |
| 3780 | NM_001024847.2(TGFBR2): c.1472 - 2A > G | 7048 | TGFBR2 | ['CCCTGTGTTTGCTGGCTTTCTTCACRGAAG TAAAAGATTATGAGCCTCCAT'] |
| 3781 | NM_003242.5(TGFBR2): c.1273A > G (p.Met425Val) | 7048 | TGFBR2 | ['GCTATAGGTGGGAACTGCAAGATACRTGG CTCCAGAAGTCCTAGAATCCAG'] |
| 3782 | NM_004612.3(TGFBR1): c.1199A > G (p.Asp400Gly) | 7046 | TGFBR1 | ['CATTTTGAATCCTTCAAACGTGCTGRCATC TATGCAATGGGCTTAGTATTC'] |
| 3783 | NM_001128177.1(THRB): c.1324A > G (p.Met442Val) | 7068 | THRB | ['CTGCCATGCCAGCCGCTTCCTGCACRTGAA GGTGGAATGCCCCACAGAACT'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3784 | NM_001128177.1(THRB): c.1327A > G (p.Lys443Glu) | 7068 | THRB | ['CCATGCCAGCCGCTTCCTGCACATGRAGGT GGAATGCCCCACAGAACTCTT'] |
| 3785 | NM_001128177.1(THRB): c.1009A > G (p.Thr337Ala) | 7068 | THRB | ['AACCTTGAATGGGGAAATGGCAGTGRCAC GGGGCCAGCTGAAAAATGGGGG'] |
| 3786 | NM_033360.3(KRAS): c.13A > G (p.Lys5Glu) | 3845 | KRAS | ['AGGCCTGCTGAAAATGACTGAATATRAAC TTGTGGTAGTTGGAGCTGGTGG'] |
| 3787 | NM_005343.2(HRAS): c.350A > G (p.Lys117Arg) | -1 | — | ['GTGCCCATGGTGCTGGTGGGGAACARGTG TGACCTGGCTGCACGCACTGTG'] |
| 3788 | NM_001063.3(TF): c.956A > G (p.His319Arg) | 7018 | TF | ['GACCTGCTGTTTAAGGACTCTGCCCRCGGG TTTTTAAAAGTCCCCCCCAGG'] |
| 3789 | NM_001063.3(TF): c.1936A > G (p.Lys646Glu) | 7018 | TF | ['CTTTTGTTTGTTCCGGTCGGAAACCRAGGA CCTTCTGTTCAGAGATGACAC'] |
| 3790 | NM_212472.2(PRKAR1A): c.891 + 3A > G | 5573 | PRKAR1A | ['ATGAGTTCTTCATTATTTTAGAGGTRAAGA ACTCAGAATTTAATACTTGAA'] |
| 3791 | NM_212472.2(PRKAR1A): c.1 A > G (p.Met1Val) | 5573 | PRKAR1A | ['GTGTGTTTTTTTCTCGCAGAGAACCRTGGA GTCTGGCAGTACCGCCGCCAG'] |
| 3792 | NM_000362.4(TIMP3): c.572A > G (p.Tyr191Cys) | -1 | — | ['GCCTGCATCCGGCAGAAGGGCGGCTRCTG CAGCTGGTACCGAGGATGGGCC'] |
| 3793 - 3795 | NM_000367.3(TPMT): c.719A > G (p.Tyr240Cys) | 7172 | TPMT | ['GATTACAGGTGTGAGCCACCGCACCNAGC CAATTTTGAGTATTTTTAAAAG', 'TAACATGTTACTCTTTCTTGTTTCARGTAAA ATATGCAATATACRTYGTCT', 'AGGTTGATGCTTTTGAAGAACGACAKAAAA GTTGGGGAATTGACTGTCTTT'] |
| 3796 | NM_198253.2(TERT): c.2315A > G (p.Tyr772Cys) | 7015 | TERT | ['TCTTACCTTGACAGACCTCCAGCCGTRCATG CGACAGTTCGTGGCTCACCTG'] |
| 3797 | NM_000073.2(CD3G): c.1A > G (p.Met1Val) | 917 | CD3G | ['CTTTTGCCGGAGGACAGAGACTGACRTGG AACAGGGGAAGGGCCTGGCTGT'] |
| 3798 | NM_000899.4(KITLG): c.107A > G (p.Asn36Ser) | 4254 | KITLG | ['ATCTGCAGGAATCGTGTGACTAATARTGTA AAAGACGTCACTAAATTGGTA'] |
| 3799 | NM_001024858.2(SPTB): c.1A > G (p.Met1Val) | 6710 | SPTB | ['GCGGAGCTGCTAAGAGCCTGCTGACRTGA CATCGGCCACAGAGTTTGAAAA'] |
| 3800 | NM_003126.2(SPTA1): c.143A > G (p.Lys48Arg) | 6708 | SPTA1 | ['GAGCGGGTCGCTGAGAGGGGTCAGARGCT TGAGGATTCCTATCACTTACAA'] |
| 3801 | NM_005633.3(SOS1): c.1654A > G (p.Arg552Gly) | 6654 | SOS1 | ['TTTACAGTACCGGAGTACACTGGAARGGA TGCTTGATGTAACAATGCTACA'] |
| 3802 | NM_003041.3(SLC5A2): c.1961A > G (p.Asn654Ser) | -1 | — | ['GACCCGAGCTGGGCCCGTGTGGTCARCCT CAATGCCCTGCTCATGATGGCA'] |
| 3803 | NM_000343.3(SLC5A1): c.83A > G (p.Asp28Gly) | 6523 | SLC5A1 | ['CACGAGCTCATTCGCAATGCAGCCGRTATC TCCATCATCGTTATCTACTTC'] |
| 3804 | NM_000702.3(ATP1A2): c.1033A > G (p.Thr345Ala) | 477 | ATP1A2 | ['TCTCTACCAGGTGTGCCTGACCCTGRCAGC CAAGCGCATGGCACGGAAGAA'] |
| 3805 | NM_003124.4(SPR): c.448A > G (p.Arg150Gly) | 6697 | SPR | ['CTTCCCGGACAGTCCTGGCCTCAACRGAAC CGTGGTTAACATCTCGTCCCT'] |
| 3806 | NM_001161766.1(AHCY): c.344A > G (p.Tyr115Cys) | 191 | AHCY | ['CTCACCAACCTCATCCACACCAAGTRCCCG CAGCTTCTGCCAGGTGAGCAG'] |
| 3807 | NM_001035.2(RYR2): c.12602A > G (p.Gln4201Arg) | 6262 | RYR2 | ['TGCGAGGACACCATCTTTGAAATGCRGCCT GGCGGCTCAGATCTCGGAGTCG'] |
| 3808 | NM_000540.2(RYR1): c.14387A > G (p.Tyr4796Cys) | 6261 | RYR1 | ['CAGTCCTTCCTGTACCTGGGCTGGTRTATG GTGATGTCCCTCTTGGGACAC'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3809 | NM_000540.2(RYR1): c.14647 - 1449A > G | 6261 | RYR1 | ['CTCTGTCTCAAAAAAAAAAAAAAACRTAT GTAAAGTTGTTCCCAAATGCCA'] |
| 3810 | NM_000540.2(RYR1): c.13909A > G (p.Thr4637Ala) | 6261 | RYR1 | ['GGTGTACTACTTCCTGGAGGAAAGCRCAG GCTACATGGAACCCGCCCTGCG'] |
| 3811 | NM_000539.3(RHO): c.533A > G (p.Tyr178Cys) | 6010 | RHO | ['TCTCCCTACCTGCCTGTCCTCAGGTRCATC CCCGAGGGCCTGCAGTGCTCG'] |
| 3812 | NM_000539.3(RHO): c.569A > G (p.Asp190Gly) | 6010 | RHO | ['GGCCTGCAGTGCTCGTGTGGAATCGRCTAC TACACGCTCAAGCCGGAGGTC'] |
| 3813 | NM_000539.3(RHO): c.886A > G (p.Lys296Glu) | 6010 | RHO | ['CATGACCATCCCAGCGTTCTTTGCCRAGAG CGCCGCCATCTACAACCCTGT'] |
| 3814 | NM_000539.3(RHO): c.44A > G (p.Asn15Ser) | 6010 | RHO | ['CCTAACTTCTACGTGCCCTTCTCCARTGCG ACGGGTGTGGTACGCAGCCCC'] |
| 3815 | NM_000321.2(RB1): c.2490 - 1398A > G | 5925 | RB1 | ['AAGGGTGCTGTGGATCAGGGAAATGRTGA GTATGAAGCTGTTTTAAATTCT'] |
| 3816 | NM_000536.3(RAG2): c.115A > G (p.Arg39Gly) | 5897 | RAG2 | ['CTTTGGACAAAAAGGCTGGCCCAAARGAT CCTGCCCCACTGGAGTTTTCCA'] |
| 3817 | NM_000448.2(RAG1): c.2735A > G (p.Tyr912Cys) | 5896 | RAG1 | ['GAGTGCCCAGAATCCCTCTGCCAGTRCAGT TTCAATTCACAGCGTTTTGCT] |
| 3818 | NM_000448.2(RAG1): c.1286A > G (p.Asp429Gly) | 5896 | RAG1 | ['TTTGCTGACAAAGAAGAAGGTGGAGRTGT GAAGTCCGTGTGCATGACCTTG'] |
| 3819 | NM_000925.3(PDHB): c.395A > G (p.Tyr132Cys) | 5162 | PDHB | ['ATAAACTCAGCTGCCAAGACCTACTRCAT GTCTGGTGGCCTTCAGCCTGTG'] |
| 3820 | NM_000055.2(BCHE): c.293A > G (p.Asp98Gly) | 590 | BCHE | ['GCAAATTCTTGCTGTCAGAACATAGRTCAA AGTTTTCCAGGCTTCCATGGA'] |
| 3821 | NM_000055.2(BCHE): c.467A > G (p.Tyr156Cys) | 590 | BCHE | ['ACTGGAACATCATCTTTACATGTTTDTGAT GGCAAGTTTCTGGCTCGGGTT'] |
| 3822 | NM_005360.4(MAF): c.890A > G (p.Lys297Arg) | 4094 | MAF | ['CTGAAGCAGAAGAGGCGGACCCTGARAAA CCGCGGCTATGCCCAGTCCTGC'] |
| 3823 | NM_002739.3(PRKCG): c.380A > G (p.Gln127Arg) | 5582 | PRKCG | ['TCCCTCCTCTACGGGCTTGTGCACCRGGGC ATGAAATGCTCCTGTGAGTGA'] |
| 3824 | NM_002739.3(PRKCG): c.1081A > G (p.Ser361Gly) | 5582 | PRKCG | ['CTTCCTCATGGTTCTAGGAAAAGGCRGTTT TGGGAAGGTTGGATTCCTGGG'] |
| 3825 | NM_000141.4(FGFR2): c.983A > G (p.Tyr328Cys) | 2263 | FGFR2 | ['ACGGACAAAGAGATTGAGGTTCTCTRTATT CGGAATGTAACTTTTGAGGAC'] |
| 3826 | NM_000141.4(FGFR2): c.1124A > G (p.Tyr375Cys) | 2263 | FGFR2 | ['AAGGAGATTACAGCTTCCCAGACTRCCT GGAGATAGCCATTTACTGCATA'] |
| 3827 | NM_000141.4(FGFR2): c.874A > G (p.Lys292Glu) | 2263 | FGFR2 | ['TGCCCAGCCCCACATCCAGTGGATCRAGC ACGTGGAAAAGAACGGCAGTAA'] |
| 3828 | NM_000141.4(FGFR2): c.1576A > G (p.Lys526Glu) | 2263 | FGFR2 | ['ACTGTTCATAGATGATGCCACAGAGRAAG ACCTTTCTGATCTGGTGTCAGA'] |
| 3829 | NM_000313.3(PROS1): c.773A > G (p.Asn258Ser) | 5627 | PROS1 | ['AACATGTGTGCTCAGCTTTGTGTCARTTAC CCTGGAGGTTACACTTGCTAT'] |
| 3830 | NM_000313.3(PROS1): c.586A > G (p.Lys196Glu) | 5627 | PROS1 | ['AAATGGTTTTGTTATGCTTTCAAATRAGAA AGATTGTAAAGGTAAGAGCAG'] |
| 3831 | NM_002834.3(PTPN11): c.922A > G (p.Asn308Asp) | 5781 | PTPN11 | ['GCCTGTTTCAGATTACATCAATGCARATAT CATCATGGTAAGCTTTGCTTTT'] |
| 3832 | NM_002834.3(PTPN11): c.923A > G (p.Asn308Ser) | 5781 | PTPN11 | ['CCTGTTTCAGATTACATCAATGCAAVTATC ATCATGGTAAGCTTTGCTTTT'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3833 | NM_002834.3(PTPN11): c.836A > G (p.Tyr279Cys) | 5781 | PTPN11 | ['CAAGAAAACAAAAACAAAAATAGATVTA AAAACATCCTGCCCTGTAAGTAT'] |
| 3834 | NM_002834.3(PTPN11): c.182A > G (p.Asp61Gly) | 5781 | PTPN11 | ['CACATCAAGATTCAGAACACTGGTGNTTA CTATGACCTGTATGGAGGGGAG'] |
| 3835 | NM_002834.3(PTPN11): c.188A > G (p.Tyr63Cys) | 5781 | PTPN11 | ['AAGATTCAGAACACTGGTGATTACTRTGA CCTGTATGGAGGGGAGAAATTT'] |
| 3836 | NM_002834.3(PTPN11): c.227A > G (p.Glu76Gly) | 5781 | PTPN11 | ['GGGGAGAAATTTGCCACTTTGGCTGNGTT GGTCCAGTATTACATGGAACAT'] |
| 3837 | NM_002834.3(PTPN11): c.236A > G (p.Gln79Arg) | 5781 | PTPN11 | ['TTTGCCACTTTGGCTGAGTTGGTCCRGTAT TACATGGAACATCACGGGCAA'] |
| 3838 | NM_002834.3(PTPN11): c.1529A > G (p.Gln510Arg) | 5781 | PTPN11 | ['TCAGGGATGGTCCAGACAGAAGCACVGTA CCGATTTATCTATATGGCGGTC'] |
| 3839 | NM_002755.3(MAP2K1): c.389A > G (p.Tyr130Cys) | 5604 | MAP2K1 | ['AACTCTCCGTACATCGTGGGCTTCTRTGGT GCGTTCTACAGCGATGGCGAG'] |
| 3840 | NM_006006.4(ZBTB16): c.1849A > G (p.Met617Val) | 7704 | ZBTB16 | ['CCAGCGCTCCCGGGACTACTCGGCCRTGAT CAAGCACCTGAGAACGCACAA'] |
| 3841 | NM_000311.3(PRNP): c.385A > G (p.Met129Val) | 5621 | PRNP | ['AGTGGTGGGGGCCTTGGCGGCTACRTGC TGGGAAGTGCCATGAGCAGGCC'] |
| 3842 | NM_000311.3(PRNP): c.650A > G (p.Gln217Arg) | 5621 | PRNP | ['GTGGTTGAGCAGATGTGTATCACCCRGTAC GAGAGGGAATCTCAGGCCTAT'] |
| 3843 | NM_000311.3(PRNP): c.547A > G (p.Thr183Ala) | 5621 | PRNP | ['CTTTGTGCACGACTGCGTCAATATCRCAAT CAAGCAGCACACGGTCACCAC'] |
| 3844 | NM_000311.3(PRNP): c.560A > G (p.His187Arg) | 5621 | PRNP | ['TGCGTCAATATCACAATCAAGCAGCRCAC GGTCACCACAACCACCAAGGGG'] |
| 3845 | NM_000371.3(TTR): c.401A > G (p.Tyr134Cys) | 7276 | TTR | ['ACCATTGCCGCCCTGCTGAGCCCCRCTCC TATTCCACCACGGCTGTCGTC'] |
| 3846 | NM_000371.3(TTR): c.238A > G (p.Thr80Ala) | 7276 | TTR | ['GTCTGGAGAGCTGCATGGGCTCACARCTG AGGAGGAATTTGTAGAAGGGAT'] |
| 3847 | NM_000371.3(TTR): c.185A > G (p.Glu62Gly) | 7276 | TTR | ['AGAAAGGCTGCTGATGACACCTGGGRGCC ATTTGCCTCTGGGTAAGTTGCC'] |
| 3848 | NM_000371.3(TTR): c.205A > G (p.Thr69Ala) | 7276 | TTR | ['CCAGACTTTCACACCTTATAGGAAARCCA GTGAGTCTGGAGAGCTGCATGG'] |
| 3849 | NM_000371.3(TTR): c.379A > G (p.Ile127Val) | 7276 | TTR | ['CGACTCCGGCCCCCGCCGCTACACCRTTGC CGCCCTGCTGAGCCCCTACTC'] |
| 3850 | NM_000371.3(TTR): c.113A > G (p.Asp38Gly) | 7276 | TTR | ['TGTCCTCTGATGGTCAAAGTTCTAGRTGCT GTCGAGGCAGTCCTGCCATC'] |
| 3851 | NM_000217.2(KCNA1): c.676A > G (p.Thr226Ala) | 3736 | KCNA1 | ['CACAGACCCCTTCTTCATCGTGGAARCGCT GTGTATCATCTGGTTCTCCTT'] |
| 3852 | NM_000217.2(KCNA1): c.763A > G (p.Asn255Asp) | 3736 | KCNA1 | ['GACGGACTTCTTCAAAAACATCATGRACTT CATAGACATTGTGGCCATCAT'] |
| 3853 | NM_002693.2(POLG): c.2864A > G (p.Tyr955Cys) | 5428 | POLG | ['AAAATCTTCAACTACGCCGCATCTRTGGT GCTGGGCAGCCCTTTGCTGAG'] |
| 3854 | NM_002693.2(POLG): c.2591A > G (p.Asn864Ser) | 5428 | POLG | ['GAGCCCACATGGCTCACCGCCAGCARTGC CCGGGTATGTGACCTCTGTACC'] |
| 3855 | NM_000174.4(GP9): c.182A > G (p.Asn61Ser) | 2815 | GP9 | ['ACCCGCCACCTTCTGCTGGCCAACARCAGC CTTCAGTCCGTGCCCCCGGGA'] |
| 3856 | NM_000174.4(GP9): c.110A > G (p.Asp37Gly) | 2815 | GP9 | ['CTGGAAACCATGGGGCTGTGGGTGGRCTG CAGGGGCCACGGACTCACGGCC'] |

TABLE 7-continued

Diseases/disorders containging A to G Changes.The table includes human gene mutations that may be corrected by changing a guanine (G) to adenine (A).The gene name, gene symbol, and Gene ID are indicated.

| SEQ ID NO: | Name | Gene ID | Gene Symbol | Flanks |
| --- | --- | --- | --- | --- |
| 3857 | NM_006206.4(PDGFRA): c.1664A > G (p.Tyr555Cys) | 5156 | PDGFRA | ['CCTGGTCATTTATAGAAACCGAGGTRTGA AATTCGCTGGAGGGTCATTGAA'] |
| 3858 | NM_000301.3(PLG): c.112A > G (p.Lys38Glu) | 5340 | PLG | ['GGGGGCTTCACTGTTCAGTGTCACTRAGAA GCAGCTGGGAGCAGGAAGTAT'] |
| 3859 | NM_000293.2(PHKB): c.306 − 2A > G | 5257 | PHKB | ['GTTTCATGAGTTATCTCTCTCACCCRGGCG AATTGATGATGACAAGGGAAG'] |
| 3860 | NM_000175.3(GPI): c.1028A > G (p.Gln343Arg) | 2821 | GPI | ['ACACACGCCATGCTGCCCTATGACCRGTAC CTGCACCGCTTTGCTGCGTAC'] |
| 3861 | NM_002633.2(PGM1): c.343A > G (p.Thr115Ala) | 5236 | PGM1 | ['CAAAGCCATTGGTGGGATCATTCTGRCAG CCAGTCACAACCCAGGGGCCC'] |
| 3862 | NM_006218.2(PIK3CA): c.3140A > G (p.His1047Arg) | 5290 | PIK3CA | ['TTCATGAAACAAATGAATGATGCACDTCA TGGTGGCTGGACAACAAAAATG'] |
| 3863 | NM_006218.2(PIK3CA): c.1634A > G (p.Glu545Gly) | 5290 | PIK3CA | ['CGAGATCCTCTCTCTGAAATCACTGVGCAG GAGAAAGATTTTCTATGGAGT'] |
| 3864 | NM_000478.4(ALPL): c.1250A > G (p.Asn417Ser) | 249 | ALPL | ['CCCTTCACTGCCATCCTGTATGGCARTGGG CCTGGCTACAAGGTGGTGGGC'] |
| 3865 - 3867 | NM_018849.2(ABCB4): c.523A > G (p.Thr175Ala) | 5244 | ABCB4 | ['AGAAATAAACAGGTATAAGATGTGARTTC AGTCCTCAAATAAACCTACTAT', 'TTCTATATGAAAGTGTGACATTAACRATGT ACCTACTCTGTTAGCCGCGYA', 'TTTCCTGTCGTAGAATAGCATGAAARAACT TCTGCCTAATTTTCCTGATCT'] |
| 3868 | NM_001083116.1(PRF1): c.755A > G (p.Asn252Ser) | 5551 | PRF1 | ['CTGGCCCTGGAAGGGCTCACGGACARCGA GGTGGAGGACTGCCTGACTGTC'] |
| 3869 | NM_198965.1(PTHLH): c.534A > G (p.Ter178Trp) | 5744 | PTHLH | ['TTCCTTCTTTTTGCAGGAGCATTGRAATT TTCAGCAGAGACCTTCCAAGG'] |
| 3870 | NM_000316.2(PTH1R): c.668A > G (p.His223Arg) | 5745 | PTH1R | ['CTGCACTGCACGCGCAACTACATCCRCATG CACCTGTTCCTGTCCTTCATG'] |
| 3871 | NM_003122.4(SPINK1): c.101A > G (p.Asn34Ser) | 6690 | SPINK1 | ['TTCCATTTTTAGGCCAAATGTTACARTGAA CTTAATGGATGCACCAAGATA'] |
| 3872 | NM_006194.3(PAX9): c.271A > G (p.Lys91Glu) | 5083 | PAX9 | ['CGTGGTGAAACACATCCGGACCTACRGCAGC AGAGAGACCCCGGCATCTTCGC'] |
| 3873 | NM_013953.3(PAX8): c.160A > G (p.Ser54Gly) | −1 | — | ['CGACATCTCTCGCCAGCTCCGCGTCRGCCA TGGCTGCGTCAGCAAGATCCT'] |
| 3874 | NM_005188.3(CBL): c.1144A > G (p.Lys382Glu) | 867 | CBL | ['GATGGGCTCCACATTCCAACTATGTRAAAT ATGTGCTGAAAATGATAAGGA'] |
| 3875 | NM_000222.2(KIT): c.2459A > G (p.Asp820Gly) | 3815 | KIT | ['GGTCTAGCCAGAGACATCAAGAATGRTTC TAATTATGTGGTTAAAGGAAAC'] |
| 3876 | NM_000222.2(KIT): c.2386A > G (p.Arg796Gly) | 3815 | KIT | ['GTGTATTCACAGAGACTTGGCAGCCRGAA ATATCCTCCTTACTCATGGTCG'] |
| 3877 | NM_000222.2(KIT): c.1924A > G (p.Lys642Glu) | 3815 | KIT | ['ACGGGAAGCCCTCATGTCTGAACTCRAAG TCCTGAGTTACCTTGGTAATCA'] |
| 3878 | NM_001005862.2(ERBB2): c.2480A > G (p.Asn827Ser) | 2064 | ERBB2 | ['CGGAACGTGCTGGTCAAGAGTCCCARCCA TGTCAAAATTACAGACTTCGGG'] |
| 3879 | NM_001127500.1(MET): c.3743A > G (p.Tyr1248Cys) | 4233 | MET | ['GATTTTGGTCTTGCCAGAGACATGTRTGAT AAAGAATACTATAGTGTACAC'] |
| 3880 | NM_001127500.1(MET): c.3335A > G (p.His1112Arg) | 4233 | MET | ['ACAGGGCATTTTGGTTGTGTATATCVTGGG ACTTTGTTGGACAATGATGGC'] |
| 3881 | NM_001127500.1(MET): c.3785A > G (p.Lys1262Arg) | 4233 | MET | ['AGTGTACACAACAAAACAGGTGCAARGCT GCCAGTGAAGTGGATGGCTTTG'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3882 | NM_002524.4(NRAS): c.182A > G (p.Gln61Arg) | 4893 | NRAS | ['TTGGACATACTGGATACAGCTGGACNAGA AGAGTACAGTGCCATGAGAGAC'] |
| 3883 | NM_004333.4(BRAF): c.1801A > G (p.Lys601Glu) | 673 | BRAF | ['AGGTGATTTTGGTCTAGCTACAGTGVAATC TCGATGGAGTGGGTCCCATCA'] |
| 3884 | NM_004333.4(BRAF): c.1781A > G (p.Asp594Gly) | 673 | BRAF | ['GAAGACCTCACAGTAAAAATAGGTGDTTT TGGTCTAGCTACAGTGAAATCT'] |
| 3885 | NM_004333.4(BRAF): c.770A > G (p.Gln257Arg) | 673 | BRAF | ['GACTTTTGTCGAAAGCTGCTTTTCCRGGGT TTCCGCTGTCAAACATGTGGT'] |
| 3886 | NM_004333.4(BRAF): c.1495A > G (p.Lys499Glu) | 673 | BRAF | ['TACACCTCAGCAGTTACAAGCCTTCRAAA ATGAAGTAGGAGTACTCAGGTG'] |
| 3887 | NM_004333.4(BRAF): c.1502A > G (p.Glu501Gly) | 673 | BRAF | ['CAGCAGTTACAAGCCTTCAAAAATGNAGT AGGAGTACTCAGGTGAGCTTGT'] |
| 3888 | NM_004333.4(BRAF): c.1741A > G (p.Asn581Asp) | 673 | BRAF | ['CATCCACAGAGACCTCAAGAGTAATVGTA TCCTTCCTGAAATTTGTCTGCG'] |
| 3889 | NM_000270.3(PNP): c.383A > G (p.Asp128Gly) | 4860 | PNP | ['CTGAACCCCAAGTTTGAGGTTGGAGRTATC ATGCTGATCCGTGACCATATC'] |
| 3890 | NM_000270.3(PNP): c.575A > G (p.Tyr192Cys) | 4860 | PNP | ['CAACGTGAGCTACAGGAAGGCACCTRTGT GATGGTGGCAGGCCCCAGCTTT'] |
| 3891 | NM_000258.2(MYL3): c.445A > G (p.Met149Val) | 4634 | MYL3 | ['CGACAAGGAGGGCAATGGCACTGTCRTGG GTGCTGAGCTTCGCCACGTGCT'] |
| 3892 | NM_000257.3(MYH7): c.2333A > G (p.Asp778Gly) | 4625 | MYH7 | ['CTGGGGCTGCTGGAGGAAATGAGGGRCGA GAGGCTGAGCCGCATCATCACG'] |
| 3893 | NM_000257.3(MYH7): c.2717A > G (p.Asp906Gly) | 4625 | MYH7 | ['CTGGCAGATGCTGAGGAGCGCTGTGRTCA GCTGATCAAAAACAAGATTCAG'] |
| 3894 | NM_002470.3(MYH3): c.1385A > G (p.Asp462Gly) | 4621 | MYH3 | ['AGACAACACTTCATTGGTGTTTTGGRCATT GCAGGCTTTGAAATCTTTGAG'] |
| 3895 | NM_000530.6(MPZ): c.286A > G (p.Lys96Glu) | 4359 | MPZ | ['CTACATTGACGAGGTGGGGACCTTCRAAG AGCGCATCCAGTGGGTAGGGGA'] |
| 3896 | NM_000530.6(MPZ): c.242A > G (p.His81Arg) | 4359 | MPZ | ['TCCCCTCATTCCTCATAGATCTTCCRCTAT GCCAAGGGACAACCCTACATT'] |
| 3897 | NG_012123.1: g.2493A > G | 6347 | CCL2 | ['GAAAAGAAAGTCTTCTGGAAAGTGAYAGC TGTCTGCCTCCCACTTCTGCTC'] |
| 3898 | RMRP: n.71A > G | 6023 | RMRP | ['TGTTCCTCCCCTTTCCGCCTAGGGGRAAGT CCCCGGACCTCGGGCAGAGAG'] |
| 3899 | NM_005006.6(NDUFS1): c.755A > G (p.Asp252Gly) | 4719 | NDUFS1 | ['TTTCTCAGAAAGACAGAATCCATTGRTGTA ATGGATGCGGTTGGAAGTAAT'] |
| 3900 | NM_005912.2(MC4R): c.508A > G (p.Ile170Val) | 4160 | MC4R | ['GACAGTTAAGCGGGTTGGGATCATCRTAA GTTGTATCTGGGCAGCTTGCAC'] |
| 3901 | NM_005912.2(MC4R): c.821A > G (p.Asn274Ser) | 4160 | MC4R | ['ATATTCTACATCTCTTGTCCTCAGARTCCA TATTGTGTGTGCTTCATGTCT'] |
| 3902 | NM_005912.2(MC4R): c.289A > G (p.Asn97Asp) | 4160 | MC4R | ['GGCTGATATGCTGGTGAGCGTTTCARATGG ATCAGAAACCATTGTCATCAC'] |
| 3903 | NM_005912.2(MC4R): c.185A > G (p.Asn62Ser) | 4160 | MC4R | ['CTGGGTGTCATCAGCTTGTTGGAGARTATC TTAGTGATTGTGGCAATAGCC'] |
| 3904 | NM_000900.3(MGP): c.62 − 2A > G | 4256 | MGP | ['AAGATTCCATGCTTTCATGTGATTCHGAAA TTAAAAAAAAAGATTCATTA'] |
| 3905 | NM_012064.3(MEP): c.401A > G (p.Glu134Gly) | 4284 | MEP | ['AGCGTGGGCCAGGCAACCACAGTGGRGAT CTTCCTGACGCTCCAGTTCGTG'] |

TABLE 7-continued

Diseases/disorders containging A to G Changes. The table includes human gene
mutations that may be corrected by changing a guanine (G) to adenine (A). The gene name,
gene symbol, and Gene ID are indicated.

| SEQ ID NO: | Name | Gene ID | Gene Symbol | Flanks |
|---|---|---|---|---|
| 3906 | NM_000233.3(LHCGR): c.1733A > G (p.Asp578Gly) | -1 | — | ['AAAATGGCAATCCTCATCTTCACCGRTTTC ACCTGCATGGCACCTATCTCT'] |
| 3907 | NM_000233.3(LHCGR): c.1691A > G (p.Asp564Gly) | -1 | — | ['CCAGAATTAATGGCTACCAATAAAGRTAC AAAGATTGCTAAGAAAATGGCA'] |
| 3908 | NM_000894.2(LHB): c.221A > G (p.Gln74Arg) | 3972 | LHB | ['CAGGCGGTCCTGCCGCCCCTGCCTCRGGTG GTGTGCACCTACCGTGATGTG'] |
| 3909 | NM_000238.3(KCNH2): c.1408A > G (p.Asn470Asp) | 3757 | KCNH2 | ['CATGTTCATTGTGGACATCCTCATCRACTT CCGCACCACCTACGTCAATGC'] |
| 3910 | NM_001754.4(RUNX1): c.328A > G (p.Lys110Glu) | 861 | RUNX1 | ['GCTGCCTACGCACTGGCGCTGCAACRAGA CCCTGCCCATCGCTTTCAAGGT'] |
| 3911 | NM_170707.3(LMNA): c.608A > G (p.Glu203Gly) | 4000 | LMNA | ['AACAGGCTGCAGACCATGAAGGAGGDACT GGACTTCCAGAAGAACATCTAC'] |
| 3912 | NM_000421.3(KRT10): c.1315A > G (p.Lys439Glu) | -1 | — | ['TGAATACCAACAACTCCTGGATATTRAGA TCCGACTGGAGAATGAAATTCA'] |
| 3913 | NM_000421.3(KRT10): c.1374 - 2A > G | -1 | — | ['CCGCCGCGTCCGCCGCCTCCGGAACYAAA CGGGGTGAGGTCACATTCGGTT'] |
| 3914 | NM_000422.2(KRT17): c.274A > G (p.Asn92Asp) | 3872 | KRT17 | ['TGAGAAGGCCACCATGCAGAACCTCVATG ACCGCCTGGCCTCCTACCTGGA'] |
| 3915 | NM_000422.2(KRT17): c.275A > G (p.Asn92Ser) | 3872 | KRT17 | ['GAGAAGGCCACCATGCAGAACCTCARTGA CCGCCTGGCCTCCTACCTGGAC'] |
| 3916 | NM_005557.3(KRT16): c.374A > G (p.Asn125Ser) | 3868 | KRT16 | ['GAGAAGGTGACCATGCAGAACCTCARTGA CCGCCTGGCCTCCTACCTGGAC'] |
| 3917 | NM_000526.4(KRT14): c.368A > G (p.Asn123Ser) | 3861 | KRT14 | ['GAGAAGGTGACCATGCAGAACCTCARTGA CCGCCTGGCCTCCTACCTGGAC'] |
| 3918 | NM_000424.3(KRT5): c.1424A > G (p.Glu475Gly) | 3852 | KRT5 | ['ATCGCCACTTACCGCAAGCTGCTGGRGGG CGAGGAATGCAGGTGAGTAGAC'] |
| 3919 | NM_000418.3(IL4R): c.223A > G (p.Ile75Val) | 3566 | IL4R | ['CTGTGTCTGCAGAGCCCACACGTGTNTCCC TGAGAACAACGGAGGCGCGGG'] |
| 3920 | NM_001079817.1(INSR): c.1459A > G (p.Lys487Glu) | 3643 | INSR | ['CCAGGAGAGAAACGACATTGCCCTGRAGA CCAATGGGGACCAGGCATCCTG'] |
| 3921 | NM_000208.2(INSR): c.707A > G (p.His236Arg) | 3643 | INSR | ['TGCACCGCCGAAGGCCTCTGTTGCCRCAGC GAGTGCCTGGGCAACTGTTCT'] |
| 3922 | NM_000208.2(INSR): c.1466A > G (p.Asn489Ser) | 3643 | INSR | ['AGAAACGACATTGCCCTGAAGACCARTGG GGACCAGGCATCCTGTAAGTCA'] |
| 3923 | NM_000208.2(INSR): c.1124 - 2A > G | 3643 | INSR | ['CTTCTAGCTCAGCTGCCAGATTGTCYAAGG AAAGGAGAGAATATCCAGTGG'] |
| 3924 | NM_000208.2(INSR): c.1372A > G (p.Asn458Asp) | 3643 | INSR | ['TCAGGGGAAACTCTTCTTCCACTATRACCC CAAACTCTGCTTGTCAGAAAT'] |
| 3925 | NM_000454.4(SOD1): c.131A > G (p.His44Arg) | 6647 | SOD1 | ['ATTAAAGGACTGACTGAAGGCCTGCRTGG ATTCCATGTTCATGAGTTTGGA'] |
| 3926 | NM_000454.4(SOD1): c.302A > G (p.Glu101Gly) | 6647 | SOD1 | ['GATGGTGTGGCCGATGTGTCTATTGRAGAT TCTGTGATCTCACTCTCAGGA'] |
| 3927 | NM_000454.4(SOD1): c.140A > G (p.His47Arg) | 6647 | SOD1 | ['CTGACTGAAGGCCTGCATGGATTCCRTGTT CATGAGTTTGGAGATAATACA'] |
| 3928 | NM_000454.4(SOD1): c.242A > G (p.His81Arg) | 6647 | SOD1 | ['ATCTGATGCTTTTTCATTATTAGGCRTGTT GGAGACTTGGGCAATGTGACT'] |
| 3929 | NM_000183.2(HADHB): c.788A > G (p.Asp263Gly) | 3032 | HADHB | ['GCACAGGATGAAGGACTCCTTTCTGRTGTG GTACCCTTCAAAGTACCAGGT'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3930 | NM_000523.3(HOXD13): c.974A > G (p.Gln325Arg) | 3239 | HOXD13 | ['GAGAGACAAGTGACCATTTGGTTTCRGAA CCGAAGAGTGAAGGACAAGAAA'] |
| 3931 | NM_000545.6(HNF1A): c.365A > G (p.Tyr122Cys) | 6927 | HNF1A | ['CGTGTGGCGAAGATGGTCAAGTCCTRCCT GCAGCAGCACAACATCCCACAG'] |
| 3932 | NM_000519.3(HBD): c.-81A > G | 3045 | HBD | ['CTGGAGCAGGGAGGACAGGACCAGCRTAA AAGGCAGGGCAGAGTCGACTGT'] |
| 3933 | NM_000518.4(HBB): c.199A > G (p.Lys67Glu) | 3043 | HBB | ['CCCTAAGGTGAAGGCTCATGGCAAGRAAG TGCTCGGTGCCTTTAGTGATGG'] |
| 3934 | NM_000518.4(HBB): c.59A > G (p.Asn20Ser) | 3043 | HBB | ['GTTACTGCCCTGTGGGGCAAGGTGARCGT GGATGAAGTTGGTGGTGAGGCC'] |
| 3935 | NM_000518.4(HBB): c.-81A > G | 3043 | HBB | ['GGGAGGGCAGGAGCCAGGGCTGGGCVTA AAAGTCAGGGCAGAGCCATCTAT'] |
| 3936 | NM_000518.4(HBB): c.-50 - 29A > G | 3043 | HBB | ['GAGGGCAGGAGCCAGGGCTGGGCATRAAA GTCAGGGCAGAGCCATCTATTG'] |
| 3937 | NM_000518.4(HBB): c.-78A > G | 3043 | HBB | ['AGGGCAGGAGCCAGGGCTGGGCATAVAA GTCAGGGCAGAGCCATCTATTGC'] |
| 3938 | NM_000518.4(HBB): c.*113A > G | 3043 | HBB | ['TGAGCATCTGGATTCTGCCTAATAARAAAC ATTTATTTTCATTGCAATGAT'] |
| 3939 | NM_000518.4(HBB): c.*112A > G | 3043 | HBB | ['TTGAGCATCTGGATTCTGCCTAATADAAAA CATTTATTTTCATTGCAATGA'] |
| 3940 | NM_000518.4(HBB): c.*111A > G | 3043 | HBB | ['CTTGAGCATCTGGATTCTGCCTAATRAAAA ACATTTATTTTCATTGCAATG'] |
| 3941 | NM_000518.4(HBB): c.80A > G (p.Glu27Gly) | 3043 | HBB | ['GTGAACGTGGATGAAGTTGGTGGTGNGGC CCTGGGCAGGTTGGTATCAAGG'] |
| 3942 | NM_000518.4(HBB): c.247A > G (p.Lys83Glu) | 3043 | HBB | ['TGGCCTGGCTCACCTGGACAACCTCVAGG GCACCTTTGCCACACTGAGTGA'] |
| 3943 | NM_000517.4(HBA2): c.1A > G (p.Met1Val) | 3040 | HBA2 | ['CCCACAGACTCAGAGAGAACCCACCRTGG TGCTGTCTCCTGCCGACAGAC'] |
| 3944 | NM_000517.4(HBA2): c.*92A > G | 3040 | HBA2 | ['CACCGGCCCTTCCTGGTCTTTGAATRAAGT CTGAGTGGGCAGCAGCCTGTG'] |
| 3945 | NM_000517.4(HBA2): c.96 - 2A > G | 3040 | HBA2 | ['CACCCCTCACTCTGCTTCTCCCCGCRGGAT GTTCCTGTCCTTCCCCACCAC'] |
| 3946 | NM_006121.3(KRT1): c.1445A > G (p.Tyr482Cys) | 3848 | KRT1 | ['GCCCTGGATCTGGAGATTGCCACCTRCAG GACCCTCCTGGAGGGAGAAGAA'] |
| 3947 | NM_001077488.3(GNAS): c.1A > G (p.Met1Val) | 2778 | GNAS | ['GCGCCCCGCCGCCGCCGCCGCCGCCRTGG GCTGCCTCGGGAACAGTAAGAC'] |
| 3948 | NM_000516.5(GNAS): c.680A > G (p.Gln227Arg) | 2778 | GNAS | ['ACCAGCATGTTTGACGTGGGTGGCCDGCG CGATGAACGCCGCAAGTGGATC'] |
| 3949 | NM_000515.4(GH1): c.413A > G (p.Asp138Gly) | 2688 | GH1 | ['GGCGCCTCTGACAGCAACGTCTATGRCCTC CTAAAGGACCTAGAGGAAGGC'] |
| 3950 | NM_000823.3(GHRHR): c.985A > G (p.Lys329Glu) | 2692 | GHRHR | ['TTGTCTTTCCTGCAGGCGTCTCTCCRAGTC GACACTTTTCCTGATCCCACT'] |
| 3951 | NM_002890.2(RASA1): c.1198A > G (p.Lys400Glu) | 5921 | RASA1 | ['GACCAATGAAAATATTCAGCGATTRAAA TATGTCCAACGCCAAACAATCA'] |
| 3952 | NM_002890.2(RASA1): c.1201A > G (p.Ile401Val) | 5921 | RASA1 | ['CAATGAAAATATTCAGCGATTTAAARTAT GTCCAACGCCAAACAATCAGTT'] |
| 3953 | NM_000406.2(GNRHR): c.317A > G (p.Gln106Arg) | 2798 | GNRHR | ['GATGGGATGTGGAACATTACAGTCCRATG GTATGCTGGAGAGTTACTCTGC'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3954 | NM_000406.2(GNRHR): c.851A > G (p.Tyr284Cys) | 2798 | GNRHR | ['TTTACTGTCTGCTGGACTCCCTACTRTGTC CTAGGAATTTGGTATTGGTTTT'] |
| 3955 | NM_000407.4(GP1BB): c.338A > G (p.Tyr113Cys) | -1 | — | ['GCCGGCCGCCCCGAGCGTGCGCCCTDCCG CGACCTGCGTTGCGTGGCGCCC'] |
| 3956 | NM_021957.3(GYS2): c.116A > G (p.Asn39Ser) | 2998 | GYS2 | ['TTTGAAGTTGCTTGGGAAGTGACCARTAA AGGTTTGTACTGCTCCTGAAGG'] |
| 3957 | NM_001146040.1(GLRA1): c.920A > G (p.Tyr307Cys) | 2741 | GLRA1 | ['CCTCCACCCCCACTCTAGGTGTCCTVTGTG AAAGCCATTGACATTTGGATG'] |
| 3958 | NM_001146040.1(GLRA1): c.910A > G (p.Lys304Glu) | 2741 | GLRA1 | ['CTCCGGCTCTCGAGCATCTCTGCCCRAGGT AAGTCCCATTGCCCAAGAGCA'] |
| 3959 | NM_000171.3(GLRA1): c.523A > G (p.Met175Val) | 2741 | GLRA1 | ['CCCCATGGACTTGAAGAATTTCCCCRTGGA TGTCCAGACATGTATCATGCA'] |
| 3960 | NM_000162.3(GCK): c.641A > G (p.Tyr214Cys) | 2645 | GCK | ['ACGGTGGCCACGATGATCTCCTGCTRCTAC GAAGACCATCAGTGCGAGGTC'] |
| 3961 | NM_000145.3(FSHR): c.1345A > G (p.Thr449Ala) | 2492 | FSHR | ['AGGCTGTGATGCTGCTGGCTTTTTCRCTGT CTTTGCCAGTGAGCTGTCAGT'] |
| 3962 | NM_182925.4(FLT4): c.3104A > G (p.His1035Arg) | 2324 | FLT4 | ['CGCCTCCCCGCACCCCAGTGCATCCRCAGA GACCTGGCTGCTCGGAACATT'] |
| 3963 | NM_023110.2(FGFR1): c.1121A > G (p.Tyr374Cys) | 2260 | FGFR1 | ['CCGGCAGTGATGACCTCGCCCCTGTRCCTG GAGATCATCATCTATTGCACA'] |
| 3964 | NM_006894.5(FMO3): c.182A > G (p.Asn61Ser) | 2328 | FMO3 | ['AGCATTTACAAATCAGTCTTTTCCARCTCT TCCAAAGAGATGATGTGTTTC'] |
| 3965 | NM_001002294.2(FMO3): c.923A > G (p.Glu308Gly) | 2328 | FMO3 | ['AAGCCTAACGTGAAGGAATTCACAGRGAC CTCGGCCATTTTTGAGGATGGG'] |
| 3966 | NM_212482.1(FN1): c.2918A > G (p.Tyr973Cys) | 2335 | FN1 | ['ACCGGGCTGTCCCCTGGGGTCACCTRTTAC TTCAAAGTCTTTGCAGTGAGC'] |
| 3967 | NM_000142.4(FGFR3): c.1948A > G (p.Lys650Glu) | 2261 | FGFR3 | ['CGTGCACAACCTCGACTACTACAAGVAGA CAACCAACGTGAGCCCGGCCCT'] |
| 3968 | NM_000142.4(FGFR3): c.1118A > G (p.Tyr373Cys) | 2261 | FGFR3 | ['GAGGCTGACGAGGCGGGCAGTGTGTRTGC AGGCATCCTCAGCTACGGGGTG] |
| 3969 | NM_000142.4(FGFR3): c.1612A > G (p.Ile538Val) | 2261 | FGFR3 | ['GTGCAGGCGCCCAGCAGGTTGATGAYGTT TTTGTGTTTCCCGATCATCTTC'] |
| 3970 | NM_000142.4(FGFR3): c.1619A > G (p.Asn540Ser) | 2261 | FGFR3 | ['GCCCTGCGTGCAGGCGCCCAGCAGGBTGA TGATGTTTTGTGTTTCCCGAT'] |
| 3971 | NM_000142.4(FGFR3): c.833A > G (p.Tyr278Cys) | 2261 | FGFR3 | ['GACGTGGAGTTCCACTGCAAGGTGTRCAG TGACGCACAGCCCCACATCCAG] |
| 3972 | NM_000138.4(FBN1): c.6431A > G (p.Asn2144Ser) | 2200 | FBN1 | ['GTCTGTAAACATGGACAGTGCATCARTAC AGATGGTTCCTATCGCTGCGAG] |
| 3973 | NM_000138.4(FBN1): c.3128A > G (p.Lys1043Arg) | 2200 | FBN1 | ['ATACCCAGCCTCTGCACCCACGGCARGTG CAGAAACACCATTGGCAGCTTT'] |
| 3974 | NM_000138.4(FBN1): c.2261A > G (p.Tyr754Cys) | 2200 | FBN1 | ['TATAAATGTATATGCAATTCAGGATRTGAA GTGGATTCAACTGGGAAAAAC'] |
| 3975 | NM_000146.3(FTL): c.-160A > G | 2512 | FTL | ['CCGCGGGTCTGTCTCTTGCTTCAACRGTGT TTGGACGGAACAGATCCGGGG'] |
| 3976 | NM_000043.4(FAS): c.695A > G (p.Tyr232Cys) | 355 | FAS | ['TTTTCAGATGTTGACTTGAGTAAATRTATC ACCACTATTGCTGGAGTCATG] |
| 3977 | NM_000043.4(FAS): c.763A > G (p.Asn255Asp) | 355 | FAS | ['AGGCTTTGTTCGAAAGAATGGTGTCRATG AAGCCAAAATAGATGAGATCAA'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 3978 | NM_000043.4(FAS): c.353A > G (p.Asn118Ser) | 355 | FAS | ['TTTCTAGGCTTAGAAGTGGAAATAARCTGC ACCCGGACCCAGAATACCAAG'] |
| 3979 | NM_000129.3(F13A1): c.851A > G (p.Tyr284Cys) | 2162 | F13A1 | ['CTCGTTGGATCCTGGGACAATATCTRTGCC TATGGCGTCCCCCCATCGGCC'] |
| 3980 | NM_000121.3(EPOR): c.1460A > G (p.Asn487Ser) | 2057 | EPOR | ['GGCTTATCCGATGGCCCCTACTCCARCCCT TATGAGAACAGCCTTATCCCA'] |
| 3981 | NM_207034.2(EDN3): c.335A > G (p.His112Arg) | 1908 | EDN3 | ['GACAAGGAGTGTGTCTACTATTGCCRCCTG GACATCATTTGGATCAACACT'] |
| 3982 | NM_001257988.1(TYMP): c.665A > G (p.Lys222Arg) | 1890 | TYMP | ['CAGAGCGGACAGCCCCTCCACGAGTYTCT TACTGAGAATGGAGGCTTTGGG'] |
| 3983 | NM_003286.2(TOP1): c.1598A > G (p.Asp533Gly) | -1 | — | ['GTAGAGTTTGACTTCCTCGGGAAGGRCTCC ATCAGATACTATAACAAGGTC'] |
| 3984 | NM_001943.3(DSG2): c.797A > G (p.Asn266Ser) | 1829 | DSG2 | ['GTTCAGATTCGTATTTTGGATGTCARTGAC AATATACCTGTAGTAGAAAAT'] |
| 3985 | NM_001943.3(DSG2): c.1880 - 2A > G | 1829 | DSG2 | ['TCTGTGTTCAATTTTGTGTCTGTACRGTGG TACCACTTTTACTGCTGATGT'] |
| 3986 | NM_024422.4(DSC2): c.631 - 2A > G | 1824 | DSC2 | ['TTTCTCCTTATTTTACTCTCTTCACRGATAA TTGCCTTTGCAACAACTCCA'] |
| 3987 | NG_012088.1: g.2209A > G | 3586 | IL10 | ['CCAGGATGGTCTCGATCTCCTGACCYTATG ATCCGCCCGCCTTGGCCTCCC'] |
| 3988 | NM_000498.3(CYP11B2): c.1492A > G (p.Thr498Ala) | -1 | — | ['GAGGCCTGGCACGTCCCCCCTCCTCRCTTT CAGAGCGATTAACTAGTCTTG'] |
| 3989 | NM_000941.2(POR): c.1733A > G (p.Tyr578Cys) | 5447 | POR | ['CGCCGCTCGGATGAGGACTACCTGTRCCG GGAGGAGCTGGCGCAGTTCCAC'] |
| 3990 | NM_000941.2(POR): c.15A > G (p.Gly5=) | 5447 | POR | ['CTAACAGTTTCATGATCAACATGGGRGACT CCCACGTGGACACCAGCTCCA'] |
| 3991 | NM_001885.2(CRYAB): c.358A > G (p.Arg120Gly) | 1410 | CRYAB | ['TGGTTTCATCTCCAGGGAGTTCCACRGGAA ATACCGGATCCCAGCTGATGT'] |
| 3992 | NM_021954.3(GJA3): c.188A > G (p.Asn63Ser) | 2700 | GJA3 | ['AACACCCAGCAGCCGGGCTGCGAGARCGT CTGCTACGACAGGGCCTTCCCC'] |
| 3993 | NM_004004.5(GJB2): c.218A > G (p.His73Arg) | 2706 | GJB2 | ['TACGATCACTACTTCCCCATCTCCCRCATC CGGCTATGGGCCCTGCAGCTG'] |
| 3994 | NM_001735.2(C5): c.1115A > G (p.Lys372Arg) | 727 | C5 | ['CGTCTACCCCTCACCCAATCTACCYTGAT GGGATATGGAATCCCAGGCTT'] |
| 3995 | NM_001848.2(COL6A1): c.362A > G (p.Lys121Arg) | 1291 | COL6A1 | ['CTCAAAAGCAGCGTGGACGCGGTCARGTA CTTTGGGAAGGGCACCTACACC'] |
| 3996 | NM_000093.4(COL5A1): c.655 - 2A > G | 1289 | COL5A1 | ['TTTTCATGAGCGTCTCTTCTTTTCCRGGGTG ACATCCAGCAGCTGCTCTTT'] |
| 3997 | NM_000089.3(COL1A2): c.226 - 2A > G | 1278 | COL1A2 | ['TATAATTTTTTTTTTTACTTCTCTRGAACT TTGCTGCTCAGTATGATGGA'] |
| 3998 | NM_000089.3(COL1A2): c.70 + 717A > G | 1278 | COL1A2 | ['GAGTGGGTACATTCTGAAAAGTAATRTAA GTGTCTCAATTCACTTTCTAGT'] |
| 3999 | NM_001844.4(COL2A1): c.4172A > G (p.Tyr1391Cys) | 1280 | COL2A1 | ['ACGGAAGGCTCCCAGAACATCACCTRCCA CTGCAAGAACAGCATTGCCTAT'] |
| 4000 | NM_001844.4(COL2A1): c.2974A > G (p.Arg992Gly) | 1280 | COL2A1 | ['CGGTCTGCCTGGGCAACGTGGTGAGRGAG GATTCCCTGGCTTGCCTGGCCC'] |
| 4001 | NM_000493.3(COL10A1): c.1790A > G (p.Tyr597Cys) | -1 | — | ['TTTACTTGTCAGATACCAGGAATATRCTAT TTTTCATACCACGTGCATGTG'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4002 | NM_004385.4(VCAN): c.4004 - 2A > G | 1462 | VCAN | ['GTATTGTGAAAACTCTGTTTTTTTCDGGTC GAATGAGTGATTTGAGTGTAA'] |
| 4003 | NM_020549.4(CHAT): c.1444A > G (p.Arg482Gly) | 1103 | CHAT | ['CGTCAGCGAGCTCCCCGCCCCCCGGVGGC TGCGGTGGAAATGCTCCCCGGA'] |
| 4004 | NM_000078.2(CETP): c.1376A > G (p.Asp459Gly) | 1071 | CETP | ['AACAGCAAAGGCGTGAGCCTCTTCGRCAT CATCAACCCTGAGATTATCACT'] |
| 4005 | NM_000083.2(CLCN1): c.1655A > G (p.Gln552Arg) | 1180 | CLCN1 | ['GTGATTTGCTTCGAATTAACGGGTCDGATT GCTCACATCCTGCCCATGATG'] |
| 4006 | NM_000083.2(CLCN1): c.382A > G (p.Met128Val) | 1180 | CLCN1 | ['CTTTCTGGTGCTTCTGGGACTGCTGRTGGC TCTGGTCAGCTGGAGCATGGA'] |
| 4007 | NM_199440.1(HSPD1): c.86A > G (p.Asp29Gly) | 3329 | HSPD1 | ['CATCTCACTCGGGCTTATGCCAAAGRTGTA AAATTTGGTGCAGATGCCCGA'] |
| 4008 | NM_001904.3(CTNNB1): c.95A > G (p.Asp32Gly) | 1499 | CTNNB1 | ['CACTGGCAGCAACAGTCTTACCTGGNCTCT GGAATCCATTCTGGTGCCACT'] |
| 4009 | NM_001904.3(CTNNB1): c.121A > G (p.Thr41Ala) | 1499 | CTNNB1 | ['CTCTGGAATCCATTCTGGTGCCACTNCCAC AGCTCCTTCTCTGAGTGGTAA'] |
| 4010 | NM_007294.3(BRCA1): c.211A > G (p.Arg71Gly) | 672 | BRCA1 | ['TTTATGTAAGAATGATATAACCAAARGGT ATATAATTTGGTAATGATGCTA'] |
| 4011 | NM_001202.3(BMP4): c.278A > G (p.Glu93Gly) | 652 | BMP4 | ['GATCTTTACCGGCTTCAGTCTGGGGRGGAG GAGGAAGAGCAGATCCACAGC'] |
| 4012 | NM_000342.3(SLC4A1): c.166A > G (p.Lys56Glu) | 6521 | SLC4A1 | ['CACCACATCACACCCGGGTACCCACRAGG TGAGGACCCCAGCCTCCTCCGT'] |
| 4013 | NM_000342.3(SLC4A1): c.2509A > G (p.Thr837Ala) | 6521 | SLC4A1 | ['GAAGACCTGGCGCATGCACTTATTCRCGG GCATCCAGATCATCTGCCTGGC'] |
| 4014 | NM_001681.3(ATP2A2): c.2300A > G (p.Asn767Ser) | 488 | ATP2A2 | ['TTCATCCGCTACCTCATCTCGTCCARCGTC GGGGAAGTTGTCTGGTAGGTC'] |
| 4015 | NM_000486.5(AQP2): c.203A > G (p.Asn68Ser) | 359 | AQP2 | ['GGCCACATAAGCGGGGCCCACATCAVCCC TGCCGTGACTGTGGCCTGCCTG'] |
| 4016 | NM_000041.3(APOE): c.237 - 2A > G | 348 | APOE | ['GACACCCTCCCGCCCTCTCGGCCGCRGGGC GCTGATGGACGAGACCATGAA'] |
| 4017 | NM_000041.3(APOE): c.490A > G (p.Lys164Glu) | 348 | APOE | ['CGCCTCCCACCTGCGCAAGCTGCGTVAGC GGCTCCTCCGCGATGCCGATGA'] |
| 4018 | NM_000041.3(APOE): c.178A > G (p.Thr60Ala) | 348 | APOE | ['TTGGGATTACCTGCGCTGGGTGCAGRCACT GTCTGAGCAGGTGCAGGAGGA'] |
| 4019 | NM_000040.1(APOC3): c.280A > G (p.Thr94Ala) | 345 | APOC3 | ['GGATTTGGACCCTGAGGTCAGACCARCTTC AGCCGTGGCTGCCTGAGACCT'] |
| 4020 | NM_000040.1(APOC3): c.232A > G (p.Lys78Glu) | 345 | APOC3 | ['CCTGAAAGACTACTGGAGCACCGTTRAGG ACAAGTTCTCTGAGTTCTGGGA'] |
| 4021 | NM_001042425.1(TFAP2A): c.751A > G (p.Arg251Gly) | 7020 | TFAP2A | ['GTCGCTGCTGGGCGGAGTGCTCCGGVGGT GAGGCCCGGCACGGCCCCGCCC'] |
| 4022 | NM_000488.3(SERPINC1): c.655A > G (p.Asn219Asp) | 462 | SERPINC1 | ['TGCAGAGCAATCCAGAGCGGCCATCRACA AATGGGTGTCCAATAAGACCGA'] |
| 4023 | NM_001085.4(SERPINA3): c.1240A > G (p.Met414Val) | 12 | SERPINA3 | ['TACAGACACCCAGAACATCTTCTTCRTGAG CAAAGTCACCAATCCCAAGCA'] |
| 4024 | NM_001148.4(ANK2): c.4373A > G (p.Glu1458Gly) | 287 | ANK2 | ['TGCATGGCATCTTGGGCGGAAAGGRATC AGAGTCAGATCAAGAACAGGAG'] |
| 4025 | NM_001145.4(ANG): c.121A > G (p.Lys41Glu) | -1 | — | ['CTTCCTGACCCAGCACTATGATGCCRAACC ACAGGGCCGGGATGACAGATA'] |

TABLE 7-continued

Diseases/disorders containging A to G Changes.The table includes human gene mutations that may be corrected by changing a guanine (G) to adenine (A).The gene name, gene symbol, and Gene ID are indicated.

| SEQ ID NO: | Name | Gene ID | Gene Symbol | Flanks |
|---|---|---|---|---|
| 4026 | NM_001145.4(ANG): c.208A > G (p.Ile70Val) | -1 | — | ['ACCCTGCAAAGACATCAACACATTTRTTCA TGGCAACAAGCGCAGCATCAA'] |
| 4027 | NM_000484.3(APP): c.2146A > G (p.Ile716Val) | 351 | APP | ['GGGCGGTGTTGTCATAGCGACAGTGRTCG TCATCACCTTGGTGATGCTGAA'] |
| 4028 | NM_000484.3(APP): c.2078A > G (p.Glu693Gly) | 351 | APP | ['TTTGTTTTCAAGGTGTTCTTTGCAGRAGAT GTGGGTTCAAACAAAGGTGCA'] |
| 4029 | NM_000484.3(APP): c.2140A > G (p.Thr714Ala) | 351 | APP | ['CATGGTGGGCGGTGTTGTCATAGCGRCAG TGATCGTCATCACCTTGGTGAT'] |
| 4030 | NM_000021.3(PSEN1): c.488A > G (p.His163Arg) | 5663 | PSEN1 | ['AAATGCTTTCTTTTCTAGGTCATCCRTGCC TGGCTTATTATATCATCTCTA'] |
| 4031 | NM_000021.3(PSEN1): c.415A > G (p.Met139Val) | 5663 | PSEN1 | ['GCACTCAATTCTGAATGCTGCCATCRTGAT CAGTGTCATTGTTGTCATGAC'] |
| 4032 | NM_000021.3(PSEN1): c.436A > G (p.Met146Val) | 5663 | PSEN1 | ['CATCATGATCAGTGTCATTGTTGTCNTGAC TATCCTCCTGGTGGTTCTGTA'] |
| 4033 | NM_000021.3(PSEN1): c.839A > G (p.Glu280Gly) | 5663 | PSEN1 | ['GTTGAAACAGCTCAGGAGAGAAATGVAAC GCTTTTTCCAGCTCTCATTTAC'] |
| 4034 | NM_000021.3(PSEN1): c.998A > G (p.Asp333Gly) | 5663 | PSEN1 | ['CAAGACACTGTTGCAGAGAATGATGRTGG CGGGTTCAGTGAGGAATGGGAA'] |
| 4035 | NM_000034.3(ALDOA): c.386A > G (p.Asp129Gly) | 226 | ALDOA | ['CCCCTTCCTCTTCTCTTAGGGTTGGRTGGG CTGTCTGAGCGCTGTGCCCAG'] |
| 4036 | NM_000477.5(ALB): c.714 - 2A > G | 213 | ALB | ['CATTTTGATTGGCGATTTTCTTTTTDGGGC AGTAGCTCGCCTGAGCCAGAG'] |
| 4037 | NM_001151.3(SLC25A4): c.311A > G (p.Asp104Gly) | 291 | SLC25A4 | ['AAGCAGCTCTTCTTAGGGGGTGTGGRTCG GCATAAGCAGTTCTGGCGCTAC'] |
| 4038 | NM_013411.4(AK2): c.1A > G (p.Met1Val) | 204 | AK2 | ['GTGGCAGTGAGAGACTTCGGCGGACRTGG CTCCCAGCGTGCCAGCGGCAGA'] |
| 4039 | NM_013411.4(AK2): c.494A > G (p.Asp165Gly) | 204 | AK2 | ['AACCCTCCAAAAGAGCCCATGAAAGRTGA CGTATGTAAACTCAGGACAAAA'] |
| 4040 | NM_000476.2(AK1): c.491A > G (p.Tyr164Cys) | 203 | AK1 | ['GCCACAGAACCCGTCATCGCCTTCTRTGAG AAACGTGGCATTGTGCGCAAG'] |
| 4041 | NM_001100.3(ACTA1): c.350A > G (p.Asn117Ser) | 58 | ACTA1 | ['GAGGCCCCCCTCAATCCCAAGGCCARCCG CGAGAAGATGACCCAGATCATG'] |
| 4042 | NM_001103.3(ACTN2): c.26A > G (p.Gln9Arg) | 88 | ACTN2 | ['ATGAACCAGATAGAGCCCGGCGTGCRGTA CAACTACGTGTACGACGAGGAT'] |
| 4043 | NM_005159.4(ACTC1): c.1088A > G (p.Glu363Gly) | -1 | — | ['CAGCAAATGTGGATTAGCAAGCAAGRGTA CGATGAGGCAGGCCCATCCATT'] |
| 4044 | NM_005159.4(ACTC1): c.373A > G (p.Met125Val) | -1 | — | ['CAACCGGGAAGATGACTCAGATCRTGT TTGAGACCTTCAATGTCCCTGC'] |
| 4045 | NM_018109.3(MTPAP): c.1432A > G (p.Asn478Asp) | 55149 | MTPAP | ['TGATTCTTCTCCTCTGTACATTCAGRATCC ATTTGAAACTTCTCTCAACAT'] |
| 4046 | NM_016955.3(SEPSECS): c.1001A > G (p.Tyr334Cys) | 51091 | SEPSECS | ['TTATTGTCACTTGGATCAAATGGCTRTAAG AAGCTACTAAAAGAAAGAAAG'] |
| 4047 | NM_014053.3(FLVCR1): c.361A > G (p.Asn121Asp) | 28982 | FLVCR1 | ['GATCTTCAGCCTGTACTCGCTGGTCRACGC CTTTCAGTGGATCCAGTACAG'] |
| 4048 | NM_000021.3(PSEN1): c.697A > G (p.Met233Val) | 5663 | PSEN1 | ['ATATCTCATTATGATTAGTGCCCTCDTGGC CCTGGTGTTTATCAAGTACCT'] |
| 4049 | NM_000207.2(INS): c.323A > G (p.Tyr108Cys) | -1 | — | ['TGCTCCCTCTACCAGCTGGAGAACTRCTGC AACTAGACGCAGCCCGCAGGC'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4050 | NM_000334.4(SCN4A): c.4078A > G (p.Met1360Val) | 6329 | SCN4A | ['GAAGCAGGCCTTCGACATCACCATCRTGA TCCTCATCTGCCTCAACATGGT'] |
| 4051 | NM_000334.4(SCN4A): c.4108A > G (p.Met1370Val) | 6329 | SCN4A | ['CCTCATCTGCCTCAACATGGTCACCRTGAT GGTGGAGACAGACAACCAGAG'] |
| 4052 | NM_000518.4(HBB): c.316 - 2A > G | 3043 | HBB | ['TTCATACCTCTTATCTTCCTCCCACVGCTCC TGGGCAACGTGCTGGTCTGT'] |
| 4053 | NM_000525.3(KCNJ11): c.155A > G (p.Gln52Arg) | 3767 | KCNJ11 | ['GTGGCCCACAAGAACATCCGGGAGCRGGG CCGCTTCCTGCAGGACGTGTTC'] |
| 4054 | NM_000525.3(KCNJ11): c.544A > G (p.Ile182Val) | 3767 | KCNJ11 | ['AGCCCACCGCAGGGCTGAGACCCTCRTCTT CAGCAAGCATGCGGTGATCGC'] |
| 4055 | NM_000525.3(KCNJ11): c.886A > G (p.Ile296Val) | 3767 | KCNJ11 | ['GGAAGGCGTGGTGGAAACCACGGGCVTCA CCACCCAGGCCCGCACCTCCTA'] |
| 4056 | NM_000525.3(KCNJ11): c.989A > G (p.Tyr330Cys) | 3767 | KCNJ11 | ['GAGGACGGACGTTACTCTGTGGACTRCTCC AAGTTTGGCAACACCGTCAAA'] |
| 4057 | NM_000528.3(MAN2B1): c.1831 - 2A > G | 4125 | MAN2B1 | ['CCCATCTGTGGACCCTTTTCTGCCCRGCAC ATCCGGGCAACGTTTGATCCT'] |
| 4058 | NM_000639.2(FASLG): c.466A > G (p.Arg156Gly) | 356 | FASLG | ['ATTTATTTCAGGCAAGTCCAACTCARGGTC CATGCCTCTGGAATGGGAAGA'] |
| 4059 | NM_000920.3(PC): c.1705A > G (p.Thr569Ala) | 5091 | PC | ['CCCGGGGCTGCTGCTGATGGACACGRCCTT CAGGGACGCCCACCAGTCACT'] |
| 4060 | NM_001017420.2(ESCO2): c.1132 - 7A > G | 157570 | ESCO2 | ['AATGGGTTTCTTTTTTTACCCCCCARTTATA GGACGCTGGTCAGAAACATT'] |
| 4061 | NM_001017420.2(ESCO2): c.1674 - 2A > G | 157570 | ESCO2 | ['ATTAAATCATCTTTTCTTCTCTTTTRGGAAT TGCTTCATGTTTGGCTGTTT'] |
| 4062 | NM_001129765.1(NSDHL): c.1046A > G (p.Tyr349Cys) | 50814 | NSDHL | ['GAGAGAGCCAAAAAGGCCATGGGCTVCCA GCCACTAGTGACCATGGATGAT'] |
| 4063 | NM_001701.3(BAAT): c.967A > G (p.Ile323Val) | 570 | BAAT | ['AGAGGCCCAGGGGCAATTCCTCTTCRTTGT AGGAGAAGGTGATAAGACTAT'] |
| 4064 | NM_002977.3(SCN9A): c.406A > G (p.Ile136Val) | 6335 | SCN9A | ['ATTCAGCATGCTCATCATGTGCACTRTTCT GACAAACTGCATATTTATGAC'] |
| 4065 | NM_004004.5(GJB2): c.487A > G (p.Met163Val) | 2706 | GJB2 | ['CTATGTCATGTACGACGGCTTCTCCRTGCA GCGGCTGGTGAAGTCAACGC'] |
| 4066 | NM_004519.3(KCNQ3): c.1403A > G (p.Asn468Ser) | 3786 | KCNQ3 | ['GAACCAAAGCCTGTTGGCTTAAACARTAA AGAGCGTTTCCGCACGGCCTTC'] |
| 4067 | NM_004519.3(KCNQ3): c.2462A > G (p.Asn821Ser) | 3786 | KCNQ3 | ['AGAGATGATTATGTGTTCGGCCCCARTGG GGGGTCGAGCTGGATGAGGGAG'] |
| 4068 | NM_004519.3(KCNQ3): c.914A > G (p.Asp305Gly) | 3786 | KCNQ3 | ['AAAGAGGAGTTTGAGACCTATGCAGRTGC CCTGTGGTGGGCCTGGTGAGT'] |
| 4069 | NM_004525.2(LRP2): c.770 - 2A > G | 4036 | LRP2 | ['TGTAACTCTCTCTTTTTCCCCCCACRGAAA GCGGTCCTCATGATGTTCATA'] |
| 4070 | NM_007375.3(TARDBP): c.1055A > G (p.Asn352Ser) | 23435 | TARDBP | ['CAGAACCAGTCAGGCCCATCGGGTARTAA CCAAAACCAAGGCAACATGCAG'] |
| 4071 | NM_007375.3(TARDBP): c.800A > G (p.Asn267Ser) | 23435 | TARDBP | ['AATGCCGAACCTAAGCACAATAGCARTAG ACAGTTAGAAAGAAGTGGAAGA'] |
| 4072 | NM_012434.4(SLC17A5): c.406A > G (p.Lys136Glu) | 26503 | SLC17A5 | ['ATATGTTGCCAGCAAAATAGGGGGGDAAA TGCTGCTAGGATTTGGGATCCT'] |
| 4073 | NM_012463.3(ATP6V0A2): c.732 - 2A > G | 23545 | ATP6V0A2 | ['AGACTGTGTTCAACTCTTGTCTTCCRGCTA CCACTGCCACGTGTACCCCTA'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4074 | NM_014043.3(CHMP2B): c.85A > G (p.Ile29Val) | 25978 | CHMP2B | ['GTTACGAGGTACACAGAGGGCTATARTCA GAGATCGAGCAGCTTTAGAGAA'] |
| 4075 | NM_018136.4(ASPM): c.2761 - 25A > G | 259266 | ASPM | ['AGCAAAATTATAATATTGGAATATARTATC TGGAACTTATTTCTTTATAGG'] |
| 4076 | NM_022081.5(HPS4): c.461A > G (p.His154Arg) | 89781 | HPS4 | ['ATTCTGAAAAACACCAGTGATCTGCRTAA GATTTTCAATTCCCTCTGGAAC'] |
| 4077 | NM_024649.4(BBS1): c.1340 - 2A > G | -1 | — | ['GTCAGCCTCTGGGACCCTTCTCCACRGCCA TGCACCGGGCCTTCCAGACAG'] |
| 4078 | NM_032520.4(GNPTG): c.610 - 2A > G | 84572 | GNPTG | ['TGCTGCCCCTGCATCCTCCACCTTCRGGGC CATGAGAAGTTGCTGAGGACA'] |
| 4079 | NM_172107.2(KCNQ2): c.1A > G (p.Met1Val) | 3785 | KCNQ2 | ['CCCGGGGCGCCTCCCGCCAGGCACCRTGG TGCAGAAGTCGCGCAACGGCGG'] |
| 4080 | NM_172107.2(KCNQ2): c.356A > G (p.Glu119Gly) | 3785 | KCNQ2 | ['GTGTTTTCCACCATCAAGGAGTATGRGAA GAGCTCGGAGGGGGCCCTCTAC'] |
| 4081 | NM_172107.2(KCNQ2): c.622A > G (p.Met208Val) | 3785 | KCNQ2 | ['CCTGCGCTTCCTGCAGATTCTGCGGRTGAT CCGCATGGACCGGCGGGGAGG'] |
| 4082 | NM_172107.2(KCNQ2): c.635A > G (p.Asp212Gly) | 3785 | KCNQ2 | ['CAGATTCTGCGGATGATCCGCATGGRCCG GCGGGGAGGCACCTGGAAGCTG'] |
| 4083 | NM_172107.2(KCNQ2): c.773A > G (p.Asn258Ser) | 3785 | KCNQ2 | ['GTGTACTTGGCAGAGAAGGGGGAGARCGA CCACTTTGACACCTACGCGGAT'] |
| 4084 | NM_172107.2(KCNQ2): c.1764 - 2A > G | 3785 | KCNQ2 | ['ATGCTTTGGGGTCTCTGTTCCCGGTRGAGT GGACCAGATCGTGGGGCGGGG'] |
| 4085 | NM_000495.4(COL4A5): c.1A > G (p.Met1Val) | 1287 | COL4A5 | ['AAGGAGCTGCGGGAGCGGAGAAGARTG AAACTGCGTGGAGTCAGCCTGGC'] |
| 4086 | NM_000495.4(COL4A5): c.466 - 2A > G | 1287 | COL4A5 | ['AGAACTTCCATTGATGGCTTCTTTTRGGGT GAACCAGGTAGTATAATTATG'] |
| 4087 | NM_000495.4(COL4A5): c.547 - 2A > G | 1287 | COL4A5 | ['TCATTTTCTTTACTCACTTTATAACRGGGC CTACCTGGTCCCACTGGTATA'] |
| 4088 | NM_000495.4(COL4A5): c.610 - 2A > G | 1287 | COL4A5 | ['ATTTTCTCTTTTGTCTTCTCTTCTTRGGGCC CTCCTGGTCCACCAGGACTT'] |
| 4089 | NM_000495.4(COL4A5): c.892 - 2A > G | 1287 | COL4A5 | ['GCCCTATCATTTCTTTGTATCCTATRGGGT AAACCAGGCAAAGATGGAGAA'] |
| 4090 | NM_000495.4(COL4A5): c.1340 - 2A > G | 1287 | COL4A5 | ['TTGCTATCCTTTCTTTATCTTACTCRGGTGA TGAGATATGTGAACCAGGCC'] |
| 4091 | NM_000495.4(COL4A5): c.2042 - 18A > G | 1287 | COL4A5 | ['TTCTTTGAACGTTTTCCTTTCAATARCTGCT GTTTCTCCATAGGTGACCCT'] |
| 4092 | NM_000495.4(COL4A5): c.2147 - 2A > G | 1287 | COL4A5 | ['GTTAAAAAATGACTTATCATTTTACRGGCT TTCCTGGAATTCCAGGACCTC'] |
| 4093 | NM_000495.4(COL4A5): c.2394A > G (p.Lys798=) | 1287 | COL4A5 | ['GCTTAGATGGGCTCCCTGGACCAAARGGT ATGGAGGCTGTCACTGCATCTC] |
| 4094 | NM_000495.4(COL4A5): c.2510 - 33A > G | 1287 | COL4A5 | ['CAGATACATCTTTTAAAACTGCTTCRGTAC TTATTAATATTGATATTGTAT'] |
| 4095 | NM_000495.4(COL4A5): c.2692A > G (p.Met898Val) | 1287 | COL4A5 | ['ATTCTTCAAAGGTACCAAAGGTGAARTGG GTATGATGGGACCTCCAGGCCC'] |
| 4096 | NM_000495.4(COL4A5): c.2746A > G (p.Ser916Gly) | 1287 | COL4A5 | ['AGGACCTTTGGGAATTCCTGGCAGGRGTG GTGTACCTGGTCTTAAAGGTAA'] |
| 4097 | NM_000495.4(COL4A5): c.3107 - 2A > G | 1287 | COL4A5 | ['ATATTATATATCACATATTTTCAACRGGGC CTCAGGGTGTGGAAGGGCCTC'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4098 | NM_000495.4(COL4A5): c.3455-9A > G | 1287 | COL4A5 | ['AACTGGGTGTAACCTGCTGTACTCARTTTT TTAGGTGGTGGAGGTCATCCT'] |
| 4099 | NM_000495.4(COL4A5): c.3605-2A > G | 1287 | COL4A5 | ['TCTTCTAATTATACTTTACTTTCATRGGCCA AAAGGGTGATGGAGGATTAC'] |
| 4100 | NM_000495.4(COL4A5): c.3925-2A > G | 1287 | COL4A5 | ['GTAACATTAATGATTTTATTTATTCRGGGT AATCCTGGCCGGCCGGGTCTC'] |
| 4101 | NM_000495.4(COL4A5): c.3998-2A > G | 1287 | COL4A5 | ['ATAAAACTGTATGTACCTTCTGTGCDGGCA TGAAAGGACCCAGTGGAGTAC'] |
| 4102 | NM_000495.4(COL4A5): c.4790A > G (p.Tyr1597Cys) | 1287 | COL4A5 | ['GGATGGGATTCTCTGTGGATTGGTTRTTCC TTCATGATGGTATTTTACACT'] |
| 4103 | NM_000495.4(COL4A5): c.4977-2A > G | 1287 | COL4A5 | ['CTGATTGTCTTATTTCTTATTTCCCRGTAAA CCTCAGTCAGAAACGCTGAA'] |
| 4104 | NM_005359.5(SMAD4): c.425-6A > G | 4089 | SMAD4 | ['TTTCATTTGTTTTCCCCTTTAAACARTTAAG ATCTCTCAGGATTAACACTG'] |
| 4105 | NM_005359.5(SMAD4): c.989A > G (p.Glu330Gly) | 4089 | SMAD4 | ['TATTGGTGTTCCATTGCTTACTTTGRAATG GATGTTCAGGTAGGAGAGACA'] |
| 4106 | NM_020630.4(RET): c.1996A > G (p.Lys666Glu) | 5979 | RET | ['CCACTGCTACCACAAGTTTGCCCACVAGCC ACCCATCTCCTCAGCTGAGAT'] |
| 4107 | NM_020630.4(RET): c.2342A > G (p.Gln781Arg) | 5979 | RET | ['CTGTCAGAGTTCAACGTCCTGAAGCRGGTC AACCACCCACATGTCATCAAA'] |
| 4108 | NM_000060.3(BTD): c.194A > G (p.His65Arg) | 686 | BTD | ['TATTATGTGGCTGCCGTGTATGAGCRTCCA TCCATCCTGAGTCTGAACCCT'] |
| 4109 | NM_000060.3(BTD): c.278A > G (p.Tyr93Cys) | 686 | BTD | ['CTCATGAACCAGAACCTTGACATCTRTGAA CAGCAAGTGATGACTGCAGCC'] |
| 4110 | NM_000060.3(BTD): c.356A > G (p.Asn119Ser) | 686 | BTD | ['CCAGAAGATGGCATTCATGGATTCARCTTT ACAAGAACATCCATTTATCCA'] |
| 4111 | NM_000060.3(BTD): c.364A > G (p.Arg122Gly) | 686 | BTD | ['TGGCATTCATGGATTCAACTTTACARGAAC ATCCATTTATCCATTTTTGGA'] |
| 4112 | NM_000060.3(BTD): c.515A > G (p.Asn172Ser) | 686 | BTD | ['AGGGGAGATATGTTCTTGGTGGCCARTCTT GGGACAAAGGAGCCTTGTCAT'] |
| 4113 | NM_000060.3(BTD): c.583A > G (p.Asn195Asp) | 686 | BTD | ['CCCAAAAGATGGGAGATACCAGTTCRACA CAAATGTCGTGTTCAGCAATAA'] |
| 4114 | NM_000060.3(BTD): c.584A > G (p.Asn195Ser) | 686 | BTD | ['CCAAAAGATGGGAGATACCAGTTCARCAC AAATGTCGTGTTCAGCAATAAT'] |
| 4115 | NM_000060.3(BTD): c.641A > G (p.Asn214Ser) | 686 | BTD | ['CTTGTTGACCGCTACCGTAAACACARCCTC TACTTTGAGGCAGCATTCGAT'] |
| 4116 | NM_000060.3(BTD): c.880A > G (p.Ile294Val) | 686 | BTD | ['GAAAGCTTTGCTGTTGCCTTTGGCRTCAA CGTTCTGGCAGCTAATGTCCA'] |
| 4117 | NM_000060.3(BTD): c.1205A > G (p.Asn402Ser) | 686 | BTD | ['TTTCACTCTGAGATGATGTATGACARTTTC ACCCTGGTCCCTGTCTGGGGA'] |
| 4118 | NM_000060.3(BTD): c.1313A > G (p.Tyr438Cys) | 686 | BTD | ['AGGCCCACCTTATCCAAAGAGCTGTRTGCC CTGGGGGTCTTTGATGGGCTT'] |
| 4119 | NM_000060.3(BTD): c.1619A > G (p.Tyr540Cys) | 686 | BTD | ['ACGGCGGCTCTCTATGGGCGCTTGTRTGAG AGGGACTAGGAAAAGTGTGTG] |
| 4120 | NM_000155.3(GALT): c.1A > G (p.Met1Val) | 2592 | GALT | ['TTCCAGCGGATCCCCCGGTGGCCTCRTGTC GCGCAGTGGAACCGATCCTCA'] |
| 4121 | NM_000155.3(GALT): c.67A > G (p.Thr23Ala) | 2592 | GALT | ['GTCAGAGGCGGACGCCGCAGCAGCARCCT TCCGGGCAAACGGTAACTGCAC'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4122 | NM_000155.3(GALT): c.253 - 2A > G | 2592 | GALT | ['GTGCTTCTAGCCTATCCTTGTCGGTRGGTG AATCCCCAGTACGATAGCACC'] |
| 4123 | NM_000155.3(GALT): c.290A > G (p.Asn97Ser) | 2592 | GALT | ['TACGATAGCACCTTCCTGTTTGACARCGAC TTCCCAGCTCTGCAGCCTGAT'] |
| 4124 | NM_000155.3(GALT): c.308A > G (p.Gln103Arg) | 2592 | GALT | ['TTTGACAACGACTTCCCAGCTCTGCRGCCT GATGCCCCAGTCCAGGTAAC'] |
| 4125 | NM_000155.3(GALT): c.379A > G (p.Lys127Glu) | 2592 | GALT | ['ATCTTTTCTCCCGTCACCACCCAGTRAGGT CATGTGCTTCCACCCCTGGTC'] |
| 4126 | NM_000155.3(GALT): c.424A > G (p.Met142Val) | 2592 | GALT | ['CTGGTCGGATGTAACGCTGCCACTCRTGTC GGTCCCTGAGATCCGGGCTGT'] |
| 4127 | NM_000155.3(GALT): c.565 - 2A > G | 2592 | GALT | ['TTCTTCTCTGCTTTTGCCCCTTGACRGGTAT GGGCCAGCAGTTTCCTGCCA'] |
| 4128 | NM_000155.3(GALT): c.574A > G (p.Ser192Gly) | 2592 | GALT | ['TTTTGCCCCTTGACAGGTATGGGCCRGCAG TTTCCTGCCAGATATTGCCCA'] |
| 4129 | NM_000155.3(GALT): c.626A > G (p.Tyr209Cys) | 2592 | GALT | ['CGTGAGGAGCGATCTCAGCAGGCCTVTAA GAGTCAGCATGGAGAGCCCCTG'] |
| 4130 | NM_000155.3(GALT): c.752A > G (p.Tyr251Cys) | 2592 | GALT | ['GTCCCCTTCTGGGCAACATGGCCCTVCCAG ACACTGCTGCTGCCCGTCGGC'] |
| 4131 | NM_000155.3(GALT): c.812A > G (p.Glu271Gly) | 2592 | GALT | ['CGGCTACCTGAGCTGACCCCTGCTGRGCGT GATGGTCAGTCTCCCAAGTAG'] |
| 4132 | NM_000155.3(GALT): c.821 - 2A > G | 2592 | GALT | ['AGGCTGAGAGTCAGGCTCTGATTCCRGAT CTAGCCTCCATCATGAAGAAGC'] |
| 4133 | NM_000155.3(GALT): c.854A > G (p.Lys285Arg) | 2592 | GALT | ['TCCATCATGAAGAAGCTCTTGACCARGTAT GACAACCTCTTTGAGACGTCC'] |
| 4134 | NM_000155.3(GALT): c.968A > G (p.Tyr323Cys) | 2592 | GALT | ['CATTGGCAGCTGCACGCTCATTACTRCCCT CCGCTCCTGCGCTCTGCCACT'] |
| 4135 | NM_000155.3(GALT): c.1001A > G (p.Lys334Arg) | 2592 | GALT | ['CTCCTGCGCTCTGCCACTGTCCGGARATTC ATGGTTGGCTACGAAATGCTT'] |
| 4136 | NM_000155.3(GALT): c.1048A > G (p.Thr350Ala) | 2592 | GALT | ['GCTTGCTCAGGCTCAGAGGGACCTCRCCCC TGAGCAGGTCAGGACTCAGAA'] |
| 4137 | NM_000155.3(GALT): c.1132A > G (p.Ile378Val) | 2592 | GALT | ['GCAGAAGGACAGGGAGACAGCAACCRTCG CCTGACCACGCCGACCACAGGG'] |
| 4138 | NM_000553.4(WRN): c.403A > G (p.Lys135Glu) | 7486 | WRN | ['GTTGCTTGAAAATAAAGCAGTTAAARAGG CAGGTGTAGGAATTGAAGGAGA'] |
| 4139 | NM_000433.3(NCF2): c.481A > G (p.Lys161Glu) | 4688 | NCF2 | ['CTTACCCAGACACACTCCATCGCCTYGTCG ATTTTGGAATGTCTGGGCTCA'] |
| 4140 | NM_198056.2(SCN5A): c.1673A > G (p.His558Arg) | 6331 | SCN5A | ['ACAGCGGGGAGAGCGAGAGCCACCRCAC ATCACTGCTGGTGCCCTGGCCC'] |
| 4141 | NM_000074.2(CD40LG): c.386A > G (p.Glu129Gly) | 959 | CD40LG | ['CAAATTGCGGCACATGTCATAAGTGRGGC CAGCAGTAAAACAACATCTGGT'] |
| 4142 | NM_002863.4(PYGL): c.1016A > G (p.Asn339Ser) | 5836 | PYGL | ['CCCACCCAGGTGGCCATCCAGCTGARTGA CACTCACCCTGCACTCGCGATC'] |
| 4143 | NM_000142.4(FGFR3): c.1454A > G (p.Gln485Arg) | 2261 | FGFR3 | ['CCCCTTGGGGAGGGCTGCTTCGGCCRGGT GGTCATGGCGGAGGCCATCGGC'] |
| 4144 | NM_001101.3(ACTB): c.34A > G (p.Asn12Asp) | 60 | ACTB | ['TGATATCGCCGCGCTCGTCGTCGACVACG GCTCCGGCATGTGCAAGGCCGG'] |
| 4145 | NM_001202.3(BMP4): c.362A > G (p.His121Arg) | 652 | BMP4 | ['TGGGGGAAGAGACTGACCTTCGTGGYGGA AGCTCCTCACGGTGTTGGCCCG'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4146 | NM_000094.3(COL7A1): c.425A > G (p.Lys142Arg) | 1294 | COL7A1 | ['CAGCTGGCCCGACCTGGTGTCCCCARGGT GATCCCTACCCCTACCATGCCT'] |
|  | NM_001130823.1(DNMT1): c.1532A > G (p.Tyr511Cys) | 1786 | DNMT1 | [] |
| 4147 | NM_000138.4(FBN1): c.5096A > G (p.Tyr1699Cys) | 2200 | FBN1 | ['AGAAGAAGTTTGTGCTACAGAAACTRCTA TGCTGACAACCAGACCTGTGAT'] |
| 4148 | NM_000138.4(FBN1): c.5087A > G (p.Tyr1696Cys) | 2200 | FBN1 | ['CTAGATATGAGAAGAAGTTTGTGCTRCAG AAACTACTATGCTGACAACCAG'] |
| 4149 | NM_000138.4(FBN1): c.5099A > G (p.Tyr1700Cys) | 2200 | FBN1 | ['AGAAGTTTGTGCTACAGAAACTACTRTGCT GACAACCAGACCTGTGATGGA'] |
| 4150 | NM_001244710.1(GFPT1): c.43A > G (p.Thr15Ala) | 2673 | GFPT1 | ['TTACTTAAACTACCATGTTCCTCGARCGAG ACGAGAAATCCTGGAGACCCT'] |
| 4151 | NM_002292.3(LAMB2): c.440A > G (p.His147Arg) | 3913 | LAMB2 | ['CTGGAGGCTGAGTTTCATTTCACACRCCTC ATTATGACCTTCAAGGTGCCT'] |
| 4152 | NM_005211.3(CSF1R): c.1754 - 2A > G | 1436 | CSF1R | ['GACTTAAGGGACCTGTGTGCGTGGCRGGT AAGACCCTCGGAGCTGGAGCCT'] |
| 4153 | NM_005247.2(FGF3): c.146A > G (p.Tyr49Cys) | 2248 | FGF3 | ['GGGGCGCCCCGGCGCCGCAAGCTCTRCTG CGCCACGAAGTACCACCTCCAG'] |
| 4154 | NM_005247.2(FGF3): c.317A > G (p.Tyr106Cys) | 2248 | FGF3 | ['GCCATGAACAAGAGGGGACGACTCRTGC TTCGGTGAGTCCAGGCTGTCAC'] |
| 4155 | NM_005188.3(CBL): c.1112A > G (p.Tyr371Cys) | 867 | CBL | ['TAATCAAAGGAACAATATGAATTATRCTG TGAGATGGGCTCCACATTCCAA'] |
| 4156 | NM_000313.3(PROS1): c.701A > G (p.Tyr234Cys) | 5627 | PROS1 | ['TGTGAATGCCCCGAAGGCTACAGATRTAA TCTCAAATCAAAGTCTTGTGAA'] |
| 4157 | NM_000329.2(RPE65): c.1292A > G (p.Tyr431Cys) | 6121 | RPE65 | ['TACCAGAAGTATTGTGGGAAACCTTRCAC ATATGCGTATGGACTTGGCTTG'] |
| 4158 | NM_001040142.1(SCN2A): c.4419A > G (p.Ile1473Met) | 6326 | SCN2A | ['TGAATCTTTTCATTGGTGTCATCATRGATA ACTTCAACCAACAGAAAAAGA'] |
| 4159 | NM_001040142.1(SCN2A): c.754A > G (p.Met252Val) | 6326 | SCN2A | ['GTCAGTGAAGAAGCTTTCTGATGTCRTGAT CTTGACTGTGTTCTGTCTAAG'] |
| 4160 | NM_004612.3(TGFBR1): c.134A > G (p.Asn45Ser) | 7046 | TGFBR1 | ['TTCTGCCACCTCTGTACAAAAGACARTTTT ACTTGTGTGACAGATGGGCTC'] |
| 4161 | NM_003688.3(CASK): c.2168A > G (p.Tyr723Cys) | 8573 | CASK | ['TTTGATCAATTAGATCTTGTCACATRTGAA GAAGTAGTAAAACTGCCAGCA'] |
| 4162 | NM_015884.3(MBTPS2): c.1523A > G (p.Asn508Ser) | 51360 | MBTPS2 | ['GGTGGCAGTGTACTTTTGGCTGCCARTGTG ACCCTGGGACTCTGGATGGTT'] |
| 4163 | m.10450A > G | 4573 | MT-TR | ['ACGAATGATTTCGACTCATTAAATTRTGAT AATCATATTTACCAAATGCCC'] |
| 4164 | m.5816A > G | 4511 | MT-TC | ['GAATTTGCAATTCAATATGAAAATCRCCTC GGAGCTGGTAAAAAGAGGCCT'] |
| 4165 | m.608A > G | 4558 | MT-TF | ['GTAGCTTACCTCCTCAAAGCAATACRCTGA AAATGTTTAGACGGGCTCACA'] |
| 4166 | NM_172337.2(OTX2): c.674A > G (p.Asn225Ser) | 5015 | OTX2 | ['CTGATTGAGATGGCTGGTGACTGCAYTGG TACCCATGGGACTGAGTGTGGC'] |
| 4167 | NM_001376.4(DYNC1H1): c.917A > G (p.His306Arg) | 1778 | DYNC1H1 | ['CTCCTGACTCTGGATATCTTGAAACRTGGC AAGCGCTTCCATGCCACCGTC'] |
| 4168 | NM_001376.4(DYNC1H1): c.2011A > G (p.Lys671Glu) | 1778 | DYNC1H1 | ['GAAGCGGGTGGAAGATGTCCTTGGCRAGG GCTGGGAGAATCACGTGGAGGG'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4169 | NM_001376.4(DYNC1H1): c.2909A > G (p.Tyr970Cys) | 1778 | DYNC1H1 | ['CTAAGAATAACCAATCAGGTAATCTRCTTG AATCCACCAATTGAAGAGTGC'] |
| 4170 | NM_004380.2(CREBBP): c.2728A > G (p.Thr910Ala) | 1387 | CREBBP | ['ACTGTAGGGGTGCTCTGGGTTTGGGHAGC ACTGGGCACTGAGCCAGGAGTC'] |
| 4171 | NM_000459.4(TEK): c.2690A > G (p.Tyr897Cys) | 7010 | TEK | ['ATGCTCTCTTCCTTCCCTCCAGGCTVCTTGT ACCTGGCCATTGAGTACGCG] |
| 4172 | NM_001354.5(AKR1C2): c.235A > G (p.Ile79Val) | 1646 | AKR1C2 | ['AGATGGCAGTGTGAAGAGAGAAGACRTAT TCTACACTTCAAAGGTACTGTG'] |
| 4173 | NM_007315.3(STAT1): c.604A > G (p.Met202Val) | 6772 | STAT1 | ['ACAAGAACAGCTGTTACTCAAGAAGRTGT ATTTAATGCTTGACAATAAGAG'] |
| 4174 | NM_007315.3(STAT1): c.494A > G (p.Asp165Gly) | 6772 | STAT1 | ['GAGCATGAAATCAAGAGCCTGGAAGRTTT ACAAGATGAATATGACTTCAAA'] |
| 4175 | NM_007315.3(STAT1): c.862A > G (p.Thr288Ala) | 6772 | STAT1 | ['GTTGGAGGAATTGGAACAGAAATACRCCT ACGAACATGACCCTATCACAAA'] |
| 4176 | NM_002052.4(GATA4): c.928A > G (p.Met310Val) | 2626 | GATA4 | ['CCTCCAGGTCCCCAGGCCTCTTGCARTGCG GAAAGAGGGGATCCAAACCAG'] |
| 4177 | NM_014191.3(SCN8A): c.5302A > G (p.Asn1768Asp) | 6334 | SCN8A | ['CATGTACATTGCCATCATCCTGGAGRACTT CAGTGTAGCCACAGAGGAAAG'] |
| 4178 | NM_000209.3(PDX1): c.533A > G (p.Glu178Gly) | 3651 | PDX1 | ['TACATCTCACGGCCGCGCCGGGTGGRGCT GGCTGTCATGTTGAACTTGACC'] |
| 4179 | NM_000890.3(KCNJ5): c.472A > G (p.Thr158Ala) | 3762 | KCNJ5 | ['CATTGGGTATGGCTTCCGAGTCATCRCAGA GAAGTGTCCAGAGGGGATTAT'] |
| 4180 | NM_000256.3(MYBPC3): c.2234A > G (p.Asp745Gly) | 4607 | MYBPC3 | ['ACGGTCGAGGGGGCAGAGAAGGAAGRTG AGGGCGTCTACACGGTCACAGTG'] |
| 4181 | NM_005359.5(SMAD4): c.1498A > G (p.Ile500Val) | 4089 | SMAD4 | ['TGTTGATGACCTTCGTCGCTTATGCRTACT CAGGATGAGTTTTGTGAAAGG'] |
| 4182 | NM_005359.5(SMAD4): c.1500A > G (p.Ile500Met) | 4089 | SMAD4 | ['TTGATGACCTTCGTCGCTTATGCATRCTCA GGATGAGTTTTGTGAAAGGCT'] |
| 4183 | NM_001184.3(ATR): c.6431A > G (p.Gln2144Arg) | 545 | ATR | ['TATCAATTTTTGACTGCTTTTTCACRATTGA TCTCTCGAATTTGTCATTCT'] |
| 4184 | NM_153427.2(PITX2): c.262A > G (p.Lys88Glu) | 5308 | PITX2 | ['CCCCAACCGCCCCCAGGTTTGGTTCRAGAA TCGTCGGGCCAAATGGAGAAA'] |
| 4185 | NM_005257.5(GATA6): c.1354A > G (p.Thr452Ala) | 2627 | GATA6 | ['CTGTGCCAACTGTCACACCACAACTRCCAC CTTATGGCGCAGAAACGCCGA'] |
| 4186 | NM_005257.5(GATA6): c.1396A > G (p.Asn466Asp) | 2627 | GATA6 | ['AAACGCCGAGGGTGAACCCGTGTGCVATG CTTGTGGACTCTACATGAAACT'] |
| 4187 | NM_000414.3(HSD17B4): c.650A > G (p.Tyr217Cys) | 3295 | HSD17B4 | ['CTTGTGGAAGCCCTGAAGCCAGAGTRTGT GGCACCTCTTGTCCTTTGGCTT'] |
| 4188 | NM_004153.3(ORC1): c.380A > G (p.Glu127Gly) | 4998 | ORC1 | ['GCCTGTGACAGCAACATTAATGCGGRGAC CATCATTGGCCTTGTTCGGGTA'] |
| 4189 | NM_002552.4(ORC4): c.521A > G (p.Tyr174Cys) | 5000 | ORC4 | ['CATCATAAAAACCAAACACTTCTCTRTAAT CTTTTTGACATTTCTCAGTCT'] |
| 4190 | NM_004656.3(BAP1): c.2057 − 2A > G | 8314 | BAP1 | ['GCTCCACTAGGTTGGCCAGCATGCCYGCG AAGAGGTAGAGACCCTTGAGCA'] |
| 4191 | NM_004656.3(BAP1): c.438 − 2A > G | 8314 | BAP1 | ['TCAGGGAGGTGGCGTGGCTCGGGCCYGGG GAAAAACAGAGTCAGGGCCCAA'] |
| | NM_003590.4(CUL3): c.1238A > G (p.Asp413Gly) | 8452 | CUL3 | [] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4192 | NM_004813.2(PEX16): c.992A > G (p.Tyr331Cys) | 9409 | PEX16 | ['TACTTGCCCACCTGGCAGAAAATCTRCTTC TACAGTTGGGGCTGACAGACC'] |
| 4193 | NM_004544.3(NDUFA10): c.1A > G (p.Met1Val) | 4705 | NDUFA10 | ['TTGATCCTGAGCTGACCGGGTAGCCRTGGC CTTGCGGCTCCTGAAGCTGGC'] |
| 4194 | NM_004544.3(NDUFA10): c.425A > G (p.Gln142Arg) | 4705 | NDUFA10 | ['TGGTTGTACAGCAGTCGCCTGCTGCRGTAC TCAGATGCCTTGGAGCACTTG'] |
| 4195 | NM_006796.2(AFG3L2): c.1996A > G (p.Met666Val) | 10939 | AFG3L2 | ['TATTTTTCAGATTGTTCAGTTTGGCDTGAA TGAAAAGGTTGGGCAAATCTC'] |
| 4196 | NM_006796.2(AFG3L2): c.1847A > G (p.Tyr616Cys) | 10939 | AFG3L2 | ['TATTTACCAAAAGAACAATACCTCRTACC AAAGAGCAGCTCTTGGATAGG'] |
| 4197 | NM_001199397.1(NEK): c.869 − 2A > G | 4750 | NEK1 | ['CAAAATTCTTTGTATCTTTTCATCTRGCTA AAAGACCAGCTTCAGGACAAA'] |
| 4198 | NM_006587.3(CORIN): c.949A > G (p.Lys317Glu) | 10699 | CORIN | ['GAATCTGTTTCACTGTCACACAGGCRAGTG CCTTAATTACAGCCTTGTGTG'] |
| 4199 | NM_006587.3(CORIN): c.1414A > G (p.Ser472Gly) | 10699 | CORIN | ['CATGAATTTGCCCTACAACAGTACARGTTA TCCAAATTATTTTGGCCACAG'] |
| 4200 | NM_015560.2(OPA1): c.1294A > G (p.Ile432Val) | 4976 | OPA1 | ['AGCTTACATGCAGAATCCTAATGCCRTCAT ACTGTGTATTCAAGGTAAATC'] |
| 4201 | NM_021625.4(TRPV4): c.1805A > G (p.Tyr602Cys) | 59341 | TRPV4 | ['CGTGGGCTGAAGCTGACGGGGACCRTAG CATCATGATCCAGAAGGTACGG'] |
| 4202 | NM_021625.4(TRPV4): c.590A > G (p.Lys197Arg) | 59341 | TRPV4 | ['TCTACGGGAAGACCTGCCTGCCCARGGC CTTGCTGAACCTGAGCAATGGC'] |
| 4203 | NM_021625.4(TRPV4): c.826A > G (p.Lys276Glu) | 59341 | TRPV4 | ['GGCCCGTGGGCGCTTCTTCCAGCCCRAGG ATGAGGGGGGCTACTTCTACTT'] |
| 4204 | NM_024022.2(TMPRSS3): c.308A > G (p.Asp103Gly) | 64699 | TMPRSS3 | ['GTCTCGGATTGCAAAGACGGGGAGGRCGA GTACCGCTGTGGTAAGGTCATG'] |
| 4205 | NM_016599.4(MYOZ2): c.738A > G (p.Ile246Met) NM_017415.2(KLHL3): c.1670A > G (p.Tyr557Cys) | 51778 26249 | MYOZ2 KLHL3 | ['GATGGATATCTGAGAATATTCCTATRGTGA TAACAACCGAACCTACAGATG'] [] |
| 4206 | NM_019109.4(ALG1): c.1129A > G (p.Met377Val) | 56052 | ALG1 | ['GTCCTCCAGTGGCCTGGACCTGCCCRTGAA GGTGGTGGACATGTTCGGGTG'] |
| 4207 | NM_031885.3(BBS2): c.472 − 2A > G | 583 | BBS2 | ['GCTAATGGTTTGGGGTTTTATTTTCRGGTT ACTGGAGACAATGTTAATTCC'] |
| 4208 | NM_006886.3(ATP5E): c.35A > G (p.Tyr12Cys) | −1 | — | ['TACCTTCTCTCATTTTCTCCCAGCTRCATCC GATACTCCCAGATCTGTGCA'] |
| 4209 | NM_022445.3(TPK1): c.656A > G (p.Asn219Ser) | 27010 | TPK1 | ['CACAACACCAGACCCGTCGTAGGTAYTGG AAGTACTGACCAATGTTCCAAA'] |
| 4210 | NM_000017.3(ACADS): c.1031A > G (p.Glu344Gly) | 35 | ACADS | ['CTCTGACTGTACCCCCATGTTTAGGRGGCA GCCATGGCCAAGCTGGCCGCC'] |
| 4211 | NM_016013.3(NDUFAF1): c.758A > G (p.Lys253Arg) | 51103 | NDUFAF1 | ['GGGGGACCCTACTGGCAGGAGGTCARGGT AACAGCATAAATCTTCATTGTT'] |
| 4212 | NM_032580.3(HES7): c.172A > G (p.Ile58Val) | 84667 | HES7 | ['GAACCCGAAGCTGGAGAAAGCGGAGRTAT TGGAGTTCGCCGTGGGCTACTT'] |
| 4213 | NM_024887.3(DHDDS): c.124A > G (p.Lys42Glu) | 79947 | DHDDS | ['GGACGGGAACCGTCGCTATGCCAAGRAGT GCCAGGTGGAGCGGCAGGAAGG'] |
| 4214 | NM_024700.3(SNEP1): c.1097A > G (p.Glu366Gly) | 79753 | SNIP1 | ['CTCAAATTTGGATTCAGTAGCAGAGRATA CGTCTTGCTCCATGAGTCGTCG'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4215 | NM_206933.2(USH2A): c.7595 - 2144A > G | 7399 | USH2A | ['AATTGAACACCTCTCCTTTCCCAAGRTAAG AGATCATCTTTAAGAAAAGGC'] |
| 4216 | NM_016952.4(CDON): c.2368A > G (p.Thr790Ala) | 50937 | CDON | ['GTTTTTGTTTTCCCTCAAAGGTTCARCATA CAAATTTAGGGTCATTGCCAT'] |
| 4217 | NM_020435.3(GJC2): c.-167A > G | 57165 | GJC2 | ['AGACCCTGAGGCCGAGGGGGGAACARTGG GGCCCTTGAGGGCCCCTCCTCC'] |
| 4218 | NM_024549.5(TCTN1): c.221 - 2A > G | 79600 | TCTN1 | ['TGGATCCTACCCCTCTTTTTTCTGCRGTTGC TGTTCTCTGTGTCTGTGACT'] |
| 4219 | NM_031427.3(DNAL1): c.449A > G (p.Asn150Ser) | 83544 | DNAL1 | ['CTCGAAGACCTGGTGTTTGTAGGCARTCCC TTGGAAGAGAAACATTCTGCT'] |
| 4220 | NM_145046.4(CALR3): c.245A > G (p.Lys82Arg) | 125972 | CALR3 | ['AGTTTTCCCTTTATTGCTGAACGGTYTGAA GCGTGCAGAGATGGCATAGAA'] |
| 4221 | NM_020320.3(RARS2): c.1024A > G (p.Met342Val) | 57038 | RARS2 | ['AATGGACAAGTATAATTTTGATACARTGAT ATATGTGGTAAGTAATCAGAA'] |
| 4222 | NM_020320.3(RARS2): c.35A > G (p.Gln12Arg) | 57038 | RARS2 | ['CTCTGCGCGCTCCGGGATCCATACCYGGC AAGCAATAGCGCGGCGAAAGCC'] |
| 4223 | NM_001017361.2(KHDC3L): c.1A > G (p.Met1Val) | 154288 | KHDC3L | ['TGTCTCCTGCAGGACCGGCCGCAGCRTGG ACGCTCCCAGGCGGTTTCCGAC'] |
| 4224 | NM_024753.4(TTC21B): c.2758 - 2A > G | 79809 | TTC21B | ['TAATCGTGCCAGTTCCAACATAATCYGTAG AGCAAAGGGCTAGATTCATCA'] |
| 4225 | NM_001145901.1(SARS2): c.1175A > G (p.Asp392Gly) | 54938 | SARS2 | ['TTCGTCCTTGACCGCAGGGTCCTGGRTATG CCCACCCAAGAACTGGGCCTC'] |
| 4226 | NM_000552.3(VWF): c.3437A > G (p.Tyr1146Cys) | 7450 | VWF | ['AACGGGTATGAGTGTGAGTGGCGCTRTAA CAGCTGTGCACCTGCCTGTCAA'] |
| 4227 | NM_014985.3(CEP152): c.2000A > G (p.Lys667Arg) | 22995 | CEP152 | ['ACCTTACCTATCCACAGCTTCTTGTYTGTC ATGGTCAAAATCTTGTACCAT'] |
| 4228 | NM_024809.4(TCTN2): c.1506 - 2A > G | 79867 | TCTN2 | ['GCTGAGAAATGTCTTACTCTCTTGCRGGGA GAATGCTGTTGAAAGACTTGA'] |
| 4229 | NM_198994.2(TGM6): c.980A > G (p.Asp327Gly) | 343641 | TGM6 | ['CGGACCCTGGAGGACCTGACAGAAGRCAG CATGTGGTGGGTCCTGCCCCCA'] |
| 4230 | NM_052873.2(IFT43): c.1A > G (p.Met1Val) | 112752 | IFT43 | ['GAAGTGACGTCAGGCGGCCGCGGAGRTGG AGGGATTTGCTCGACTTGGACGA'] |
| 4231 | NM_201269.2(ZNF644): c.2014A > G (p.Ser672Gly) | 84146 | ZNF644 | ['AACATTTGGATCAACCTCACAATCARGTA GTTTTTCAAAAATTCATAAGCG'] |
| 4232 | NM_201269.2(ZNF644): c.1759A > G (p.Ile587Val) | 84146 | ZNF644 | ['GTAGTAAAAGGACACATCTTACATAYGTA GGTAGCTGATTTTTTGGATGAT'] |
| 4233 | NM_018699.3(PRDM5): c.320A > G (p.Tyr107Cys) | 11107 | PRDM5 | ['TTTCAGGAAGGAGAAAACATTTTCTRTTTG GCAGTTGAAGATATAGAAACA'] |
| 4234 | NM_001198799.2(ASCC1): c.953A > G (p.Asn318Ser) | 51008 | ASCC1 | ['CTATAGTTCTCTGGGGACTTACCAYTGGG GTCTTTCCTGAATAGTGTATT'] |
| 4235 | NM_007055.3(POLR3A): c.2554A > G (p.Met852Val) | 11128 | POLR3A | ['ACCAACTGAGTTTTTCTTCCACACARTGGC CGGCCGGGAAGGTCTAGTCGA'] |
| 4236 | NM_001256047.1(C19orf12): c.391A > G (p.Lys131Glu) | 83636 | C19orf12 | ['TACTGGATCTCGGCCCGCAGCTCCTYGGTG ACGTAGTTCACCAGCATGGCC'] |
| 4237 | NM_016464.4(TMEM138): c.287A > G (p.His96Arg) | 51524 | TMEM138 | ['TACTTTGCCCTCAGCATCTCCCTTCRTGTCT GGGTCATGGTAAGAGTGGCA'] |
| 4238 | NM_016464.4(TMEM138): c.389A > G (p.Tyr130Cys) | 51524 | TMEM138 | ['TTCCTCCCCACAGCAGCAGTGTTGTRCTGC TACTTCTATAAACGGACAGCC'] |

TABLE 7-continued

Diseases/disorders containging A to G Changes. The table includes human gene
mutations that may be corrected by changing a guanine (G) to adenine (A). The gene name,
gene symbol, and Gene ID are indicated.

| SEQ ID NO: | Name | Gene ID | Gene Symbol | Flanks |
|---|---|---|---|---|
| 4239 | NM_177965.3(C8orf37): c.545A > G (p.Gln182Arg) | 157657 | C8orf37 | ['AAAGGAACACGGGCATATGCCTGCCRGTG TAGCTGGAGAACTATTGAAGAA'] |
| 4240 | NM_001004334.3(GPR179): c.659A > G (p.Tyr220Cys) | 440435 | GPR179 | ['CCCAAGTGGCCGCAGGCAGATGGATRTGT GGGGGACACGCAGCAGGTGAGG'] |
| 4241 | NM_004963.3(GUCY2C): c.1160A > G (p.Asp387Gly) | 2984 | GUCY2C | ['AGCAGTGAGACATACTTTCTTGGTGYCCAC AGAGGTATACAGAAGCACCAT'] |
| 4242 | NM_024110.4(CARD14): c.425A > G (p.Glu142Gly) | 79092 | CARD14 | ['AGCCTGCAGGAGGAGCTGAACCAGGRAAA GGGGCAGAAGGAGGTGCTGCTG'] |
| 4243 | NM_018105.2(THAP1): c.70A > G (p.Lys24Glu) | 55145 | THAP1 | ['CAAGGACAAGCCCGTTTCTTTCCACRAGTG AGGACCCTGCGCGCCTCGCGG'] |
| 4244 | NM_000933.3(PLCB4): c.1868A > G (p.Tyr623Cys) | 5332 | PLCB4 | ['AACAAACGGCAAATGAGTCGCATTTRCCC CAAGGGAGGCCGAGTCGATTCC'] |
| 4245 | NM_001172646.1(PLCB4): c.986A > G (p.Asn329Ser) | 5332 | PLCB4 | ['CACTACTTCATCAGTTCTTCCCATAVCACT TATCTCACTGGCAGACAGTTC'] |
| 4246 | NM_005850.4(SF3B4): c.1A > G (p.Met1Val) | 10262 | SF3B4 | ['GGGAGACGGCGGGATCTCTTTCGCCRTGG CTGCCGGGCCGATCTCCGAGCG'] |
| 4247 | NM_014714.3(IFT140): c.932A > G (p.Tyr311Cys) | 9742 | IFT140 | ['TGGGACATAGAACGAGGAGAGAATTRTAT ACTGAGTCCAGATGAGAAGTTT'] |
| 4248 | NM_000258.2(MYL3): c.517A > G (p.Met173Val) | 4634 | MYL3 | ['GACAGAAGACGAAGTGGAGAAGTTGRTGG CTGGGCAAGAGGACTCCAATGG'] |
| 4249 | NM_032578.3(MYPN): c.59A > G (p.Tyr20Cys) | 84665 | MYPN | ['ATATCTCAGCTTCTAAGAGAGAGCTRTTTA GCTGAAACCAGACATCGGGGA'] |
| 4250 | NM_001018005.1(TPM1): c.742A > G (p.Lys248Glu) | 7168 | TPM1 | ['TGAGTTTGCGGAGAGGTCAGTAACTRAAT TGGAGAAAAGCATTGATGACTT'] |
| 4251 | NM_005006.6(NDUFS1): c.1783A > G (p.Thr595Ala) | 4719 | NDUFS1 | ['AGCTGCTTACACAGAGAAGTCTGCTRCAT ATGTCAACACTGAGGGTAGAGC'] |
| 4252 | NM_033360.3(KRAS): c.439A > G (p.Lys147Glu) | 3845 | KRAS | ['AATTCCTTTTATTGAAACATCAGCARAGAC AAGACAGGTAAGTAACACTGA'] |
| 4253 | NM_014236.3(GNPAT): c.1556A > G (p.Asp519Gly) | 8443 | GNPAT | ['GAAGATGAACTCATCTGCAAAAACAHCAC GTAGGAAGCGAAAGCAACTGTA'] |
| 4254 | NM_017565.3(FAM20A): c.813 - 2A > G | -1 | — | ['GGCACCCGTCGGAAGTCCAGAATCCYGCA AGAGAGGAAGCTCTGTTCCATC'] |
| 4255 | NM_017565.3(FAM20A): c.590 - 2A > G | 54757 | FAM20A | ['AGGCTTTCTCATCTTGACTGTAATCYGCAA AGGAGGAGAAGGGCAATGAGA'] |
| 4256 | NM_017636.3(TRPM4): c.2741A > G (p.Lys914Arg) | 54795 | TRPM4 | ['CTGCTTCACATCTTCACGGTCAACARACAG CTGGGCCCAAGATCGTCATC'] |
| 4257 | NM_000076.2(CDKN1C): c.832A > G (p.Lys278Glu) | 1028 | CDKN1C | ['GCTGTCGCCCGCAGATTTCTTCGCCRAGCG CAAGAGATCAGCGCCTGAGAA'] |
| 4258 | NM_022912.2(REEP1): c.304 - 2A > G | 65055 | REEP1 | ['AGTGTGCCTCTGTTTTTCCTTTGACRGGAA ATCGATGATTGTCTGGTCCAA'] |
| 4259 | NM_000053.3(ATP7B): c.2305A > G (p.Met769Val) | 540 | ATP7B | ['TGTGACATTCTTCGACACGCCCCCCRTGCT CTTTGTGTTCATTGCCCTGGG'] |
| 4260 | NM_000053.3(ATP7B): c.3620A > G (p.His1207Arg) | 540 | ATP7B | ['GTCCACACCCATGCTCTGCAGCGTGYGCA CAGCCAGGGCAGCCTCCTGCTT'] |
| 4261 | NM_000492.3(CFTR): c.3140 - 26A > G | 1080 | CFTR | ['ACATTTGTGTTTATGTTATTTGCARTGTTT TCTATGGAAATATTTCACAG'] |
| 4262 | NM_000570.4(FCGR3B): c.194A > G (p.Asn65Ser) | 2215 | FCGR3B | ['GCTCGAGGCCTGGCTTGAGATGAGGYTCT CATTGTGAAACCACTGTGTGGA'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4263 | NM_198253.2(TERT): c.2705A > G (p.Lys902Arg) | 7015 | TERT | ['TATGGCTGCGTGGTGAACTTGCGGARGAC AGTGGTGAACTTCCCTGTAGAA'] |
| 4264 | NM_005022.3(PFN1): c.350A > G (p.Glu117Gly) | 5216 | PFN1 | ['GTTGATCAAACCACCGTGGACACCTYCTTT GCCCATCAGCAGGACTAGCGC'] |
| 4265 | NM_005349.3(RBPJ): c.188A > G (p.Glu63Gly) | 3516 | RBPJ | ['GTTGCACAGAAGTCATATGGAAATGRAAA AAGGTAAGATTATTTTCTGGT'] |
| 4266 | NM_005349.3(RBPJ): c.505A > G (p.Lys169Glu) | 3516 | RBPJ | ['GATAAAGTCATCTCCAAACCTTCCRAAA AGAAGCAGTCATTGAAAAATGC'] |
| 4267 | NM_022787.3(NMNAT1): c.817A > G (p.Asn273Asp) | 64802 | NMNAT1 | ['GGTCATCCTGGCCCCTTTGCAGAGARACAC TGCAGAAGCTAAGACATAGGA'] |
| 4268 | NM_020921.3(NIN): c.3665A > G (p.Gln1222Arg) | 51199 | NIN | ['CACAGAAACATCAAAAAGTAGGTCCYGTT TCTTTTCAGAAGCTCGATCACA'] |
| 4269 | NM_020921.3(NIN): c.5126A > G (p.Asn1709Ser) | 51199 | NIN | ['AAAATCTCTAGTGTTCTAAGCTACARCGAA AAACTGCTGAAAGAAAAGGAA'] |
| 4270 | NM_005340.6(HINT1): c.152A > G (p.His51Arg) | 3094 | HINT1 | ['GACATTTCCCCTCAAGCACCAACACRTTTT CTGGTGATACCCAAGAAACAT'] |
| 4271 | NM_005050.3(ABCD4): c.956A > G (p.Tyr319Cys) | 5826 | ABCD4 | ['GAGCTGGGTGAAGCAGCTGATGAGGYAGA TGCACACAAAGGCATTCTGGAC'] |
| 4272 | NM_000155.3(GALT): c.950A > G (p.Gln317Arg) | 2592 | GALT | ['GCTGGGGCCAACTGGAACCATTGGCRGCT GCACGCTCATTACTACCCTCCG'] |
| 4273 | NM_007294.3(BRCA1): c.213 - 12A > G | 672 | BRCA1 | ['ACTTGCTGAGTGTGTTTCTCAAACARTTTA ATTTCAGGAGCCTACAAGAAA'] |
| 4274 | NM_007294.3(BRCA1): c.4096 + 3A > G | 672 | BRCA1 | ['GCAAAGCATGGATTCAAACTTAGGTRTTG GAACCAGGTTTTTGTGTTTGCC'] |
| 4275 | NM_007294.3(BRCA1): c.5194 - 2A > G | 72 | BRCA1 | ['TGATGGGTTGTGTTTGGTTTCTTTCVGCAT GATTTTGAAGTCAGAGGAGAT'] |
| 4276 | NM_007294.3(BRCA1): c.5453A > G (p.Asp1818Gly) | 672 | BRCA1 | ['GTGCAGCCAGATGCCTGGACAGAGGRCAA TGGCTTCCATGGTAAGGTGCCT'] |
| 4277 | NM_000059.3(BRCA2): c.1799A > G (p.Tyr600Cys) | 675 | BRCA2 | ['TATGCTATACATGATGAAACATCTTRTAAA GGAAAAAAAATACCGAAAGAC'] |
| 4278 | NM_000059.3(BRCA2): c.476 - 2A > G | 675 | BRCA2 | ['ACAATTTTCCCCTTTTTTTACCCCCRGTGGT ATGTGGGAGTTTGTTTCATA'] |
| 4279 | NM_000059.3(BRCA2): c.8168A > G (p.Asp2723Gly) | 675 | BRCA2 | ['AAAGTGGCCATTATTGAACTTACAGNTGG GTGGTATGCTGTTAAGGCCCAG'] |
| 4280 | NM_000059.3(BRCA2): c.8633 - 2A > G | 675 | BRCA2 | ['GAATTAATAATCCTTTTGTTTTCTTDGAAA ACACAACAAAACCATATTTAC'] |
| 4281 | NM_000060.3(BTD): c.629A > G (p.Tyr210Cys) | 686 | BTD | ['AATAATGGAACCCTTGTTGACCGCTRCCGT AAACACAACCTCTACTTTGAG'] |
| 4282 | NM_000060.3(BTD): c.968A > G (p.His323Arg) | 686 | BTD | ['ACCCCTCTGGAGTCCTTTTGGTACCRTGAC ATGGAAAATCCCAAAGTCAC'] |
| 4283 | NM_000155.3(GALT): c.857A > G (p.Tyr286Cys) | 2592 | GALT | ['ATCATGAAGAAGCTCTTGACCAAGTRTGA CAACCTCTTTGAGACGTCCTTT'] |
| 4284 | NM_000060.3(BTD): c.128A > G (p.His43Arg) | 686 | BTD | ['TGTTACGTGGTTGCCCTGGGAGCCCRCACC GGGGAGGAGAGCGTGGCTGAC'] |
| 4285 | NM_002437.4(MPV17): c.262A > G (p.Lys88Glu) | 4358 | MPV17 | ['CACCACCAAAGTGGATGCACTGAAGRAGA TGTTGTTGGATCAGGTGAGCAG'] |
| 4286 | NM_002769.4(PRSS1): c.65A > G (p.Asp22Gly) | -1 | - | ['GTTGCTGCCCCCTTTGATGATGATGRCAAG ATCGTTGGGGGCTACAACTGT'] |

TABLE 7-continued

Diseases/disorders containging A to G Changes.The table includes human gene mutations that may be corrected by changing a guanine (G) to adenine (A).The gene name, gene symbol, and Gene ID are indicated.

| SEQ ID NO: | Name | Gene ID | Gene Symbol | Flanks |
|---|---|---|---|---|
| 4287 | NM_005211.3(CSF1R): c.2320-2A > G | 1436 | CSF1R | ['GACTAACCCTGCAGTGCTTTCCCTCRGTGC ATCCACCGGGACGTGGCAGCG'] |
| 4288 | NM_024312.4(GNPTAB): c.118-2A > G | 79158 | GNPTAB | ['GAAAACGTTTCTTTTTCTTTGTTCTRGGTG GTTCTGGAATGGAGCCGAGAT'] |
| 4289 | NM_000495.4(COL4A5): c.3107-4A > G | 1287 | COL4A5 | ['AAATATTATATATCACATATTTTCARCAGG GCCTCAGGGTGTGGAAGGGCC'] |
| 4290 | NM_000282.3(PCCA): c.862A > G (p.Arg288Gly) | 5095 | PCCA | ['TGGGAATGCTTTATGGCTTAATGAANGAG AGTGCTCAATTCAGAGAAGAAA'] |
| 4291 | NM_000288.3(PEX7): c.854A > G (p.His285Arg) | 5191 | PEX7 | ['TCTCTTCTTGAAACAGTGGAGCATCRTACA GAGTTTACTTGTGGTTTAGAC'] |
| 4292 | NM_000532.4(PCCB): c.1606A > G (p.Asn536Asp) | 5096 | PCCB | ['ACAACGTCCTTGGAGAAAACATGCARATA TTCCATTGTAAACAAATCAAAG'] |
| 4293 | NM_000553.4(WRN): c.2089-3024A > G | 7486 | WRN | ['TCAAGGAAAAATACATTTAAGATTVTAA GTCTGGTTATAAGCTTAAAAAG'] |
| 4294 | NM_001039958.1(MESP2): c.271A > G (p.Lys91Glu) | 145873 | MESP2 | ['GCGGCAGAGCGCCAGCGAGCGGGAGAA CTGCGCATGCGCACGCTGGCCCG'] |
| 4295 | NM_001099274.1(TINF2): c.850A > G (p.Thr284Ala) | 26277 | TINF2 | ['TAGGGGAGGCCATAAGGAGCGCCCCRCAG TCATGCTGTTTCCCTTTAGGAA'] |
| 4296 | NM_001099274.1(TINF2): c.871A > G (p.Arg291Gly) | 26277 | TINF2 | ['CCCCACAGTCATGCTGTTTCCCTTTRGGAA TCTCGGCTCACCAACCCAGGT'] |
| 4297 | NM_001363.4(DKC1): c.115A > G (p.Lys39Glu) | 1736 | DKC1 | ['ACAACACGCTGAAGAATTTCTTATCRAACC TGAATCCAAAGTTGCTAAGTT'] |
| 4298 | NM_001363.4(DKC1): c.127A > G (p.Lys43Glu) | 1736 | DKC1 | ['AGAATTTCTTATCAAACCTGAATCCRAAGT TGCTAAGTTGGACACGTCTCA'] |
| 4299 | NM_001363.4(DKC1): c.196A > G (p.Thr66Ala) | 1736 | DKC1 | ['GAATTTTGATAAGCTGAATGTAAGGRCAA CACACTATACACCTCTTGCATG'] |
| 4300 | NM_001363.4(DKC1): c.941A > G (p.Lys314Arg) | 1736 | DKC1 | ['GTAAATGCCATCTGCTATGGGCCARGATT ATGCTTCCAGGTGTTCTTCGA'] |
| 4301 | NM_004614.4(TK2): c.173A > G (p.Asn58Ser) | 7084 | TK2 | ['GCATGTCGTCTTCCCACTTGCAATAYTGCC CTCGACACAGATCTGGCAAAA'] |
| 4302 | NM_004614.4(TK2): c.278A > G (p.Asn93Ser) | 7084 | TK2 | ['AACCAACAACCCACTCACCAGAGGAYTGT GGCCACGGACATTTCTCCACTT'] |
| 4303 | NM_004614.4(TK2): c.562A > G (p.Thr188Ala) | 7084 | TK2 | ['AGTTTACCTTCGGACCAATCCTGAGRCTTG TTACCAGAGGTTAAAGAAGAG'] |
| 4304 | NM_024312.4(GNPTAB): c.1285-2A > G | 79158 | GNPTAB | ['TTTATTTTCTCTTTGGTTTTATCGTRGGTTT ATTTGACATGGCCTGTGCCA'] |
| 4305 | NM_024312.4(GNPTAB): c.2867A > G (p.His956Arg) | 79158 | GNPTAB | ['TTCACATCGCGGAAAGTCCCTGCTCRCATG CCTCACATGATTGACCGGATT'] |
| 4306 | NM_024312.4(GNPTAB): c.3458A > G (p.Asn1153Ser) | 79158 | GNPTAB | ['AGGAAGTTTGTTTGCCTGAATGACARCATT GACCACAATCATAAAGATGCT'] |
| 4307 | NM_024312.4(GNPTAB): c.2783A > G (p.Lys928Arg) | 79158 | GNPTAB | ['AGCAAAAATACTGGGAGGCAACTAARAGA TACATTTGCAGATTCCCTCAGA'] |
| 4308 | NM_198253.2(TERT): c.2537A > G (p.Tyr846Cys) | 7015 | TERT | ['TCCACGCTGCTCTGCAGCCTGTGCTRCGGC GACATGGAGAACAAGCTGTTT'] |
| 4309 | NM_198578.3(LRRK2): c.3342A > G (p.Leu1114=) | 120892 | LRRK2 | ['TAGAGAAACTGGAGCAGCTTCATTTTRGAA GGGTAAGAAAGAGCTCATTAAA'] |
| 4310 | NM_198578.3(LRRK2): c.5605A > G (p.Met1869Val) | 120892 | LRRK2 | ['TTTGGCTGACCTGCCTAGAAATATTRTGTT GAATAATGATGAGTTGGAATT'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4311 | NM_207352.3(CYP4V2): c.367A > G (p.Met123Val) | 285440 | CYP4V2 | ['TTCAAAGCAAATTGACAAATCCTCTRTGTA CAAGTTTTTAGAACCATGGCT'] |
| 4312 | NM_207352.3(CYP4V2): c.761A > G (p.His254Arg) | 285440 | CYP4V2 | ['CTTATGTTTAAAGAAGGATGGGAACRCAA AAAGAGCCTTCAGATCCTACAT'] |
| 4313 | NR_001566.1(TERC): n.37A > G | 7012 | TERC | ['GGTGGGCCTGGGAGGGGTGGTGGCCDTTT TTTGTCTAACCCTAACTGAGAA'] |
| 4314 | NR_001566.1(TERC): n.48A > G | 7012 | TERC | ['GAGGGGTGGTGGCCATTTTTTGTCTRACCC TAACTGAGAAGGGCGTAGGCG'] |
| 4315 | NM_007171.3(POMT1): c.430A > G (p.Asn144Asp) | 10585 | POMT1 | ['CATGTGTTTCCTCTTTGAAACAGAGRATGC TCTCATCACTCAGTCAAGGCT'] |
| 4316 | NM_003863.3(DPM2): c.68A > G (p.Tyr23Cys) | 8818 | DPM2 | ['GCCGTTAGCCTGATCATCTTCACCTRCTAC ACCGCCTGGGTGATTCTCTTG'] |
| 4317 | NM_000030.2(AGXT): c.1020A > G (p.Ile340Met) | 189 | AGXT | ['GGAGAGACATCGTCAGCTACGTCATRGAC CACTTCGACATTGAGATCATGG'] |
| 4318 | NM_031418.2(ANO3): c.2053A > G (p.Ser685Gly) | 63982 | ANO3 | ['TTATGTTCTATTTCAGTGTCATCCTRGTGG CTGTTTGATAGACCTCTGCCT'] |
| 4319 | NM_183075.2(CYP2U1): c.1139A > G (p.Glu380Gly) | 113612 | CYP2U1 | ['CCTTTTTACATAGAAAAGGTTCATGRAGAA ATTGAAAGAGTCATTGGCGCC'] |
| 4320 | NM_003094.3(SNRPE): c.1A > G (p.Met1Val) | 6635 | SNRPE | ['GGTGTGCTCTTTGTGAAATTCCACCRTGGC GTACCGTGGCCAGGGTCAGAA'] |
| 4321 | NM_000344.3(SMN1): c.389A > G (p.Tyr130Cys) | 6606 | SMN1 | ['ACCTGTGTTGTGGTTTACACTGGATRTGGA AATAGAGAGGAGCAAAATCTG] |
| 4322 | NM_012082.3(ZFPM2): c.2209A > G (p.Lys737Glu) | -1 | — | ['CATGCAGAGAACCATGCGCACACGCRAGC GCAGAAAGATGTATGAGATGTG'] |
| 4323 | NM_006364.2(SEC23A): c.2104A > G (p.Met702Val) | 10484 | SEC23A | ['TGTTCAGTGTCAATGTATCTTGGCAYTGGA AATCTGGAGTGAAGAATTTCC'] |
| 4324 | NM_001139.2(ALOX12B): c.1562A > G (p.Tyr521Cys) | 242 | ALOX12B | ['ACCCTCCACGGCTGCGTCACTCGGGYAAT AATAGGTGATGATCTCCGTCAC'] |
| 4325 | NM_001004434.2(SLC30A2): c.161A > G (p.His54Arg) | 7780 | SLC30A2 | ['GTGACTGTCAGGACCCTTCTGAGCAYGGC AGTGATGGTTGCTCTGGGCAGC'] |
| 4326 | NM_001168272.1(ITPR1): c.1759A > G (p.Asn587Asp) | 3708 | ITPR1 | ['CACTATCACTGCCCTGCTCCACAATRATCG GAAACTCCTGGAAAAACACAT'] |
| 4327 | m.15923A > G | -1 | — | ['ATAAACTAATACACCAGTCTTGTAARCCG GAGATGAAAACCTTTTTCCAAG'] |
| 4328 | NM_007332.2(TRPA1): c.2564A > G (p.Asn855Ser) | -1 | — | ['TTTTTTTACTTTTCTAGATTTGAAARTTGTG GAATTTTTATTGTTATGTTG'] |
| 4329 | NM_014254.2(TMEM5): c.1016A > G (p.Tyr339Cys) | 10329 | TMEM5 | ['CCGGTCGGAGTAAACACAGAATGCTRTCG AATCTATGAGGCTTGCTCCTAT'] |
| 4330 | NM_144577.3(CCDC114): c.487 - 2A > G | 93233 | CCDC114 | ['ACTGATTTTTTCTCCTCCCCCCACRGGAG ATCCACCACCTGCATCACCTG'] |
| 4331 | NM_000834.3(GRIN2B): c.2172 - 2A > G | 2904 | GRIN2B | ['GGATTTGTTTGCTTTTTTCCTGTACRGGAA ACTGGATGCCTTCATCTATGA'] |
| 4332 | NM_018486.2(HDAC8): c.539A > G (p.His180Arg) | 55869 | HDAC8 | ['ATTCTCTACGTGGATTTGGATCTGCRCCAT GGAGATGGTAAGCCCTTTGGT'] |
| 4333 | NM_018486.2(HDAC8): c.1001A > G (p.His334Arg) | 55869 | HDAC8 | ['ACACTATCCTCTGAGATCCCAGATCRTGAG GTAAGTAAGGCTCTGACAAGT'] |
| 4334 | NM_178012.4(TUBB2B): c.767A > G (p.Asn256Ser) | 347733 | TUBB2B | ['GCAGACCTGCGCAAGCTGGCGGTGARCAT GGTGCCCTTCCCTCGCCTGCAC'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4335 | NM_006888.4(CALM1): c.293A > G (p.Asn98Ser) | 801 | CALM1 | ['ATTGCTGAATGTTCACAGGATGGCARTGGT TATATCAGTGCAGCAGAACTA'] |
| 4336 | NM_172107.2(KCNQ2): c.1636A > G (p.Met546Val) | 3785 | KCNQ2 | ['GCCCCACCCACCCCCCTGCAGTGTCRTGCG GTTCCTGGTGTCCAAGCGGAA'] |
| 4337 | NM_001866.2(COX7B): c.41 − 2A > G | 1349 | COX7B | ['TGTATTCTTTTTCGTTTTCCTGTARGTTCG AAGCATTCAGCAAACAATGG'] |
| 4338 | NM_001099922.2(ALG13): c.339A > G (p.Ala113=) | 79868 | ALG13 | ['TGAACAATCATCAGCTGGAACTGGCRAAG CAGCTACACAAGAGGGTCATC'] |
| 4339 | NM_001083614.1(EARS2): c.502A > G (p.Arg168Gly) | 124454 | EARS2 | ['CCCCATCAGGTATGACAATCGGTGCRGGA ACATGAGCCAGGAGCAGGTGGC'] |
| 4340 | NM_001083614.1(EARS2): c.193A > G (p.Lys65Glu) | 124454 | EARS2 | ['TGCCTTGTACAACTACATCTTTGCTRAGAA GTACCAGGGGAGCTTCATCCT'] |
| 4341 | NM_033109.4(PNPT1): c.1160A > G (p.Gln387Arg) | 87178 | PNPT1 | ['ACCCTTCATGGATCAGCATTATTTCRAAGA GGACAAACACAGGTAATTTAT'] |
| 4342 | NM_033109.4(PNPT1): c.1424A > G (p.Glu475Gly) | 87178 | PNPT1 | ['CCTTTCACCATAAGAGTTACATCTGRAGTC CTAGAGTCAAATGGTATGGTA'] |
| 4343 | NM_000390.2(CHM): c.1520A > G (p.His507Arg) | 1121 | CHM | ['ATTTTTTTTTAACAGATTTGGTTCRTTTGA CTTGCACATCTTCTAAAACA'] |
| 4344 | NM_181690.2(AKT3): c.686A > G (p.Asn229Ser) | 10000 | AKT3 | ['TTGTGTTTTGTGATGGAATATGTTARTGGG GGCGAGGTGAGTCAAGAAGTA'] |
| 4345 | NM_006567.3(FARS2): c.431A > G (p.Tyr144Cys) | 10667 | FARS2 | ['CCCAGCAGGAAGAAGGGGGACAACTRTTA CCTGAATCGGACTCACATGCTG'] |
| 4346 | NM_001410.2(MEGF8): c.7099A > G (p.Ser2367 Gly) | 1954 | MEGF8 | ['CAAGTGCCGGGAATCATTTCACGGGRGTC CGCTGGGCGGCCAGCAGTGCTA'] |
| 4347 | NM_003124.4(SPR): c.596 − 2A > G | 6697 | SPR | ['CCTCATCGTCTCCTTTTCATCCTCTRGGTCC TCTGGACACAGACATGCAGC'] |
| 4348 | NM_005609.2(PYGM): c.152A > G (p.Asp51Gly) | 5837 | PYGM | ['GACCGCAATGTGGCCACCCCACGAGRCTA CTACTTTGCTCTGGCCCATACC'] |
| 4349 | NM_004247.3(EFTUD2): c.623 A > G (p.His208Arg) | 9343 | EFTUD2 | ['TTACTTAGTATTTGCTTTTCAGGACRTGTG AATTTCTCTGATGAGGTCACA'] |
| 4350 | NM_001310338.1(MGME1): c.743 A > G (p.Tyr248Cys) | 92667 | MGME1 | ['GCTGTTCAACATGAAACCTTAAACTRTATA GGTCTGCTGGACTGTGTGGCT'] |
| 4351 | NM_001128085.1(ASPA): c.433 − 2A > G | −1 | — | ['AAGAAAGACGTTTTTGATTTTTTTCRGACT TCTCTGGCTCCACTACCCTGC'] |
| 4352 | NM_000108.4(DLD): c.1444A > G (p.Arg482Gly) | 1738 | DLD | ['TGGAGCATCCTGTGAAGATATAGCTRGAG TCTGTCATGCACATCCGGTAAT'] |
| 4353 | NM_007215.3(POLG2): c.1105A > G (p.Arg369Gly) | 11232 | POLG2 | ['ACTAACATTAAGAACAAACAAACCCNTAT TTTTAGTTTCCCAAGTCTATCT'] |
| 4354 | NM_004333.4(BRAF): c.2126A > G (p.Gln709Arg) | 673 | BRAF | ['AGAGATGAGAGACCACTCTTTCCCCRAGT AAGTAAAAGCTTCATGCTATCC'] |
| 4355 | NM_004985.4(KRAS): c.65A > G (p.Gln22Arg) | 3845 | KRAS | ['GTAGGCAAGAGTGCCTTGACGATACDGCT AATTCAGAATCATTTTGTGGAC'] |
| 4356 | NM_004985.4(KRAS): c.458A > G (p.Asp153Gly) | 3845 | KRAS | ['ACTTTTTATGTATTTCAGGGTGTTGDTGAT GCCTTCTATACATTAGTTCGA'] |
| 4357 | NM_002834.3(PTPN11): c.124A > G (p.Thr42Ala) | 5781 | PTPN11 | ['TAGTAAAAGTAACCCTGGAGACTTCRCAC TTTCCGTTAGGTAAGTTGGAAT'] |
| 4358 | NM_002834.3(PTPN11): c.172A > G (p.Asn58Asp) | 5781 | PTPN11 | ['AGCTGTCACCCACATCAAGATTCAGNACA CTGGTGATTACTATGACCTGTA'] |

TABLE 7-continued

Diseases/disorders containging A to G Changes.The table includes human gene mutations that may be corrected by changing a guanine (G) to adenine (A).The gene name, gene symbol, and Gene ID are indicated.

| SEQ ID NO: | Name | Gene ID | Gene Symbol | Flanks |
|---|---|---|---|---|
| 4359 | NM_002834.3(PTPN11): c.767A > G (p.Gln256Arg) | 5781 | PTPN11 | ['TTTCTTTCTTTCCAGACACTACAACRACAG GAGTGCAAACTTCTCTACAGC'] |
| 4360 | NM_002834.3(PTPN11): c.844A > G (p.Ile282Val) | 5781 | PTPN11 | ['CAAAAACAAAAATAGATATAAAAACRTCC TGCCCTGTAAGTATCAATATTC'] |
| 4361 | NM_002834.3(PTPN11): c.1510A > G (p.Met504Val) | 5781 | PTPN11 | ['GATGGTGCGGTCTCAGAGGTCAGGGRTGG TCCAGACAGAAGCACAGTACCG'] |
| 4362 | NM_002880.3(RAF1): c.524A > G (p.His175Arg) | 5894 | RAF1 | ['ACTTGTGGCTACAAATTTCATGAGCRCTGT AGCACCAAAGTACCTACTATG'] |
| 4363 | NA4_002880.3(RAF1): c.1279A > G (p.Ser427Gly) | 5894 | RAF1 | ['AATTGTGACCCAGTGGTGCGAGGGCRGCA GCCTCTACAAACACCTGCATGT'] |
| 4364 | NM_005633.3(SOS1): c.508A > (p.Lys170Glu) | 6654 | SOS1 | ['TATTAAAGTGGCAATGTGTGCTGACRAGG TAGGAAACTGAGCTTTTCTATT'] |
| 4365 | NM_030662.3(MAP2K2): c.181A > G (p.Lys61Glu) | 5605 | MAP2K2 | ['GCGGCTGGAAGCCTTTCTCACCCAGRAAG CCAAGGTCGGCGAACTCAAAGA'] |
| 4366 | NM_024334.2(TMEM43): c.271A > G (p.Ile91Val) | 79188 | TMEM43 | ['GGAGAATGAAGGAAGGCTGGTGCACRTCA TTGGCGCCTTACGGACATCCAA'] |
| 4367 | NM_000084.4(CLCN5): c.1637A > G (p.Lys546Arg) | 1184 | CLCN5 | ['CTGATGGCTGCAGCCATGACAAGCARGTG GGTGGCAGATGCTCTTGGGCGG'] |
| 4368 | NM_000084.4(CLCN5): c.815A > G (p.Tyr272Cys) | 1184 | CLCN5 | ['CCTTCTTTCTTCTAGGTCAGCTACTRTTTTC CCCTCAAAACATTGTGGCGT'] |
| 4369 | NM_000095.2(COMP): c.1760A > G (p.His587Arg) | 1311 | COMP | ['GGCGTGGACTTCGAGGGCACGTTCCRTGT GAACACGGTCACGGATGACGAC'] |
| 4370 | NM_000530.6(MPZ): c.389A > G (p.Lys130Arg) | 4359 | MPZ | ['AATGGCACGTTCACTTGTGACGTCARAAA CCCTCCAGACATAGTGGGCAAG'] |
| 4371 | NM_000530.6(MPZ): c.347A > G (p.Asn116Ser) | 4359 | MPZ | ['AAGGATGGCTCCATTGTCATACACARCCTA GACTACAGTGACAATGGCACG'] |
| 4372 | NA4_003611.2(OFD1): c.260A > G (p.Tyr87Cys) | 8481 | OFD1 | ['GCAGATCACTTACAAAGATGTGGCTDTGA ATATTCACTTTCTGTTTTCTTT'] |
| 4373 | NA4_003611.2(OFD1): c.290A > G (p.Glu97Gly) | 8481 | OFD1 | ['TATTCACTTTCTGTTTTCTTTCCAGRAAGTG GTTTGGCAAAAGAAAAGGTA'] |
| 4374 | NA4_003611.2(OFD1): c.382 - 2A > G | 8481 | OFD1 | ['TAAAAGTGAAATATTTTCTTTTAACRGGTT TCAGGATCTGATAAAGAAAAT'] |
| 4375 | NM_003977.3(AIP): c.721A > G (p.Lys241Glu) | 9049 | AIP | ['GCTGCTGCTCAACTACTGCCAGTGCDAGCT GGTGGTCGAGGAGTACTACGA'] |
| 4376 | NM_006158.4(NEFL): c.293A > G (p.Asn98Ser) | 4747 | NEFL | ['GAGAAGGCGCAGCTCCAGGACCTCARTGA CCGCTTCGCCAGCTTCATCGAG'] |
| 4377 | NA4_024312.4(GNPTAB): c.3053A > G (p.Asp1018Gly) | 79158 | GNPTAB | ['ATATCTCAAGTCTTTGATGAAGTTGRTACA GATCAATCTGGTGTCTTGTCT'] |
| 4378 | NA4_025137.3(SPG11): c.1457 - 2A > G | 80208 | SPG11 | ['TAAAGCTAACTTTTATTTTTCCTATRGAGA ATGGACTCTCTCTGATTTTGT'] |
| 4379 | NM_025137.3(SPG11): c.2608A > G (p.Ile870Val) | 80208 | SPG11 | ['ACAAGAATCCATCCTTCTCCCCAGGRTAAG TCCAGAAGGCAAGTGTGAGAG'] |
| 4380 | NM_025137.3(SPG11): c.2833A > G (p.Arg945Gly) | 80208 | SPG11 | ['GAATGAAATTTTAGATAAGCTGGCCRGGT ATTATAACTGTTGAACTAAAC'] |
| 4381 | NA4_025137.3(SPG11): c.6477 + 4A > G | 80208 | SPG11 | ['CAGTGAGGAGTATGGGCTGGTGGTARGTA GCCCCCTCAACCCCAGTCTCCA'] |
| 4382 | NM_212472.2(PRKAR1A): c.178 - 2A > G | 5573 | PRKAR1A | ['ATTTTGCAAACTCGTAATTTCTTTCRGGAAT GAGGCAAAACAGATTCAGAAT'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4383 | NM_006231.3(POLE): c.4444 + 3A > G | 5426 | POLE | ['CCAGTTCAGCTACCTGGAACCAGGTRTGG CCTGCACCAGCCGCCCATCATG'] |
| 4384 | NM_003156.3(STEV11): c.251A > G (p.Asp84Gly) | 6786 | STEV11 | ['GACGATGATGCCAATGGTGATGTGGRTGT GGAAGAAAGTGATGAGGTGAGC'] |
| 4385 | NM_003156.3(STEV11): c.326A > G (p.His109Arg) | 6786 | STEV11 | ['CCAACAGTGAAACACAGCACCTTCCRTGG TGAGGATAAGCTCATCAGCGTG'] |
| 4386 | NM_001128425.1(MUTYH): c.934 − 2A > G | 4595 | MUTYH | ['GGCTAAGAGCTGTTCCTGCTCCACCYGAG AGGCACAGGGTTGAGTGTCATA'] |
| 4387 | NM_133499.2(SYN1): c.1699A > G (p.Thr567Ala) | 6853 | SYN1 | ['GGCGGAGCCGGGCCAGAGACGGATGYCTG ACGGGTAGCCTGTGGGGGGCCC'] |
| 4388 | NM_021629.3(GNB4): c.265A > G (p.Lys89Glu) | 59345 | GNB4 | ['TATTTGGGATAGCTATACAACAAATRAGG TAGAATTTCTTCATAATTCTTT'] |
| 4389 | NM_138425.3(C12orf57): c.1A > G (p.Met1Val) | 113246 | C12orf57 | ['CTGAACCTAGAGCTTCAGACGCCCTRTGGC GTCCGCCTCGACCCAACCGGC'] |
| 4390 | NM_000096.3(CP): c.2953A > G (p.Met985Val) | 1356 | CP | ['GGGAGATGAAGTCAACTGGTATCTGRTGG GAATGGGCAATGAAATAGACTT'] |
| 4391 | NM_000057.3(BLM): c.1088 − 2A > G | 641 | BLM | ['AATATTAACAACATAATTATTTTATRGCTA GACAGATAAGTTTACAGCAGC'] |
| 4392 | NM_000257.3(MYH7): c.5807A > G (p.Ter1936Trp) | 4625 | MYH7 | ['TTTCAAAAGGGCTTGAATGAGGAGTRGCT TTGCCACATCTTGATCTGCTCA'] |
| 4393 | NM_152263.3(TPM3): c.505A > G (p.Lys169Glu) | 7170 | TPM3 | ['GGATCTTTTCCTGTAGGTGGCTCGTRAGTT GGTGATCATTGAAGGAGACTT'] |
| 4394 | NM_152263.3(TPM3): c.733A > G (p.Arg245Gly) | 7170 | TPM3 | ['AGAGACCCGTGCTGAGTTTGCTGAGRGAT CGGTAGCCAAGCTGGAAAAGAC'] |
| 4395 | NM_000096.3(CP): c.1209 − 2A > G | 1356 | CP | ['GCATTAAACACTTTTTTCCCCCTGCRGTGA CTCAGCGGTGTTTTTTGAACA'] |
| 4396 | NM_002739.3(PRKCG): c.76A > G (p.Arg26Gly) | 5582 | PRKCG | ['CCTGTTTTGCAGAAAGGGGGCCCTGRGGC AGAAGGTGGTCCACGAAGTCAA'] |
| 4397 | NM_000138.4(FBN1): c.1148 − 2A > G | 2200 | FBN1 | ['GTGTTTTGTTTTGTTGTGTTTTTCTRGAGGA TTTCAACAAGCTGTGCTCTG'] |
| 4398 | NM_000138.4(FBN1): c.3058A > G (p.Thr1020Ala) | 2200 | FBN1 | ['ACCCGGATTTGCCACAAAAGAAATTRCAA ATGGAAAGCCTTTCTTCAAAGG'] |
| 4399 | NM_000169.2(GLA): c.1153A > G (p.Thr385Ala) | −1 | — | ['GGCCTGTAATCCTGCCTGCTTCATCRCACA GCTCCTCCCTGTGAAAGGAA'] |
| 4400 | NM_000256.3(MYBPC3): c.1224 − 2A > G | 4607 | MYBPC3 | ['ACTTCAACGGCCCCTTCTGTTCTACRGCAA GTAAGTTCCCCTCTGGATGGC'] |
| 4401 | NM_000256.3(MYBPC3): c.1814A > G (p.Asp605Gly) | 4607 | MYBPC3 | ['GTCAGCCTCGTCGGCAGGTGTGACGYCGT CAATGGTCAGTTTGTGGACCCT'] |
| 4402 | NM_000256.3(MYBPC3): c.1928 − 2A > G | 4607 | MYBPC3 | ['CTCTGAACTACATTGTGTCTTCTGCRGAAC CTCCCAAGATCCACCTGGACT'] |
| 4403 | NM_000256.3(MYBPC3): c.2309 − 2A > G | 4607 | MYBPC3 | ['GGGCCGCAGGTGCGTCTGGCACGTCBGGA TGGGGTGGGATGGACCCACATC'] |
| 4404 | NM_000256.3(MYBPC3): c.26 − 2A > G | 4607 | MYBPC3 | ['GTGGCTTCTTGCTAAAAGCTGAGACYGAA GGGCCAGGTGGAGGCTACAGCG'] |
| 4405 | NM_000256.3(MYBPC3): c.927 − 2A > G | 4607 | MYBPC3 | ['GGCCACAGCCTAGACTGCGGGACACRGGG ACTCGAAGCTGGAGGCACCAGC'] |
| 4406 | NM_000257.3(MYH7): c.2206A > G (p.Ile736Val) | 4625 | MYH7 | ['AGCGGCCATCCCTGAGGGACAGTTCRTTG ATAGCAGGAAGGGGCAGAGAA'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4407 | NM_000257.3(MYH7): c.2681A > G (p.Glu894Gly) | 4625 | MYH7 | ['CTCCCCTCTGTTCCTCACCTTCAGGDACAA GACAACCTGGCAGATGCTGAG'] |
| 4408 | NM_000260.3(MYO7A): c.1344 - 2A > G | 4647 | MYO7A | ['CCTTACCCCATCCCTGTGCCCCTGCRGCTT TGAGCAGCTCTGCATCAACTT'] |
| 4409 | NM_000260.3(MYO7A): c.6029A > G (p.Asp2010Gly) | 4647 | MYO7A | ['GTGCCAGGGAAGGATCCCATGGCCGRTTC CATCTTCCACTATTACCAGGTG'] |
| 4410 | NM_000260.3(MYO7A): c.6439 - 2A > G | 4647 | MYO7A | ['CTCTCTATGCCCTTTCTGCTCCCCCRGGAT ATCCTCACCACTCATCCCTTC'] |
| 4411 | NM_000441.1(SLC26A4): c.-3 - 2A > G | -1 | — | ['CCCTCCTCGCTGTCCTCTGGCTCGCRGGTC ATGGCAGCGCCAGGCGGCAGG'] |
| 4412 | NM_000441.1(SLC26A4): c.1149 + 3A > G | 5172 | SLC26A4 | ['ATTACACCATCGATGGGAACCAGGTDTGG GTGCCCTTTTGCTGAACTGGTT'] |
| 4413 | NM_000551.3(VHL): c.467A > G (p.Tyr156Cys) | 7428 | VHL | ['GATTTGGTTTTTGCCCTTCCAGTGTRTACTC TGAAAGAGCGATGCCTCCAG] |
| 4414 | NM_002294.2(LAMP2): c.65 - 2A > G | 3920 | LAMP2 | ['AAATATTATTTTTTAAATGAATCCRGGAG CTGTGCGGTCTTATGCATTGG'] |
| 4415 | NM_004004.5(GJB2): c.1A > G (p.Met1Val) | 2706 | GJB2 | ['CAGAGCAAACCGCCCAGAGTAGAAGRTGG ATTGGGGCACGCTGCAGACGAT'] |
| 4416 | NM_004004.5(GJB2): c.617A > G (p.Asn206Ser) | 2706 | GJB2 | ['GTGTCTGGAATTTGCATCCTGCTGARTGTC ACTGAATTGTGTTATTTGCTA'] |
| 4417 | NM_033360.3(KRAS): c.182A > G (p.Gln61Arg) | 3845 | KRAS | ['TTGGATATTCTCGACACAGCAGGTCNAGA GGAGTACAGTGCAATGAGGGAC'] |
| 4418 | NM_006218.2(PIK3CA): c.1637A > G (p.Gln546Arg) | 5290 | PIK3CA | ['GATCCTCTCTCTGAAATCACTGAGCRGGAG AAAGATTTTCTATGGAGTCAC'] |
| 4419 | NM_006218.2(PIK3CA): c.3073A > G (p.Thr1025Ala) | 5290 | PIK3CA | ['TGATGACATTGCATACATTCGAAAGRCCCT AGCCTTAGATAAAACTGAGCA'] |
| 4420 | NM_032119.3(ADGRV1): c.14973 - 2A > G | 84059 | ADGRV1 | ['TTCTTCATGATTTAATTTTTTCCCRGATCA GGTTTCATTGTTGCTGAAAAT'] |
| 4421 | NM_033056.3(PCDH15): c.1998 - 2A > G | 65217 | PCDH15 | ['TTATTTGTTTGTTTGTTTTGTCACTRGCACG GGGATTCTAACCTTAGGGAA'] |
| 4422 | NM_138691.2(TMC1): c.1763 + 3A > G | 117531 | TMC1 | ['ATCTTCAACCAAGGCATGATCTGGTRGGCC AGCTGTTGGACAGCTTATCAC'] |
| 4423 | NM_206933.2(USH2A): c.12067 - 2A > G | 7399 | USH2A | ['CAACTTAACCTGTTAATTTTCTTACRGGGA ACAAGCCATCAAGCCCACCTG'] |
| 4424 | NM_206933.2(USH2A): c.12295 - 2A > G | 7399 | USH2A | ['CCCGTCACTGAAGATGTTGTATGTCYACAG AAGGACAGAAGCAAAAGGGAT'] |
| 4425 | NM_206933.2(USH2A): c.1841 - 2A > G | 7399 | USH2A | ['ATAATGCATAACCTTTCCCTGATGCRGGAA GGAACTGTGAGCTGTGCAAGG'] |
| 4426 | NM_206933.2(USH2A): c.8559 - 2A > G | 7399 | USH2A | ['GATGTTCCTGCTTGTCTTTTGCTTTRGATAT GAGCTTCTGAGACGTAAAAT'] |
| 4427 | NM_03241S.5(CARD11): c.401A > G (p.Glu134Gly) | 84433 | CARD11 | ['GGCCTCACGCACTTCCTGATGAACGRGGTC ATCAAGCTGCAGCAGCAGATG'] |
| 4428 | NM_000548.3(TSC2): c.226 - 2A > G | 7249 | TSC2 | ['CACCGCTGTCCCTCTGCTGGTGACRGCAC GCAGTGGAAGCACTCTGGAAG'] |
| 4429 | NM_000548.3(TSC2): c.1444 - 2A > G | 7249 | TSC2 | ['TCATTGGCTCCCTTGTGCCTGTGCRGGAG GAGCTGATTAACTCAGTGGTC'] |
| 4430 | NM_000548.3(TSC2): c.2546 - 2A > G | 7249 | TSC2 | ['CCCTGACCACCCTCTCCATTACCGCDGCTC TGGCCAGGCTGCCGCACCTCT'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4431 | NM_130466.3(UBE3B): c.545 - 2A > G | 89910 | UBE3B | ['TTTGTTCTCACTGTTTTCTTTCTTTRGGTGA AAGTCTTCGACCAGCGATGA'] |
| 4432 | NM_005430.3(WNT1): c.624 + 4A > G | 7471 | WNT1 | ['CAACAACGAGGCAGGCCGTACGGTGRGCT TTGAGAGGCTCCGCACCCTAAG'] |
| 4433 | NM_001893.4(CSNK1D): c.137A > G (p.His46Arg) | 1453 | CSNK1D | ['AAGCTTGAATGTGTCAAAACCAAACRCCC TCAGCTCCACATTGAGAGCAAA'] |
| 4434 | NM_018972.2(GDAP1): c.368A > G (p.His123Arg) | 54332 | GDAP1 | ['AGCATGTATTACCCACGGGTACAACRTTAC CGAGAGCTGCTTGACTCCTTG'] |
| 4435 | NM_032237.4(POMK): c.773A > G (p.Gln258Arg) | 84197 | POMK | ['CATGGGGATTTCGTGGCTCCAGAGCRACT GTGGCCCTATGGAGAGGACGTG'] |
| 4436 | NM_201647.2(STAMBP): c.125A > G (p.Glu42Gly) | 10617 | STAMBP | ['CGTCGGTACTTCCGCTCTGGAGTTGRGATT ATCCGAATGGCATCCATTTAC'] |
| 4437 | NM_001946.3(DUSP6): c.566A > G (p.Asn189Ser) | 1848 | DUSP6 | ['ACTACCATCCGAGTCTGTTGCACTAYTGGG GTCTCGGTCAAGGTCAGACTC'] |
| 4438 | NM_003867.3(FGF17): c.560A > G (p.Asn187Ser) | 8822 | FGF17 | ['TACCAAGGCCAGCTGCCCTTCCCCARCCAC GCCGAGAAGCAGAAGCAGTTC'] |
| 4439 | NM_013281.3(FLRT3): c.1016A > G (p.Lys339Arg) | -1 | - | ['GGGCTCATGTGCCAAGCCCCAGAAARGGT TCGTGGGATGGCTATTAAGGAT'] |
| 4440 | NM_015560.2(OPA1): c.1146A > G (p.Ile382Met) | 4976 | OPA1 | ['TTTTTATTTTTCCTGAGTAGACCATRTCCTT AAATGTAAAAGGCCCTGGAC'] |
| 4441 | NM_030964.3(SPRY4): c.530A > G (p.Lys177Arg) | 81848 | SPRY4 | ['CCGGCGGTCCCACCCGAGCTGGACARGCA CTTCTTGCTGTGCGAGGCCTGT'] |
| 4442 | NM_002972.3(SBF1): c.1249A > G (p.Met417Val) | 6305 | SBF1 | ['AAGGCCATGCCCTCCAGCACCTTCAYCAG GAAATCGTCCTCTACCAGCCCA'] |
| 4443 | NM_002972.3(SBF1): c.4768A > G (p.Thr1590Ala) | 6305 | SBF1 | ['TACATGTAATTGTGGAACACAGGCGYCCT CTTGCTCAGCCGGTCCACATAC'] |
| 4444 | NM_006876.2(B4GAT1): c.1168A > G (p.Asn390Asp) | 11041 | B4GAT1 | ['GTTCCATCCCCAAAAGGAGGCTGAARATC AGCACAATAAGATCCTATATCG'] |
| 4445 | NM_000059.3(BRCA2): c.517 - 2A > G | 675 | BRCA2 | ['AAAATAAACTATTTTCTTTCCTCCCVGGGT CGTCAGACACCAAAACATATT'] |
| 4446 | NM_000059.3(BRCA2): c.6938 - 2A > G | 675 | BRCA2 | ['ATGTAATATAAAATAATTGTTTCCTRGGCA CAATAAAAGATCGAAGATTGT'] |
| 4447 | NM_000059.3(BRCA2): c.7008 - 2A > G | 675 | BRCA2 | ['AACTTATATATTTTCTCCCCATTGCDGCAC AACTAAGGAACGTCAAGAGAT'] |
| 4448 | NM_000059.3(BRCA2): c.7806 - 2A > G | 675 | BRCA2 | ['GATAATATTCTACTTTTATTTGTTCRGGGC TCTGTGTGACACTCCAGGTGT'] |
| 4449 | NM_000059.3(BRCA2): c.8754 + 4A > G | 675 | BRCA2 | ['AGCAGACCCAGCTTACCTTGAGGTGRGAG AGTAAGAGGACATATAATGAGG'] |
| 4450 | NM_000059.3(BRCA2): c.9118 - 2A > G | 675 | BRCA2 | ['GTTGAATTTTTGTTTTGTTTTCTGTRGGTTT CAGATGAAATTTTATTTCAG'] |
| 4451 | NM_000059.3(BRCA2): c.9649 - 2A > G | 675 | BRCA2 | ['TAGGCTACGTTTTCATTTTTTTATCRGATGT CTTCTCCTAATTGTGAGATA'] |
|  | NM_000218.2(KCNQ1): c.1070A > G (p.Gln357Arg) | 3784 | KCNQ1 | [] |
| 4452 | NM_000218.2(KCNQ1): c.1085A > G (p.Lys362Arg) | 3784 | KCNQ1 | ['AAGGTGCAGCAGAAGCAGAGGCAGARGC ACTTCAACCGGCAGATCCCGGCG] |
| 4453 | NM_000218.2(KCNQ1): c.1576A > G (p.Lys526Glu) | 3784 | KCNQ1 | ['TCGACGCATGCAGTACTTTGTGGCCVAGA AGAAATTCCAGGTAAGCCCTGT'] |
|  | NM_000218.2(KCNQ1): c.1756A > G (p.Asn586Asp) | 3784 | KCNQ1 | [] |

TABLE 7-continued

Diseases/disorders containging A to G Changes. The table includes human gene
mutations that may be corrected by changing a guanine (G) to adenine (A). The gene name,
gene symbol, and Gene ID are indicated.

| SEQ ID NO: | Name | Gene ID | Gene Symbol | Flanks |
|---|---|---|---|---|
| 4454 | NM_000218.2(KCNQ1): c.332A > G (p.Tyr111Cys) | 3784 | KCNQ1 | ['CGCACCCACGTCCAGGGCCGCGTCTRCAA CTTCCTCGAGCGTCCCACCGGC'] |
|  | NM_000218.2(KCNQ1): c.344A > G (p.Glu115Gly) | 3784 | KCNQ1 | [] |
| 4455 | NM_000218.2(KCNQ1): c.773A > G (p.His258Arg) | 3784 | KCNQ1 | ['CTCCTGGGCTCCGTGGTCTTCATCCVCCGC CAGGTGGGTGGCCCGGGTTAG'] |
| 4456 | NM_000218.2(KCNQ1): c.944A > G (p.Tyr315Cys) | 3784 | KCNQ1 | ['CAGGTCACAGTCACCACCATCGGCTNTGG GGACAAGGTGCCCCAGACGTGG'] |
|  | NM_000218.2(KCNQ1): c.964A > G (p.Thr322Ala) | 3784 | KCNQ1 | [] |
| 4457 | NM_000492.3(CFTR): c.1393 - 2A > G | 1080 | CFTR | ['CCTAATAATGATGGGTTTTATTTCCRGACT TCACTTCTAATGGTGATTATG'] |
| 4458 | NM_000492.3(CFTR): c.1766 + 3A > G | 1080 | CFTR | ['ACAGAAAAGAAATATTTGAAAGGTVTGT TCTTTGAATACCTTACTTATAA'] |
| 4459 | NM_000492.3(CFTR): c.1A > G (p.Met1Val) | 1080 | CFTR | ['CAGGGACCCCAGCGCCCGAGAGACCRTGC AGAGGTCGCCTCTGGAAAAGGC'] |
| 4460 | NM_000492.3(CFTR): c.2989 - 2A > G | 1080 | CFTR | ['ACCAACATGTTTTCTTTGATCTTACDGTTG TTATTAATTGTGATTGGAGCT'] |
| 4461 | NM_000492.3(CFTR): c.579 + 3A > G | 1080 | CFTR | ['ACAACCTGAACAAATTTGATGAAGTNTGT ACCTATTGATTAATCTTTTAG'] |
| 4462 | NM_007294.3(BRCA1): c.122A > G (p.His41Arg) | 672 | BRCA1 | ['GAACCTGTCTCCACAAAGTGTGACCRCAT ATTTTGCAAGTAAGTTTGAATG'] |
| 4463 | NM_007294.3(BRCA1): c.1A > G (p.Met1Val) | 672 | BRCA1 | ['TTAAAGTTCATTGGAACAGAAAGAARTGG ATTTATCTGCTCTTCGCGTTGA'] |
| 4464 | NM_007294.3(BRCA1): c.212 + 3A > G | 672 | BRCA1 | ['TGTAAGAATGATATAACCAAAAGGTRTAT AATTTGGTAATGATGCTAGGTT'] |
| 4465 | NM_007294.3(BRCA1): c.4097 - 2A > G | 672 | BRCA1 | ['TCTGAACCTCTGTTTTTGTTATTTAVGGTG AAGCAGCATCTGGGTGTGAGA'] |
| 4466 | NM_007294.3(BRCA1): c.4485 - 2A > G | 672 | BRCA1 | ['GTTTTCTCCTTCCATTTATCTTTCTRGGTCA TCCCCTTCTAAATGCCCATC'] |
| 4467 | NM_007294.3(BRCA1): c.4987 - 2A > G | 672 | BRCA1 | ['ATAATGGAATATTTGATTTAATTTCRGATG CTCGTGTACAAGTTTGCCAGA'] |
| 4468 | NM_007294.3(BRCA1): c.5053A > G (p.Thr1685Ala) | 672 | BRCA1 | ['AACTAATCTAATTACTGAAGAGACTRCTCA TGTTGTTATGAAAACAGGTAT'] |
| 4469 | NM_007294.3(BRCA1): c.5407 - 2A > G | 672 | BRCA1 | ['AATGCTCTTTCCTTCCTGGGGATCCDGGGT GTCCACCCAATTGTGGTTGTG'] |
| 4470 | NM_000540.2(RYR1): c.97A > G (p.Lys33Glu) | 6261 | RYR1 | ['CGCTACCGTGCTCAAGGAGCAGCTCRAGC TCTGCCTGGCCGCCGAGGGCTT'] |
| 4471 | NM_015250.3(BICD2): c.2321A > G (p.Glu774Gly) | 23299 | BICD2 | ['CGGCAGCTGGCGGCTGCTGAGGACGRGAA GAAGACGCTGAACTCGCTGCTG'] |
| 4472 | NM_006012.2(CLPP): c.270 + 4A > G | 8192 | CLPP | ['CATCGTGTGCGTCATGGGCCCGGTGRGCG CCCCGCGCCGGGACCCTCCCCA'] |
| 4473 | NM_004656.3(BAP1): c.277A > G (p.Thr93Ala) | 8314 | BAP1 | ['AGGAGCACGCTCAGCAAGGCATGAGHTGC ACAAGAGTTGGGTATCAGCTGT'] |
| 4474 | NM_004315.4(ASAH1): c.965 + 4A > G | 427 | ASAH1 | ['AGGAATCATTGGATGTATATGAGTARGTA GGTTTGTTAAAGCAAAAGAAGT'] |
| 4475 | NM_000100.3(CSTB): c.169 - 2A > G | 1476 | CSTB | ['GCTTCGCTCACTCCGCTCTCTTCCCRGGTG CACGTCGGCGACGAGGACTTC'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4476 | NM_015268.3(DNAJC13): c.2564A > G (p.Asn855Ser) | 23317 | DNAJC13 | ['TTAAAATCTAGGTATGAATTTTTCARTGAG CTTTATCATCGCTTCTTGCTC'] |
| 4477 | NM_001003722.1(GLE1): c.433 - 10A > G | 2733 | GLE1 | ['CTTAAAAAAAAAAAAAAAAAAAAARCCT TTTCAGGAGGGCCTGAGGCTAT'] |
| 4478 | NM_001142519.1(FAM111A): c.1583A > G (p.Asp528Gly) | 63901 | FAM111A | ['TTCCAGAAAATAGTTCACAACCCTGDTGTG ATTACCTATGACACTGAATTT'] |
| 4479 | NM_001142519.1(FAM111A): c.1012A > G (p.Thr338Ala) | 63901 | FAM111A | ['GCATAGAACAACGTTTGGGAAAGTARCAA AAAATTCTTCTTCGATTAAAGT'] |
| 4480 | NM_001927.3(DES): c.1289 - 2A > G | 1674 | DES | ['CTGAGTGTGCGATGGACCCTGTTACRGAA ACCAGCCCTGAGCAAAGGGGTT'] |
| 4481 | NM_014795.3(ZEB2): c.3134A > G (p.His1045Arg) | 9839 | ZEB2 | ['AAACACAAGCACCACCTTATCGAGCRCTC AAGGCTTCACTCGGGCGAGAAG'] |
| 4482 | NM_002163.2(IRF8): c.322A > G (p.Lys108Glu) | 3394 | IRF8 | ['CCAACTGGACATTTCCGAGCCATACRAAG TTTACCGAATTGTTCCTGAGGA'] |
| 4483 | NM_002163.2(IRF8): c.238A > G (p.Thr80Ala) | 3394 | IRF8 | ['CAAAGCTGAACCAGCCACTTGGAAGRCGA GGTTACGCTGTGCTTTGAATAA'] |
| 4484 | NM_001287.5(CLCN7): c.296A > G (p.Tyr99Cys) | 1186 | CLCN7 | ['TGTCCCGGCCTGCAGAGCTTGGACTRTGAC AACAGTGAGAACCAGCTGTTC'] |
| 4485 | NM_001127217.2(SMAD9): c.127A > G (p.Lys43Glu) | 4093 | SMAD9 | ['AGAGAAGGCAGTGGACTCTCTAGTGRAGA AGTTAAAGAAGAAGAAGGGAGC'] |
| 4486 | NM_002246.2(KCNK3): c.575A > G (p.Tyr192Cys) | 3777 | KCNK3 | ['TGGACCTTCTTCCAGGCCTACTACTRCTGC TTCATCACCCTCACCACCATC'] |
| 4487 | NM_080605.3(B3GALT6): c.1A > G (p.Met1Val) | 126792 | B3GALT6 | ['CGCCACGCCCGCCGCAGCAGCTTCAYGGC GCCCGCGCCGGGCCGGCGCCC'] |
| 4488 | NM_080605.3(B3GALT6): c.193A > G (p.Ser65Gly) | 126792 | B3GALT6 | ['CGGCGCTCGGCGGCGCGGGGCGCGCYGGC CACCAGCACTGCCAGGAAGGCG'] |
| 4489 | NM_000388.3(CASR): c.85A > G (p.Lys29Glu) | 846 | CASR | ['CGGGCCAGACCAGCGAGCCCAAAAGRAGG GGGACATTATCCTTGGGGGGCT'] |
| 4490 | NM_003793.3(CTSF): c.962A > G (p.Gln321Arg) | 8722 | CTSF | ['GGGACCCTGCTCTCCCTCTCTGAACRGGGT GAGCATCTCGCTCTACTCCTC'] |
| 4491 | NM_003793.3(CTSF): c.692A > G (p.Tyr231Cys) | 8722 | CTSF | ['GAGATCACTGAACTTGGTGACTCCAYACT GAGCTGTGCCACGGTCCAGGGC'] |
| 4492 | NM_022114.3(PRDM16): c.2447A > G (p.Asn816Ser) | 63976 | PRDM16 | ['GGCAGCCGGGCCCGTGCCAGCCAAARCGG CGGCGGGCGGGAGCCCCGCAAG'] |
| 4493 | NM_173551.4(ANKS6): c.1322A > G (p.Gln441Arg) | 203286 | ANKS6 | ['GGGCAGCACTGGGATGCTCCAGGGCYGTC GGACCTTCGAGTGGGGCAGGGG'] |
| 4494 | NM_005689.2(ABCB6): c.508A > G (p.Ser170Gly) | 10058 | ABCB6 | ['GAACTTGGCCCTGGTGTCTTGGAACRGCCC ACAGTGGTGGTGGGCAAGGGC'] |
| 4495 | NM_001070.4(TUBG1): c.275A > G (p.Tyr92Cys) | 7283 | TUBG1 | ['AAGCTCTACAACCCAGAGAACATCTRCCT GTCGGAACATGGAGGAGGAGCT'] |
| 4496 | NM_001613.2(ACTA2): c.145A > G (p.Met49Val) | 59 | ACTA2 | ['ACCTTTTAGGGGGTGATGGTGGGARTGG GACAAAAGACAGCTACGTGGG'] |
| 4497 | NM_031157.2(HNRNPA1): c.956A > G (p.Asn319Ser) | 3178 | HNRNPA1 | ['AGCTACAATGATTTTGGGAATTACARCAAT CAGTCTTCAAATTTTGGACCC'] |
| 4498 | NM_020117.9(LARS): c.1118A > G (p.Tyr373Cys) | 51520 | LARS | ['CTTAATAGTTAGCATTGGGAGAACAYAGA TCACCTTGTATGATGTTAAAGG'] |
| 4499 | NM_001651.3(AQP5): c.367A > G (p.Asn123Asp) | 362 | AQP5 | ['CTAACCCGCTATCCCCTTGCAGCTCRACAA CAACACAACGCAGGGCCAGGC'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4500 | m.13637A > G | 4540 | MT-ND5 | ['ATAATTCTTCTCACCCTAACAGGTCRACCT CGCTTCCCCACCCTTACTAAC'] |
| 4501 | NM_000081.3(LYST): c.10127A > G (p.Asn3376Ser) | 1130 | LYST | ['GGGAAGGCTTCTGTTCAAGCGATCARTGTT TTTCATCCTGCTGTAAGTGAC'] |
| 4502 | NM_000142.4(FGFR3): c.2421A > G (p.Ter807Trp) | 2261 | FGFR3 | ['CCAGCAGTGGGGGCTCGCGGACGTGNAGG GCCACTGGTCCCCAACAATGTG'] |
| 4503 | NM_000207.2(INS): c.*59A > G | -1 | — | ['TCCTGCACCGAGAGAGATGGAATAAGCC CTTGAACCAGCCCTGCTGTGCC'] |
| 4504 | NM_000370.3(TTPA): c.191A > G (p.Asp64Gly) | 7274 | TTPA | ['CTGCGCGCCCGGGATTTCGATCTGGRCCTG GCCTGGCGGGTAAGCGTGCGT'] |
| 4505 | NM_001006657.1(WDR35): c.2912A > G (p.Tyr971Cys) | 57539 | WDR35 | ['AAACCTTTACGTGTCAAGAAGCTCTRTGTA CTGTCAGCCTTACTTATAGAG'] |
| 4506 | NM_004595.4(SMS): c.443A > G (p.Gln148Arg) | 6611 | SMS | ['GTATATGACGAAGATTCACCTTATCRAAAT ATAAAAATTCTACACTCGAAG'] |
| 4507 | NM_005259.2(MSTN): c.458A > G (p.Lys153Arg) | -1 | — | ['AAAATACAATACAATAAAGTAGTAARGGC CCAACTATGGATATATTTGAGA'] |
| 4508 | NM_000784.3(CYP27A1): c.1061A > G (p.Asp354Gly) | 1593 | CYP27A1 | ['TGGGCCCTGTACCACCTCTCAAAGGRCCCT GAGATCCAGGAGGCCTTGCAC'] |
| 4509 | NM_000784.3(CYP27A1): c.776A > G (p.Lys259Arg) | 1593 | CYP27A1 | ['TCACTCTATGCCACCTTCCTCCCCARGTGG ACTCGCCCCGTGCTGCCTTTC'] |
| 4510 | NM_000540.2(RYR1): c.10100A > G (p.Lys3367Arg) | 6261 | RYR1 | ['ATCCCAACTATCGGCGGCTGCGCARGAG GGCAGGGAAGGTGGTGTCCGAG'] |
| 4511 | NM_000540.2(RYR1): c.14572A > G (p.Asn4858Asp) | 6261 | RYR1 | ['CTACCTGTACACCGTGGTGGCCTTCRACTT CTTCCGCAAGTTCTACAACAA'] |
| 4512 | NM_000540.2(RYR1): c.14740A > G (p.Arg4914Gly) | 6261 | RYR1 | ['CGCGGGTGACGAATACGAGCTCTACRGGG TGGTCTTCGACATCACCTTCTT'] |
| 4513 | NM_000540.2(RYR1): c.14591A > G (p.Tyr4864Cys) | 6261 | RYR1 | ['GCCTTCAACTTCTTCCGCAAGTTCTRCAAC AAGAGCGAGGATGAGGATGAA'] |
| 4514 | NM_002336.2(LRP6): c.1298A > G (p.Asn433Ser) | 4040 | LRP6 | ['GATCGAATAGAAGTGACAAGGCTCARTGG GACCATGAGGAAGATCTTGATT'] |
| 4515 | NM_001257235.1(ALG13): c.8A > G (p.Asn3Ser) | 79868 | ALG13 | ['GTTATAAACGAAAAGTTGATGAACARTCA TCAGCTGGAACTGGCAAAGCAG'] |
| 4516 | NM_001015879.1(AURKC): c.379 – 2A > G | 6795 | AURKC | ['CAGGGTGACTTTTCTTTGCACCCACRGATA ATAGAGGAGTTGGCAGATGCC'] |
| 4517 | NM_012160.4(FBXL4): c.1694A > G (p.Asp565Gly) | 26235 | FBXL4 | ['AATTGTACCAGGTTACAGCAGCTGGRCAT ATTAGGTAAGGTTACAATATAT'] |
| 4518 | NM_020988.2(GNAO1): c.521A > G (p.Asp174Gly) | 2775 | GNAO1 | ['GCCGACTACCAGCCCACCGAGCAGGRCAT CCTCCGAACCAGGGTCAAAACC'] |
| 4519 | NM_001927.3(DES): c.1024A > G (p.Asn342Asp) | 1674 | DES | ['GACCTGGGTTCCCCCTCTCCTGCAGRACGA TTCCCTGATGAGGCAGATGCG'] |
| 4520 | NM_001927.3(DES): c.1333A > G (p.Thr445Ala) | 1674 | DES | ['GGGTTCTGAGGTCCATACCAAGAAGRCGG TGATGATCAAGACCATCGAGAC'] |
| 4521 | NM_001927.3(DES): c.735 + 3A > G | 1674 | DES | ['TCCTTAAGAAAGTGCATGAAGAGGTRTAC CTTGGCCCCTCTTCCTGGGGTC'] |
| 4522 | NM_002055.4(GFAP): c.1097A > G (p.Tyr366Cys) | 2670 | GFAP | ['GCCCTGGACATCGAGATCGCCACCTRCAG GAAGCTGCTAGAGGGCGAGGAG'] |
| 4523 | NM_002055.4(GFAP): c.1112A > G (p.Glu371Gly) | 2670 | GFAP | ['ATCGCCACCTACAGGAAGCTGCTAGDGGG CGAGGAGAACCGGTGAGCCCTC'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4524 | NM_002055.4(GFAP): c.1121A > G (p.Glu374Gly) | 2670 | GFAP | ['TACAGGAAGCTGCTAGAGGGCGAGGRGAA CCGGTGAGCCCTCATCACAGCC'] |
| 4525 | NM_002055.4(GFAP): c.230A > G (p.Asn77Ser) | 2670 | GFAP | ['GAGCGGGCAGAGATGATGGAGCTCARTGA CCGCTTTGCCAGCTACATCGAG'] |
| 4526 | NM_002055.4(GFAP): c.770A > G (p.Tyr257Cys) | 2670 | GFAP | ['AACATGCATGAAGCCGAAGAGTGGTRCCG CTCCAAGGTAGCCCTGCCTGTG'] |
| 4527 | NM_002055.4(GFAP): c.835A > G (p.Lys279Glu) | 2670 | GFAP | ['CAACGCGGAGCTGCTCCGCCAGGCCRAGC ACGAAGCCAACGACTACCGGCG'] |
| 4528 | NM_005554.3(KRT6A): c.511A > G (p.Asn171Asp) | 3853 | KRT6A | ['GGAGCGTGAACAGATCAAGACCCTCDACA ACAAGTTTGCCTCCTTCATCGA'] |
| 4529 | NM_005554.3(KRT6A): c.512A > G (p.Asn171Ser) | 3853 | KRT6A | ['GAGCGTGAACAGATCAAGACCCTCAVCAA CAAGTTTGCCTCCTTCATCGAC'] |
| 4530 | NM_005557.3(KRT16): c.373A > G (p.Asn125Asp) | 3868 | KRT16 | ['TGAGAAGGTGACCATGCAGAACCTCRATG ACCGCCTGGCCTCCTACCTGGA'] |
| 4531 | NM_170707.3(LMNA): c.640 - 10A > G | 4000 | LMNA | ['TTTTGGTTTCTGTGTCCTTCCTCCAVCCCTT CCAGGAGCTGCGTGAGACCA'] |
| | NM_000218.2(KCNQ1): c.1061A > G (p.Lys354Arg) | 3784 | KCNQ1 | [] |
| | NM_000218.2(KCNQ1): c.1138A > G (p.Arg380Gly) | 3784 | KCNQ1 | [] |
| | NM_000218.2(KCNQ1): c.1193A > G (p.Lys398Arg) | 3784 | KCNQ1 | [] |
| | NM_000218.2(KCNQ1): c.1640A > G (p.Gln547Arg) | 3784 | KCNQ1 | [] |
| | NM_000218.2(KCNQ1): c.1669A > G (p.Lys557Glu) | 3784 | KCNQ1 | [] |
| | NM_000218.2(KCNQ1): c.1705A > G (p.Lys569Glu) | 3784 | KCNQ1 | [] |
| | NM_000218.2(KCNQ1): c.1793A > G (p.Lys598Arg) | 3784 | KCNQ1 | [] |
| | NM_000218.2(KCNQ1): c.430A > G (p.Thr144Ala) | 3784 | KCNQ1 | [] |
| | NM_000218.2(KCNQ1): c.440A > G (p.Gln147Arg) | 3784 | KCNQ1 | [] |
| | NM_000218.2(KCNQ1): c.548A > G (p.Lys183Arg) | 3784 | KCNQ1 | [] |
| 4532 | NM_000218.2(KCNQ1): c.592A > G (p.Ile198Val) | 3784 | KCNQ1 | ['GCGGCTGCGCTTTGCCCGGAAGCCCRTTTC CATCATCGGTGAGTCATGCCT'] |
| 4533 | NM_000218.2(KCNQ1): c.652A > G (p.Lys218Glu) | 3784 | KCNQ1 | ['CATGGTGGTCCTCTGCGTGGGCTCCRAGGG GCAGGTGTTTGCCACGTCGGC'] |
| 4534 | NM_000218.2(KCNQ1): c.820A > G (p.Ile274Val) | 3784 | KCNQ1 | ['CCTGTACATCGGCTTCCTGGGCCTCRTCTT CTCCTCGTACTTTGTGTACCT'] |
| | NM_000218.2(KCNQ1): c.842A > G (p.Tyr281Cys) | 3784 | KCNQ1 | [] |
| | NM_000218.2(KCNQ1): c.931A > G (p.Thr311Ala) | 3784 | KCNQ1 | [] |
| | NM_000218.2(KCNQ1): c.950A > G (p.Asp317Gly) | 3784 | KCNQ1 | [] |
| | NM_000238.3(KCNH2): c.1205A > G (p.His402Arg) | 3757 | KCNH2 | [] |
| | NM_000238.3(KCNH2): c.1259A > G (p.Tyr420Cys) | 3757 | KCNH2 | [] |
| 4535 | NM_000238.3(KCNH2): c.1280A > G (p.Tyr427Cys) | 3757 | KCNH2 | ['ATCTACACGGCTGTCTTCACACCCTVCTCG GCTGCCTTCCTGCTGAAGGAG'] |
| | NM_000238.3(KCNH2): c.128A > G (p.Tyr43Cys) | 3757 | KCNH2 | [] |
| | NM_000238.3(KCNH2): c.1424A > G (p.Tyr475Cys) | 3757 | KCNH2 | [] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4536 | NM_000238.3(KCNH2): c.1478A > G (p.Tyr493Cys) | 3757 | KCNH2 | ['CACCCCGGCCGCATCGCCGTCCACTNCTTC AAGGGCTGGTTCCTCATCGAC'] |
| | NM_000238.3(KCNH2): c.1502A > G (p.Asp501Gly) | 3757 | KCNH2 | [] |
| 4537 | NM_000238.3(KCNH2): c.1685A > G (p.His562Arg) | 3757 | KCNH2 | ['ATGTGCACCTTTGCGCTCATCGCGCVCTGG CTAGCCTGCATCTGGTACGCC'] |
| 4538 | NM_000238.3(KCNH2): c.1711A > G (p.Ile571Val) | 3757 | KCNH2 | ['CTGGCTAGCCTGCATCTGGTACGCCVTCGG CAACATGGAGCAGCCACACAT'] |
| 4539 | NM_000238.3(KCNH2): c.1720A > G (p.Met574Val) | 3757 | KCNH2 | ['CTGCATCTGGTACGCCATCGGCAACVTGG AGCAGCCACACATGGACTCACG'] |
| | NM_000238.3(KCNH2): c.1724A > G (p.Glu575Gly) | 3757 | KCNH2 | [] |
| 4540 | NM_000238.3(KCNH2): c.173A > G (p.Glu58Gly) | 3757 | KCNH2 | ['GAGCTGTGCGGCTACTCGCGGGCCGVGGT GATGCAGCGACCCTGCACCTGC'] |
| | NM_000238.3(KCNH2): c.1747A > G (p.Ile583Val) | 3757 | KCNH2 | [] |
| | NM_000238.3(KCNH2): c.1762A > G (p.Asn588Asp) | 3757 | KCNH2 | [] |
| | NM_000238.3(KCNH2): c.1777A > G (p.Ile593Val) | 3757 | KCNH2 | [] |
| | NM_000238.3(KCNH2): c.1783A > G (p.Lys595Glu) | 3757 | KCNH2 | [] |
| | NM_000238.3(KCNH2): c.1790A > G (p.Tyr597Cys) | 3757 | KCNH2 | [] |
| | NM_000238.3(KCNH2): c.1826A > G (p.Asp609Gly) | 3757 | KCNH2 | [] |
| | NM_000238.3(KCNH2): c.1847A > G (p.Tyr616Cys) | 3757 | KCNH2 | [] |
| | NM_000238.3(KCNH2): c.1885A > G (p.Asn629Asp) | 3757 | KCNH2 | [] |
| 4541 | NM_000238.3(KCNH2): c.1886A > G (p.Asn629Ser) | 3757 | KCNH2 | ['AGCCTCACCAGTGTGGGCTTCGGCANCGT CTCTCCCAACACCAACTCAGAG'] |
| | NM_000238.3(KCNH2): c.1897A > G (p.Asn633Asp) | 3757 | KCNH2 | [] |
| 4542 | NM_000238.3(KCNH2): c.1898A > G (p.Asn633Ser) | 3757 | KCNH2 | ['GTGGGCTTCGGCAACGTCTCTCCCADCACC AACTCAGAGAAGATCTTCTCC'] |
| | NM_000238.3(KCNH2): c.1903A > G (p.Asn635Asp) | 3757 | KCNH2 | [] |
| | NM_000238.3(KCNH2): c.1910A > G (p.Glu637Gly) | 3757 | KCNH2 | [] |
| | NM_000238.3(KCNH2): c.1912A > G (p.Lys638Glu) | 3757 | KCNH2 | [] |
| 4543 | NM_000238.3(KCNH2): c.1933A > G (p.Met645Val) | 3757 | KCNH2 | ['AGAGAAGATCTTCTCCATCTGCGTCDTGCT CATTGGCTGTGAGTGTGCCCA'] |
| | NM_000238.3(KCNH2): c.209A > G (p.His70Arg) | 3757 | KCNH2 | [] |
| 4544 | NM_000238.3(KCNH2): c.2131A > G (p.Ile711Val) | 3757 | KCNH2 | ['GCACGCCTGGTCCTACACCAACGGCRTCG ACATGAACGCGGTGAGGCCACC'] |
| | NM_000238.3(KCNH2): c.2266A > G (p.Met756Val) | 3757 | KCNH2 | [] |
| | NM_000238.3(KCNH2): c.2510A > G (p.Asp837Gly) | 3757 | KCNH2 | [] |
| | NM_000238.3(KCNH2): c.2591A > G (p.Asp864Gly) | 3757 | KCNH2 | [] |
| | NM_000238.3(KCNH2): c.286A > G (p.Ile96Val) | 3757 | KCNH2 | [] |
| 4545 | NM_000238.3(KCNH2): c.301A > G (p.Lys101Glu) | 3757 | KCNH2 | ['CAAAGTGGAAATCGCCTTCTACCGGDAAG ATGGTAGGAGCGGGCCGGGGCG'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4546 | NM_000238.3(KCNH2): c.3118A > G (p.Ser1040Gly) | 3757 | KCNH2 | ['TCGGCGGCCCCGGGGCGACGTGGAGRGCA GGCTGGATGCCCTCCAGCGCCA'] |
| | NM_000238.3(KCNH2): c.3233A > G (p.Tyr1078Cys) | 3757 | KCNH2 | [] |
| | NM_000238.3(KCNH2): c.3343A > G (p.Met1115Val) | 3757 | KCNH2 | [] |
| | NM_000238.3(KCNH2): c.652A > G (p.Met218Val) | 3757 | KCNH2 | [] |
| | NM_000238.3(KCNH2): c.82A > G (p.Lys28Glu) | 3757 | KCNH2 | [] |
| | NM_000891.2(KCNJ2): c.220A > G (p.Thr74Ala) | 3759 | KCNJ2 | [] |
| | NM_000891.2(KCNJ2): c.223A > G (p.Thr75Ala) | 3759 | KCNJ2 | [] |
| | NM_000891.2(KCNJ2): c.233A > G (p.Asp78Gly) | 3759 | KCNJ2 | [] |
| | NM_000891.2(KCNJ2): c.574A > G (p.Thr192Ala) | 3759 | KCNJ2 | [] |
| 4547 | NM_000891.2(KCNJ2): c.913A > G (p.Thr305Ala) | 3759 | KCNJ2 | ['CATACTGGAAGGCATGGTGGAAGCCVCTG CCATGACGACACAGTGCCGTAG'] |
| | NM_172201.1(KCNE2): c.269A > G (p.Glu90Gly) | 9992 | KCNE2 | [] |
| 4548 | NM_172201.1(KCNE2): c.281A > G (p.Glu94Gly) | 9992 | KCNE2 | ['CAGTACATTGTAGAGGACTGGCAGGRAAA GTACAAGAGCCAAATCTTGAAT'] |
| | NM_000335.4(SCN5A): c.1217A > G (p.Asn406Ser) | 6331 | SCN5A | [] |
| | NM_000335.4(SCN5A): c.1502A > G (p.Asp501Gly) | 6331 | SCN5A | [] |
| | NM_000335.4(SCN5A): c.2249A > G (p.Gln750Arg) | 6331 | SCN5A | [] |
| | NM_198056.2(SCN5A): c.2527A > G (p.Thr843Ala) | 6331 | SCN5A | [] |
| | NM_000335.4(SCN5A): c.2780A > G (p.Asn927Ser) | 6331 | SCN5A | [] |
| | NM_000335.4(SCN5A): c.3164A > G (p.Asp1055Gly) | 6331 | SCN5A | [] |
| | NM_000335.4(SCN5A): c.343A > G (p.Ser115Gly) | 6331 | SCN5A | [] |
| | NM_000335.4(SCN5A): c.3755A > G (p.Glu1252Gly) | 6331 | SCN5A | [] |
| 4549 | NM_000335.4(SCN5A): c.376A > G (p.Lys126Glu) | 6331 | SCN5A | ['AAAGGATATGAGTGAACCAGAATCTYCAC AGCCGCTCTCCGGATGGGGTGG'] |
| 4550 | NM_198056.2(SCN5A): c.4000A > G (p.Ile1334Val) | 6331 | SCN5A | ['TGCCCTGGTGGGCGCCATCCCGTCCRTCAT GAACGTCCTCCTCGTCTGCCT'] |
| | NM_000335.4(SCN5A): c.4223A > G (p.Tyr1408Cys) | 6331 | SCN5A | [] |
| | NM_000335.4(SCN5A): c.4252A > G (p.Lys1418Glu) | 6331 | SCN5A | [] |
| | NM_000335.4(SCN5A): c.4291A > G (p.Arg1431Gly) | 6331 | SCN5A | [] |
| | NM_198056.2(SCN5A): c.4346A > G (p.Tyr1449Cys) | 6331 | SCN5A | [] |
| | NM_000335.4(SCN5A): c.4412A > G (p.Asn1471Ser) | 6331 | SCN5A | [] |
| 4551 | NM_198056.2(SCN5A): c.4478A > G (p.Lys1493Arg) | 6331 | SCN5A | ['ATCTTCATGACAGAGGAGCAGAAGARGTA CTACAATGCCATGAAGAAGCTG'] |
| | NM_000335.4(SCN5A): c.4489A > G (p.Met1497Val) | 6331 | SCN5A | [] |
| | NM_000335.4(SCN5A): c.4577A > G (p.Lys1526Arg) | 6331 | SCN5A | [] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4552 | NM_198056.2(SCN5A): c.4978A > G (p.Ile1660Val) | 6331 | SCN5A | ['GATGTCCCTGCCTGCCCTCTTCAACRTCGG GCTGCTGCTCTTCCTCGTCAT'] |
| | NM_000335.4(SCN5A): c.5138A > G (p.Asp1713Gly) | 6331 | SCN5A | [] |
| | NM_000335.4(SCN5A): c.5161A > G (p.Asn1721Asp) | 6331 | SCN5A | [] |
| | NM_000335.4(SCN5A): c.5297A > G (p.Tyr1766Cys) | 6331 | SCN5A | [] |
| | NM_198056.2(SCN5A): c.5302A > G (p.Ile1768Val) | 6331 | SCN5A | [] |
| | NM_000335.4(SCN5A): c.5317A > G (p.Asn1773Asp) | 6331 | SCN5A | [] |
| | NM_000335.4(SCN5A): c.5318A > G (p.Asn1773Ser) | 6331 | SCN5A | [] |
| | NM_000335.4(SCN5A): c.5366A > G (p.Asp1789Gly) | 6331 | SCN5A | [] |
| | NM_000335.4(SCN5A): c.5402A > G (p.Asp1801Gly) | 6331 | SCN5A | [] |
| | NM_000335.4(SCN5A): c.5513A > G (p.Asp1838Gly) | 6331 | SCN5A | [] |
| | NM_198056.2(SCN5A): c.5726A > G (p.Gln1909Arg) | 6331 | SCN5A | [] |
| 4553 | NM_000335.4(SCN5A): c.688A > G (p.Ile230Val) | 6331 | SCN5A | ['CCGAGTCCTCCGGGCCCTGAAAACTRTATC AGTCATTTCAGGTGAAAATCA'] |
| | NM_000335.4(SCN5A): c.715A > G (p.Ile239Val) | 6331 | SCN5A | [] |
| | NM_000335.4(SCN5A): c.89A > G (p.Glu30Gly) | 6331 | SCN5A | [] |
| 4554 | NM_000383.3(AIRE): c.254A > G (p.Tyr85Cys) | 326 | AIRE | ['TTCTGGAGGGTGCTGTTCAAGGACTRCAAC CTGGAGCGCTATGGCCGGCTG'] |
| 4555 | NM_006920.4(SCN1A): c.1876A > G (p.Ser626Gly) | 6323 | SCN1A | ['ACGCAACAGCAACCTGAGTCAGACCRGTA GGTCATCCCGGATGCTGGCAGT'] |
| 4556 | NM_006920.4(SCN1A): c.4352A > G (p.Tyr1451Cys) | -1 | — | ['GAAGAAAGTCTGTACATGTATCTTTRCTTT GTTATTTTCATCATCTTTGGG'] |
| 4557 | NM_000165.4(GJA1): c.617A > G (p.Lys206Arg) | 2697 | GJA1 | ['TGTTTCCTCTCTCGCCCCACGGAGARAACC ATCTTCATCATCTTCATGCTG'] |
| 4558 | NM_000833.4(GRIN2A): c.1123 - 2A > G | 2903 | GRIN2A | ['AGCTGTGTCTTTGTGTTTGTGCTGCRGGTG GGCAAGTGGGAGAACCATACG'] |
| 4559 | NC_000007.14: g.62535490A > G | -1 | — | ['GGAGAGTTTTGAGGCCTGTGGTTGARATG GAAATATCTTCACAGAAAAACT'] |
| 4560 | NM_004595.4(SMS): c.983A > G (p.Tyr328Cys) | 6611 | SMS | ['AATCTGACAGAAGCACTGTCGCTCTVTGA AGAACAGCTGGGGCGCCTGTAT'] |
| 4561 | NM_001256864.1(DNAJC6): c.801 - 2A > G | 9829 | DNAJC6 | ['CAAGAGAGTGCCAACCTTCTGTTTCRGATA CCTGGGCTATATGTGTGACCT'] |
| 4562 | NM_001204316.1(PRLR): c.635A > G (p.His212Arg) | 5618 | PRLR | ['GTCCAGGTTCGCTGCAAACCAGACCRTGG ATACTGGAGTGCATGGAGTCCA'] |
| 4563 | NM_012243.2(SLC35A3): c.886A > G (p.Ser296Gly) | 23443 | SLC35A3 | ['TTGGCTTCAAGATTTTGTGCCAACCRGGTA AAATGTTCTTTTCTATTTTTT'] |
| 4564 | NM_000179.2(MSH6): c.3439 - 2A > G | 2956 | MSH6 | ['AAAGACCTTTTCCTCCCTCATTCACRGGCT GGCTTATTAGCTGTAATGGCC'] |
| 4565 | NM_000249.3(MLH1): c.113A > G (p.Asn38Ser) | 4292 | MLH1 | ['AATGCTATCAAAGAGATGATTGAGARCTG GTACGGAGGGAGTCGAGCCGGG'] |
| 4566 | NM_000249.3(MLH1): c.122A > G (p.Asp41Gly) | 4292 | MLH1 | ['TTTTCTGTTTGATTTGCCAGTTTAGRTGCA AAATCCACAAGTATTCAAGTG'] |
| 4567 | NM_000249.3(MLH1): c.1559 - 2A > G | 4292 | MLH1 | ['TTTTTGGTTTTATTTTTTGTTTTGCNGTTCT CCGGGAGATGTTGCATAACC'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4568 | NM_000249.3(MLH1): c.1990 - 2A > G | 4292 | MLH1 | ['TTGAGGTATTGAATTTCTTTGGACCRGGTG AATTGGGACGAAGAAAAGGAA'] |
| 4569 | NM_000249.3(MLH1): c.208 - 2A > G | 4292 | MLH1 | ['TTTACTCATCTTTTTGGTATCTAACVGAAA GAAGATCTGGATATTGTATGT'] |
| 4570 | NM_000249.3(MLH1): c.544A > G (p.Arg182Gly) | 4292 | MLH1 | ['TGGGAAAATTTTGGAAGTTGTTGGCRGGT ACAGTCCAAAATCTGGGAGTGG'] |
| 4571 | NM_000249.3(MLH1): c.545 + 3A > G | 4292 | MLH1 | ['AAAATTTTGGAAGTTGTTGGCAGGTRCAGT CCAAAATCTGGGAGTGGGTCT'] |
| 4572 | NM_000249.3(MLH1): c.546 - 2A > G | 4292 | MLH1 | ['TCTTACTCTTTTGTTTTCTTTTCCVGGTAT TCAGTACACAATGCAGGCAT'] |
| 4573 | NM_000249.3(MLH1): c.589 - 2A > G | 4292 | MLH1 | ['TTGTGTCTTCTGCTGTTTGTTTATCRGCAAG GAGAGACAGTAGCTGATGTT'] |
| 4574 | NM_000249.3(MLH1): c.677 + 3A > G | 4292 | MLH1 | ['GATTTTTTATATAGGTTATCGACABACCG ACTAACAGCATTTCCAAAGAT'] |
| 4575 | NM_000249.3(MLH1): c.791 - 2A > G | 4292 | MLH1 | ['ACTGGTTGCTTTCTTTTATTGTTTRGATCG TCTGGTAGAATCAACTTCCT'] |
| 4576 | NM_000249.3(MLH1): c.883A > G (p.Ser295Gly) | 4292 | MLH1 | ['AAACACACACCCATTCCTGTACCTCVGGTA ATGTAGCACCAAACTCCTCAA'] |
| 4577 | NM_000249.3(MLH1): c.884 + 4A > G | 4292 | MLH1 | ['CACACCCATTCCTGTACCTCAGGTARTGTA GCACCAAACTCCTCAACCAAG'] |
| 4578 | NM_000251.2(MSH2): c.1277 - 2A > G | 4436 | MSH2 | ['TTTGTTTGTTTTACTACTTTCTTTTVGGAAA ACACCAGAAATTATTGTTGG'] |
| 4579 | NM_000251.2(MSH2): c.1511 - 2A > G | 4436 | MSH2 | ['CTTTTTCTTTTCTTCTTGATTATCARGGCTT GGACCCTGGCAAACAGATTA'] |
| 4580 | NM_000251.2(MSH2): c.1660A > G (p.Ser554Gly) | 4436 | MSH2 | ['GAAGAATGGTGTTAAATTTACCAACNGGT TTGCAAGTCGTTATTATATTTT'] |
| 4581 | NM_000535.5(PMS2): c.1A > G (p.Met1Val) | 5395 | PMS2 | ['CCGAGGCGGATCGGGTGTTGCATCCDTGG AGCGAGCTGAGAGCTCGAGGTG'] |
| 4582 | NM_000535.5(PMS2): c.989 - 2A > G | 5395 | PMS2 | ['ATAAATATGTTTCTTTTTGCCTTRGAATG CGTTGATATCAATGTTACTC'] |
| 4583 | NM_000059.3(BRCA2): c.426 - 2A > G | 675 | BRCA2 | ['TAAGGGATTTGCTTTGTTTTATTTTRGTCCT GTTGTTCTACAATGTACACA'] |
| 4584 | NM_024876.3(ADCK4): c.857A > G (p.Asp286Gly) | 79934 | ADCK4 | ['CAGCAGGAGCTGGCTTGGGAGTGTGRCTA CCGTCGTGAGGCGGCTTGTGCC'] |
| 4585 | NM_006005.3(WFS1): c.1385A > G (p.Glu462Gly) | 7466 | WFS1 | ['TACACGCGCAGGGCCCTGGCCACCGRGGT CACCGCCGGCCTGCTATCGCTG'] |
| 4586 | NM_000019.3(ACAT1): c.472A > G (p.Asn158Asp) | 38 | ACAT1 | ['GGCAGGTGGGATGGAGAGCATGTCCRATG TTCCATATGTAATGAACAGAGG'] |
| 4587 | NM_000050.4(ASS1): c.496 - 2A > G | 445 | ASS1 | ['TCCACCTGTGCTGTCTCTTTCCTGCRGCAA CACGGGATTCCCATCCCGGTC'] |
| 4588 | NM_000117.2(EMD): c.450 - 2A > G | 2010 | EMD | ['CCCACTTGCTCCCCTCTTTTGCCTCRGGGA ACGCCCCATGTACGGCCGGGA'] |
| 4589 | NM_000153.3(GALC): c.334A > G (p.Thr112Ala) | 2581 | GALC | ['GCATAATGCATGTGGGAGGGCTCAGBGCC GTCTGAATAGAGGAGAGCAAAA'] |
| 4590 | NM_000155.3(GALT): c.905 - 2A > G | 2592 | GALT | ['CCCCACTGTCTCTCTTCTTTCTGTCRGGGG CTCCCACAGGATCAGAGGCTG'] |
| 4591 | NM_000159.3(GCDH): c.542A > G (p.Glu181Gly) | 2639 | GCDH | ['CTCCTGGGCTGCTTCGGGCTCACAGRGCCC AACAGCGGAAGTGACCCCAGC'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4592 | NM_000169.2(GLA): c.509A > G (p.Asp170Gly) | -1 | — | ['TGGGGAGTAGATCTGCTAAAATTTGRTGGT TGTTACTGTGACAGTTTGGAA'] |
| 4593 | NM_000169.2(GLA): c.548 - 2A > G | -1 | — | ['TATTTTACCCATTGTTTTCTCATACRGGTTA TAAGCACATGTCCTTGGCCC'] |
| 4594 | NM_000169.2(GLA): c.647A > G (p.Tyr216Cys) | -1 | — | ['TCATATCTGTTTTCACAGCCCAATTRTACA GAAATCCGACAGTACTGCAAT'] |
| 4595 | NM_000232.4(SGCB): c.1A > G (p.Met1Val) | 6443 | SGCB | ['GCTCGGCGGCGGCGGGCGCGGGAAGRTGG CGGCAGCGGCGGCGGCGGCTGC'] |
| 4596 | NM_000255.3(MUT): c.1445 - 2A > G | 4594 | MUT | ['TAAAATTTTCTTTGGGAAATTACCRGGTT CTGAAGTAATTGTTGGAGTAA'] |
| 4597 | NM_000277.1(PAH): c.533A > G (p.Glu178Gly) | 5053 | PAH | ['AGTGGGCAGCCCATCCCTCGAGTGGDATA CATGGAGGAAGAAAAGAAAACA'] |
| 4598 | NM_000277.1(PAH): c.974A > G (p.Tyr325Cys) | 5053 | PAH | ['CAGATTGACTTTCCATTCCAGATTRCTGG TTTACTGTGGAGTTTGGGCTC] |
| 4599 | NM_000328.2(RPGR): c.155 - 2A > G | 6103 | RPGR | ['TGATTATTTCTTTTTCCCTCCTACCRGGAA ATAATAAACTTTACATGTTTG'] |
| 4600 | NM_000350.2(ABCA4): c.4540 - 2A > G | 24 | ABCA4 | ['ATTAACGTGGGTGTCTCATTGCCTCRGAGA ACACAGCGCAGCACGGAAATT'] |
| 4601 | NM_000350.2(ABCA4): c.67 - 2A > G | 24 | ABCA4 | ['TTCTCTCTTTTTGTTTGTTTTCCRGATTC GCTTTGTGGTGGAACTCGTG'] |
| 4602 | NM_000487.5(ARSA): c.1108 - 2A > G | 410 | ARSA | ['CCCCGTGACCCCTGACTCTGCCCCCRGAGC CCTCGGCAGTCTCTCTTCTTC'] |
| 4603 | NM_000489.4(ATRX): c.134 - 2A > G | 546 | ATRX | ['TAATGTTCTTTATTTCTTCTTTTTTRGATAA AATCAGTGGTTCTGGAAGTA'] |
| 4604 | NM_000489.4(ATRX): c.536A > G (p.Asn179Ser) | 546 | ATRX | ['TGCACTGCTTGTGGACAACAGGTCARTCAT TTTCAAAAAGATTCCATTTAT'] |
| 4605 | NM_000512.4(GALNS): c.1171A > G (p.Met391Val) | 2588 | GALNS | ['CTTCTATTACCGTGGCGACACGCTGRTGGC GGCCACCCTCGGGCAGCACAA'] |
| 4606 | NM_000521.3(HEXB): c.1243 - 2A > G | 3074 | HEXB | ['ATGTATTGCAATTTGTAACGTTAATRGCTT GCGCCGGGCACAATAGTTGAA'] |
| 4607 | NM_000531.5(OTC): c.238A > G (p.Lys80Glu) | 5009 | OTC | ['ATAGTATTTGCCTTTATTGCAAGGGRAGTC CTTAGGCATGATTTTTGAGAA'] |
| 4608 | NM_000551.3(VHL): c.233A > G (p.Asn78Ser) | 7428 | VHL | ['GAGCCCTCCCAGGTCATCTTCTGCARTCGC AGTCCGCGCGTCGTGCTGCCC'] |
| 4609 | NM_001848.2(COL6A1): c.805 - 2A > G | 1291 | COL6A1 | ['CCAACCTTGACCTGTTTTGTGTTCCRGGGA GAACGAGGCAAGCCGGGGCTC'] |
| 4610 | NM_001918.3(DBT): c.773 - 2A > G | 1629 | DBT | ['AATGAATAACAATTTAATGCTTTTCRGGCT TTCAAAAAGCAATGGTCAAGA'] |
| 4611 | NM_003482.3(KMT2D): c.5645 - 2A > G | 8085 | KMT2D | ['TCAACAGTGTCCTTCATTCCCCCACRGAAC TGCCCAAGATGGAATCCAAGG'] |
| 4612 | NM_003494.3(DYSF): c.1398 - 2A > G | 8291 | DYSF | ['CAGGCCCTCTCTGCTCCCTTGCTCTRGGGA CCGCCTGACTCACAATGACAT'] |
| 4613 | NM_004006.2(DMD): c.1332 - 9A > G | 1756 | DMD | ['AAGAGGTCATAATAGGCTTCTTTCAVATTT TCAGTTTACATAGAGTTTTAA'] |
| 4614 | NM_004006.2(DMD): c.3432 + 3A > G | 1756 | DMD | ['AGTGGGATCACATGTGCCAACAGGTRTAG ACAATCTCTTTCACTGTGGCTT'] |
| 4615 | NM_004006.2(DMD): c.6763 - 2A > G | 1756 | DMD | ['AAACGTTGTTGCATTTGTCTGTTTCRGTTA CTGGTGGAAGAGTTGCCCCTG'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4616 | NM_004006.2(DMD): c.9224 + 61934A > G | 1756 | DMD | ['AGCTGTGAATGCTTCATTCAGGCCCRAGTA AATATAGGAAGAGGTGTAGTG'] |
| 4617 | NM_004006.2(DMD): c.9225 − 647A > G | 1756 | DMD | ['GCTGTGAATGCTTCATTCAGGCCCARGTAA ATATAGGAAGAGGTGTAGTGG'] |
| 4618 | NM_004006.2(DMD): c.9650 − 2A > G | 1756 | DMD | ['TGTTGCAATTTCTTCTTCCTTTGTRGACCT TTTCAAGCAAGTGGCAAGTT'] |
| 4619 | NM_015560.2(OPA1): c.983A > G (p.Lys328Arg) | 4976 | OPA1 | ['GAGATGATGACACGTTCTCCAGTTAVGGT AAGAACATAGGCCGTCTCAGTG'] |
| 4620 | NM_144997.5(FLCN): c.1433 − 2A > G | 201163 | FLCN | ['TTGCTCTGCCCCTGCCCTTCTCCCCRGTGG GCCCCACCATCCTGAATAAGA'] |
| 4621 | NM_144997.5(FLCN): c.250 − 2A > G | 201163 | FLCN | ['AGATTTACTTTTCCTTTTCATGGACRGGGC TGCCGGTCACTTGCTGCAGGG'] |
| 4622 | NM_000146.3(FTL): c.1A > G (p.Met1Val) | 2512 | FTL | ['GTTAGCTCCTTCTTGCCAACCAACCRTGAG CTCCCAGATTCGTCAGAATTA'] |
| 4623 | NM_024531.4(SLC52A2): c.914A > G (p.Tyr305Cys) | 79581 | SLC52A2 | ['GTGCAGAGCTTTTCCTGCTTACCCTRCGGG CGTCTGGCCTACCACCTGGCT'] |
| 4624 | NM_001743.5(CALM2): c.293A > G (p.Asn98Ser) | 805 | CALM2 | ['TACTAAATTTTTGCTAGGATGGCADTGGC TATATTAGTGCTGCAGAACTT'] |
| 4625 | NM_014754.2(PTDSS1): c.1058A > G (p.Gln353Arg) | 9791 | PTDSS1 | ['ACACAGTGCAAGCGCGTAGGAACACRATG CTGGGTGTTTGGGTGAGTAATC'] |
| 4626 | NM_052844.3(WDR34): c.1307A > G (p.Lys436Arg) | 89891 | WDR34 | ['GGACCAGCGCACAGCAAACAGATACYTGA GGGAGAGCTGCAGCGAAGTCAA'] |
| 4627 | NM_001130010.2(C15orf41): c.281A > G (p.Tyr94Cys) | 84529 | C15orf41 | ['TACTTCTGTTTTATAAAGGTGGACTVTGCG CCCTCATTAATGGCTCGGCTT'] |
| 4628 | NM_001290048.1(ATL3): c.521A > G (p.Tyr174Cys) | 25923 | ATL3 | ['AATTTCATCCATTGCCAGACGACCGYATTC TGTGAAGAGCTTTAAAAAGA'] |
| 4629 | NM_000531.5(OTC): c.1034A > G (p.Tyr345Cys) | 5009 | OTC | ['GTCATGGTGTCCCTGCTGACAGATTRCTCA CCTCAGCTCCAGAAGCCTAAA'] |
| 4630 | NM_000531.5(OTC): c.122A > G (p.Asp41Gly) | 5009 | OTC | ['AATAAAGTGCAGCTGAAGGGCCGTGRCCT TCTCACTCTAAAAAACTTTACC'] |
| 4631 | NM_000531.5(OTC): c.155A > G (p.Glu52Gly) | 5009 | OTC | ['ACTCTAAAAAACTTTACCGGAGAAGRAAT TAAATATATGCTATGGCTATCA'] |
| 4632 | NM_000531.5(OTC): c.1A > G (p.Met1Val) | 5009 | OTC | ['TCGTCCTTTACACAATTAAAAGAAGDTGCT GTTTAATCTGAGGATCCTGTT'] |
| 4633 | NM_000531.5(OTC): c.268A > G (p.Ser90Gly) | 5009 | OTC | ['CTTAGGCATGATTTTTGAGAAAAGARGTA CTCGAACAAGATTGTCTACAGA'] |
| 4634 | NM_000531.5(OTC): c.277A > G (p.Thr93Ala) | 5009 | OTC | ['GATTTTTGAGAAAAGAAGTACTCGARCAA GATTGTCTACAGAAACAGGTAA'] |
| 4635 | NM_000531.5(OTC): c.350A > G (p.His117Arg) | 5009 | OTC | ['TGTTTTCTTACCACACAAGATATTCDTTTG GGTGTGAATGAAAGTCTCACG'] |
| 4636 | NM_000531.5(OTC): c.377A > G (p.Asp126Gly) | 5009 | OTC | ['TTGGGTGTGAATGAAAGTCTCACGGRCAC GGCCCGGTTTGTAAATATTTTC'] |
| 4637 | NM_000531.5(OTC): c.387 − 2A > G | 5009 | OTC | ['GATTATCTTTTCTTGGTTTGCCACNGTGT ATTGTCTAGCATGGCAGATGC'] |
| 4638 | NM_000531.5(OTC): c.481A > G (p.Asn161Asp) | 5009 | OTC | ['TAAAGAAGCATCCATCCCAATTATCRATGG GGCTGTCAGATTTGTACCATCC'] |
| 4639 | NM_000531.5(OTC): c.482A > G (p.Asn161Ser) | 5009 | OTC | ['AAAGAAGCATCCATCCCAATTATCARTGG GCTGTCAGATTTGTACCATCCT'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4640 | NM_000531.5(OTC): c.503A > G (p.His168Arg) | 5009 | OTC | ['ATCAATGGGCTGTCAGATTTGTACCVTCCT ATCCAGATCCTGGCTGATTAC'] |
| 4641 | NM_000531.5(OTC): c.524A > G (p.Asp175Gly) | 5009 | OTC | ['TACCATCCTATCCAGATCCTGGCTGDTTAC CTCACGCTCCAGGTTGGTTTA'] |
| 4642 | NM_000531.5(OTC): c.527A > G (p.Tyr176Cys) | 5009 | OTC | ['CATCCTATCCAGATCCTGGCTGATTRCCTC ACGCTCCAGGTTGGTTTATTT] |
| 4643 | NM_000531.5(OTC): c.541 − 2A > G | 5009 | OTC | ['TCATCTCCTTCATCCCGTGCCTTTTRGGAA CACTATAGCTCTCTGAAAGGT'] |
| 4644 | NM_000531.5(OTC): c.542A > G (p.Glu181Gly) | 5009 | OTC | ['TCTCCTTCATCCCGTGCCTTTTAGGRACAC TATAGCTCTCTGAAAGGTCTT'] |
| 4645 | NM_000531.5(OTC): c.548A > G (p.Tyr183Cys) | 5009 | OTC | ['TCATCCCGTGCCTTTTAGGAACACTRTAGC TCTCTGAAAGGTCTTACCCTC'] |
| 4646 | NM_000531.5(OTC): c.595A > G (p.Asn199Asp) | 5009 | OTC | ['CCTCAGCTGGATCGGGGATGGGAACRATA TCCTGCACTCCATCATGATGAG'] |
| 4647 | NM_000531.5(OTC): c.596A > G (p.Asn199Ser) | 5009 | OTC | ['CTCAGCTGGATCGGGGATGGGAACARTAT CCTGCACTCCATCATGATGAGC'] |
| 4648 | NM_000531.5(OTC): c.613A > G (p.Met205Val) | 5009 | OTC | ['TGGGAACAATATCCTGCACTCCATCRTGAT GAGCGCAGCGAAATTCGGAAT'] |
| 4649 | NM_000531.5(OTC): c.716A > G (p.Glu239Gly) | 5009 | OTC | ['AAGTTGGCAGAGCAGTATGCCAAAGDGGT ATGCTCTTTACATGTAAAGCTA'] |
| 4650 | NM_000531.5(OTC): c.717 + 3A > G | 5009 | OTC | ['TGGCAGAGCAGTATGCCAAAGAGGTRTGC TCTTTACATGTAAAGCTATTAT'] |
| 4651 | NM_000531.5(OTC): c.718 − 2A > G | 5009 | OTC | ['TTTAACCAGCGTGTTTATGTATGCTRGAAT GGTACCAAGCTGTTGCTGACA'] |
| 4652 | NM_000531.5(OTC): c.788A > G (p.Asp263 Gly) | 5009 | OTC | ['CATGGAGGCAATGTATTAATTACAGRCAC TTGGATAAGCATGGGACAAGAA'] |
| 4653 | NM_000531.5(OTC): c.790A > G (p.Thr264Ala) | 5009 | OTC | ['TGGAGGCAATGTATTAATTACAGACRCTTG GATAAGCATGGGACAAGAAGA'] |
| 4654 | NM_000531.5(OTC): c.905A > G (p.His302Arg) | 5009 | OTC | ['GCTGCCTCTGACTGGACATTTTTACDCTGC TTGCCCAGAAAGCCAGAAGAA'] |
| 4655 | NM_000531.5(OTC): c.929A > G (p.Glu310Gly) | 5009 | OTC | ['CACTGCTTGCCCAGAAAGCCAGAAGRAGT GGATGATGAAGTCTTTTATTCT'] |
| 4656 | NM_000531.5(OTC): c.988A > G (p.Arg330Gly) | 5009 | OTC | ['ACTAGTGTTCCCAGAGGCAGAAAACRGAA AGTGGACAATCATGGTAAGCAA'] |
| 4657 | NM_000322.4(PRPH2): c.422A > G (p.Tyr141Cys) | 5961 | PRPH2 | ['GGGCTCAAGAACGGCATGAAGTACTRCCG GGACACAGACACCCCTGGCAGG'] |
|  | NM_003590.4(CUL3): c.1207 − 26A > G | 8452 | CUL3 | [] |
|  | NM_003590.4(CUL3): c.1376A > G (p.Lys459Arg) | 8452 | CUL3 | [] |
|  | NM_003590.4(CUL3): c.1377 + 3A > G | 8452 | CUL3 | [] |
| 4658 | NM_017415.2(KLHL3): c.232A > G (p.Met78Val) | 26249 | KLHL3 | ['AGCCTGCAGCCCCTACTTCTGTGCGDTGTT CACAGGTATGGTGAGTGGCCA] |
|  | NM_017415.2(KLHL3): c.926A > G (p.Gln309Arg) | 26249 | KLHL3 | [] |
| 4659 | NM_005763.3(AASS): c.874A > G (p.Ile292Val) | 10157 | AASS | ['CTCACATCAGTATTAAAACGACTTAYGTA GCGCTCCGGATGTTTGTCATAC'] |
| 4660 | NM_000203.4(IDUA): c.1874A > G (p.Tyr625Cys) | 3425 | IDUA | ['TCCTACCGAGTTCGAGCCCTGGACTRCTGG GCCCGACCAGGCCCCTTCTCG'] |

TABLE 7-continued

Diseases/disorders containging A to G Changes.The table includes human gene mutations that may be corrected by changing a guanine (G) to adenine (A).The gene name, gene symbol, and Gene ID are indicated.

| SEQ ID NO: | Name | Gene ID | Gene Symbol | Flanks |
|---|---|---|---|---|
| 4661 | NM_000546.5(TP53): c.736A > G (p.Met246Val) | 7157 | TP53 | ['GTGTAACAGTTCCTGCATGGGCGGCVTGA ACCGGAGGCCCATCCTCACCAT] |
| 4662 | NM_194442.2(LBR): c.1639A > G (p.Asn547Asp) | 3930 | LBR | ['GCCATGATGAGATCACCCAAGTAATYGGG GTGGCGAACAAAGCCCCACCAT'] |
| 4663 | NM_000090.3(COL3A1): c.2284 - 2A > G (p.Gly762_Lys779del) | 1281 | COL3A1 | ['ATTAAAAATATTTTTATTTCCTCTRGGGT CCTACTGGTCCTATTGGTCCT'] |
| 4664 | NM_000090.3(COL3A1): c.997 - 2A > G (p.Gly333_Lys350del+) | 1281 | COL3A1 | ['TCTTGAAATTGTATTTAATTTTTTCRGGGC CCTCCTGGTCCTCCTGGAACT'] |
| 4665 | NM_000090.3(COL3A1): c.3418 - 2A > G (p.Arg1139_Gly1140insVSSTERY YRSTCFRCLHFRKIFWHCDVMI LSW) | 1281 | COL3A1 | ['CATTGTGATGTCATGATACTTTCTTDGGGA CCTGTTGGACCCAGTGGACCT'] |
| 4666 | NM_000090.3(COL3A1): c.997 - 10A > G (p.Pro332_Gly333insFFQ) | 1281 | COL3A1 | ['AAAAGAGCTCTTGAAATTGTATTTARTTTT TTCAGGGGCCCTCCTGGTCCTC'] |
| 4667 | NM_000090.3(COL3A1): c.1870 - 2A > G (p.Gly624_Gln641del) | 1281 | COL3A1 | ['ACAGAGTGTATCATTATACTTTTCTDGGGG CCTGGTGGTGACAAAGGAGAC'] |
| 4668 | NM_000090.3(COL3A1): c.3202 - 2A > G (p.Gly1068_Pro1085del) | 1281 | COL3A1 | ['CTTCTCAATTGAATGTTTTCATCTTRGGGC CCTGCTGGCCCTGCTGGTGCT'] |
| 4669 | NM_000090.3(COL3A1): c.1762 - 2A > G (p.Gly588_Gln605del) | 1281 | COL3A1 | ['AGTAAATACCGACCACTTCTTCTTTRGGGT GCTCCTGGTAAGAATGGAGAA'] |
| 4670 | NM_003611.2(OFD1): c.935 + 706A > G | 8481 | OFD1 | ['CTTTTTGGCAATAATGAAAAGGTAARTTGA TCAAGAGAGGAAATAGGCA'] |
| 4671 | NM_014740.3(EIF4A3): c.809A > G (p.Asp270Gly) | 9775 | EIF4A3 | ['AGTGATGGTCAGTGTGTCGTAGAGGYCAC ACAGAGTGTCAAATTTCCACTC'] |
| 4672 | NM_001040436.2(YARS2): c.1303A > G (p.Ser435Gly) | 51067 | YARS2 | ['TTTGTTACTTGTTGGTGATTTATGCYGACT CCGCCTTCTGTTATCATTCGA'] |
| 4673 | NM_000277.1(PAH): c.1157A > G (p.Tyr386Cys) | 5053 | PAH | ['ACTGTCACGGAGTTCCAGCCCCTCTRTTAC GTGGCAGAGAGTTTTAATGAT'] |
| 4674 | NM_000277.1(PAH): c.812A > G (p.His271Arg) | 5053 | PAH | ['TTCCACTGCACACAGTACATCAGACDTGG ATCCAAGCCCATGTATACCCCC'] |
| 4675 | NM_004820.3(CYP7B1): c.889A > G (p.Thr297Ala) | 9420 | CYP7B1 | ['ATTGCCCAGAACATAGTTGGAATAGYGTT TGCCACAGAGGCCCAGAGAAAG'] |
| 4676 | NM_024301.4(FKRP): c.1A > G (p.Met1Val) | 79147 | FKRP | ['CCAGCTAGCCCCAGACTTCGGCCCCRTGCG GCTCACCCGCTGCCAGGCTGC'] |
| 4677 | NM_001955.4(EDN1): c.271A > G (p.Lys91Glu) | 1906 | EDN1 | ['GTATGGACTTGGAAGCCCTAGGTCCRAGA GAGCCTTGGAGAATTTACTTCC'] |
| 4678 | NM_198947.3(FAM111B): c.1879A > G (p.Arg627Gly) | 374393 | FAM111B | ['TAATGTATACTGTATGTTTACCCAARGAAG TTTCCTATCAGAGGTTTGAA'] |
| 4679 | NM_001282227.1(CECR1): c.1232A > G (p.Tyr411Cys) | 51816 | CECR1 | ['GCCCATGAAGACCTCATAGAAATCAYAGG ACAAGCCTTTGGCACCAAACAT'] |
| 4680 | NM_033419.4(PGAP3): c.914A > G (p.Asp305Gly) | 93210 | PGAP3 | ['TGATTCCTTCAGCAGGTACAGGCTGYCATC TTCCAGAAAGCTGTGGGCCAA'] |
| 4681 | NM_007294.3(BRCA1): c.135 - 2A > G | 672 | BRCA1 | ['TGTTCTTTCTTTCTTTATAATTTATRGATTT TGCATGCTGAAACTTCTCAA'] |
| 4682 | NM_007294.3(BRCA1): c.4676 - 2A > G | 672 | BRCA1 | ['AAATTAAACTTCTCCCATTCCTTTCRGAGG GAACCCCTTACCTGGAATCTG'] |
| 4683 | NM_015474.3(SAMHD1): c.1153A > G (p.Met385Val) | 25939 | SAMHD1 | ['GGAAATGACAATCAAGTTTCTTACAYTGT ATCAATAATGTTGCCAACTTTG'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4684 | NM_015474.3(SAMHD1): c.1411 - 2A > G | 25939 | SAMHD1 | ['TTTTGGAAGAGATTCATAGTCCTCCYGGAA AACACAAGACTCCCCATGTTA'] |
| 4685 | NM_000097.5(CPDX): c.980A > G (p.His327Arg) | 1371 | CPDX | ['ACCAATGCCCCGCCGTTCTCCACGAYGGG CTATAAAGAAGTAATCATCACA'] |
| 4686 | NM_012338.3(TSPAN12): c.413A > G (p.Tyr138Cys) | 23554 | TSPAN12 | ['AAGCCACCGATATCTAGGTAATCCAYAAT TTGTCATCCTGGCTTTCAAAGT'] |
| 4687 | NM_000406.2(GNRHR): c.94A > G (p.Thr32Ala) | 2798 | GNRHR | ['GTCACTCGGATCTTTCCAGACAAGGYCAG AGTGGGAGGTTGCCCTGCATC'] |
| 4688 | NM_199189.2(MATR3): c.1864A > G (p.Thr622Ala) | 9782 | MATR3 | ['TGGTTCCCAGAAGACTGAGAGTTCARCCG AAGGTAAAGAACAAGAAGAGAA'] |
| 4689 | NM_003181.3(T): c.512A > G (p.His171Arg) | 6862 | T | ['CTGTGGACCCCCAACTCTCACTATGYGGAT TCGAGGCTCATACTTATGCAA'] |
| 4690 | NM_000321.2(RB1): c.1927A > G (p.Lys643 Glu) | 5925 | RB1 | ['AGCCTTCCAGACCCAGAAGCCATTGRAAT CTACCTCTCTTTCACTGTTTTA'] |
| 4691 | NM_002234.3(KCNA5): c.143A > G (p.Glu48Gly) | 3741 | KCNA5 | ['GCTGGGCTCAGCGATGGGCCCAAGGRGCC GGCGCCAAAGGGGCGCGGCGCG'] |
| 4692 | NM_178014.3(TUBB): c.895A > G (p.Met299Val) | 203068 | TUBB | ['CCAGCAGGTCTTCGATGCCAAGAACRTGA TGGCTGCCTGTGACCCCCGCCM'] |
| 4693 | NM_000136.2(FANCC): c.-78 - 2A > G | 2176 | FANCC | ['TGCTTCTATTTGTTCCCTTTCTTACRGATTT AATGTGTGCCGACCATTTCC'] |
| 4694 | NM_000546.5(TP53): c.488A > G (p.Tyr163Cys) | 7157 | TP53 | ['CTCCGTCATGTGCTGTGACTGCTTGYAGAT GGCCATGGCGCGGACGCGGGT'] |
| 4695 | NM_000546.5(TP53): c.659A > G (p.Tyr220Cys) | 7157 | TP53 | ['TTTTGACATAGTGTGGTGGTGCCCTVTGAG CCGCCTGAGGTCTGGTTTGCA'] |
| 4696 | NM_000546.5(TP53): c.701A > G (p.Tyr234Cys) | 7157 | TP53 | ['GGCTCTGACTGTACCACCATCCACTRCAAC TACATGTGTAACAGTTCCTGC'] |
| 4697 | NM_002878.3(RAD51D): c.1A > G (p.Met1Val) | -1 | — | ['CACAGTCCGACCCTGAGCACGCCCAYGTT CCCCGCAGGCCGGAACAGCCCC'] |
| 4698 | NM_058216.2(RAD51C): c.706 - 2A > G | 5889 | RAD51C | ['ATCTAATATTATCTCTTCTGTATTTRGGTTC GACTAGTGATAGTGGATGGT'] |
| 4699 | NM_015713.4(RRM2B): c.556A > G (p.Arg186Gly) | 50484 | RRM2B | ['TCTACAGCAGCAAAGGCCACCACTCYTTC CCCTGGGAGACATAAAATCGTT'] |
| 4700 | NM_015713.4(RRM2B): c.581A > G (p.Glu194Gly) | 50484 | RRM2B | ['AAAAGATCCTGAGAAGAAAACTCCTYCTA CAGCAGCAAAGGCCACCACTCT'] |
| 4701 | NM_000219.5(KCNE1): c.242A > G (p.Tyr81Cys) | 3753 | KCNE1 | ['CACTCGAACGACCCATTCAACGTCTDCATC GAGTCCGATGCCTGGCAAGAG'] |
| 4702 | NM_000271.4(NPC1): c.1832A > G (p.Asp611Gly) | 4864 | NPC1 | ['TTCACTGCTGAACGAAGTATTGAAGRTGA ACTAAATCGTGAAAGTGACAGT'] |
| 4703 | NM_000257.3(MYH7): c.1952A > G (p.His651Arg) | 4625 | MYH7 | ['CTGGGGCTGTGTCCCACTCACCCTGYGCAG AGCTGACACAGTCTGAAAGGA'] |
| 4704 | NM_000540.2(RYR1): c.7043A > G (p.Glu2348Gly) | 6261 | RYR1 | ['GGGTGGCCAGGCGAGAGCGTGGAGGRGA ACGCCAATGTGGTGGTGCGGCTG'] |
| 4705 | NM_058216.2(RAD51C): c.1027 - 2A > G | 5889 | RAD51C | ['TTTGTATATATATTTTTTATCTTTCRGCCTC AGGGATTTAGAGATACTGTT'] |
| 4706 | NM_130838.1(UBE3A): c.1694 - 2A > G | 7337 | UBE3A | ['TGTATTTTTAAAAATCATTTCTTATRGGTA TGTTCACATACGATGAATCTA'] |
| 4707 | NM_022168.3(IFIH1): c.1009A > G (p.Arg337Gly) | 64135 | IFIH1 | ['TCCTTGGCAATGTAAACAGCCACTCYGGTT TTTCCACTCCCTGTAGGGAGG'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4708 | NM_022068.3(PIEZO2): c.2134A > G (p.Met712Val) | 63895 | PIEZO2 | ['GCCACACAGAACAGGAACAGCACCAYGTA GATGATTTTGTACATTACGATT'] |
| 4709 | NM_001164342.2(ZBTB20): c.1787A > G (p.His596Arg) | 26137 | ZBTB20 | ['ACCGCCAAACAGAACTACGTCAAGCRCAT GTTCGTACACACAGGTGAGTGT'] |
| 4710 | NM_001128159.2(VPS53): c.2084A > G (p.Gln695Arg) | 55275 | VPS53 | ['TGCCTGATACTACGTCCATCTCACCYGTTC TGCTCCCACCATGCTAATTGG'] |
| 4711 | NM_003108.3(SOX11): c.347A > G (p.Tyr116Cys) | 6664 | SOX11 | ['AAGCACATGGCCGACTACCCCGACTRCAA GTACCGGCCCCGGAAAAAGCCC'] |
| 4712 | NM_020435.3(GJC2): c.-170A > G | 57165 | GJC2 | ['TTCAGACCCTGAGGCCGAGGGGGGARCAA TGGGGCCCTTGAGGGCCCCTCC'] |
| 4713 | NM_004817.3(TJP2): c.1992 - 2A > G | 9414 | TJP2 | ['GATTTACTTCCCGTGGTTTCTTCTCRGAGC TGAACAAATGGCCAGTGTTCA'] |
| 4714 | NM_017565.3(FAM20A): c.720 - 2A > G | -1 | — | ['GGTGTCTCCTCATCTCGCTGCTGTCYGGAA GGAAGGAAGGAATCACGCCCT'] |
| 4715 | NM_002764.3(PRPS1): c.343A > G (p.Met115Val) | 5631 | PRPS1 | ['AATCTCAGCCAAGCTTGTTGCAAATRTGCT ATCTGTAGCAGGTGCAGATCA'] |
| 4716 | NM_000216.2(ANOS1): c.1A > G (p.Met1Val) | 3730 | ANOS1 | ['TCGCCCTCGCCCTCGACCCGCAGCCRTGGT GCCCGGGGTGCCCGGCGCGGT'] |
| 4717 | NM_031229.2(RBCK1): c.1160A > G (p.Asn387Ser) | 10616 | RBCK1 | ['TGGTGCTTCTTTGAGGATGATGTCARTGAG TTCACCTGCCCTGTGTGTTTC'] |
| 4718 | NM_015599.2(PGM3): c.737A > G (p.Asn246Ser) | 5238 | PGM3 | ['CACAAAGTCAGCTCCACATAAATGAYTGA GTTTGCCCTTGGACCCATCATT'] |
| 4719 | NM_015599.2(PGM3): c.1352A > G (p.Gln451Arg) | 5238 | PGM3 | ['TTTCTCTCACACCTGAACTTTAAGTYGTCT GTTTGGAAGATCTGTATAGAG'] |
| 4720 | NM_000535.5(PMS2): c.904 - 2A > G | 5395 | PMS2 | ['CTTTTCTACTCCTTGTATTTTGTGCRGGTCT GCAGACTCGTGAATGAGGTC'] |
| 4721 | NM_000546.5(TP53): c.358A > G (p.Lys120Glu) | 7157 | TP53 | ['GGGCTTCTTGCATTCTGGGACAGCCDAGTC TGTGACTTGCACGGTCAGTTG'] |
| 4722 | NM_000546.5(TP53): c.842A > G (p.Asp281Gly) | 7157 | TP53 | ['CGTGTTTGTGCCTGTCCTGGGAGAGDCCGG CGCACAGAGGAAGAGAATCTC'] |
| 4723 | NM_001128425.1(MUTYH): c.1187 - 2A > G | 4595 | MUTYH | ['CCCCTGCCTGGCTGCCCTCCCTCTCRGGTC TGCTGGCAGGACTGTGGGAGT'] |
| 4724 | NM_000546.5(TP53): c.1101 - 2A > G | 7157 | TP53 | ['TCTCCTCCCTGCTTCTGTCTCCTACRGCCAC CTGAAGTCCAAAAAGGGTCA'] |
| 4725 | NM_000314.6(PTEN): c.493 - 2A > G | 5728 | PTEN | ['GGCTTCTCTTTTTTTCTGTCCACCRGGGA GTAACTATTCCCAGTCAGAGG'] |
| 4726 | NM_000051.3(ATM): c.3994 - 2A > G | 472 | ATM | ['ATATATTTTAATTTTGTGCCCTTGCRGATT GATCACTTATTCATTAGTAAT'] |
| 4727 | NM_000314.6(PTEN): c.403A > G (p.Ile135Val) | 5728 | PTEN | ['TGGAAAGGGACGAACTGGTGTAATGRTAT GTGCATATTTATTACATCGGGG'] |
| 4728 | NM_000249.3(MLH1): c.117 - 2A > G | 4292 | MLH1 | ['TAAATTATTTTCTGTTTGATTTGCCDGTTTA GATGCAAAATCCACAAGTAT'] |
| 4729 | NM_025150.4(TARS2): c.695 + 3A > G | 80222 | TARS2 | ['GGTCCAACAGCAACAGTATATGGGTRAGA GTTGTCAAGATTAAGGCAAACA'] |
| 4730 | NM_206933.2(USH2A): c.10544A > G (p.Asp3515Gly) | 7399 | USH2A | ['TGGACCAAAATAGACAATCTTGAAGVTAC AATTGTCTTAAACTGGAGAAAA'] |
| 4731 | NM_000834.3(GRIN2B): c.1238A > G (p.Glu413Gly) | 2904 | GRIN2B | ['CATCTGAGCATTGTGACCCTGGAGGRGGC ACCATTTGTCATTGTGGAAAGT'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4732 | NM_004830.3(MED23): c.3638A > G (p.His1213Arg) | 9439 | MED23 | ['TGTAGCTATACGTTAGCTCTTGCACRTGCT GTGTGGCACCATTCTAGCATC'] |
| 4733 | NM_003159.2(CDKL5): c.125A > G (p.Lys42Arg) | 6792 | CDKL5 | ['GAAACACATGAAATTGTGGCGATCARGAA ATTCAAGGACAGTGAAGGTAGA'] |
| 4734 | NM_003159.2(CDKL5): c.380A > G (p.His127Arg) | 6792 | CDKL5 | ['CTAATCAAGGCTATTCACTGGTGCCRTAAG AATGATATTGTCCATCGAGGT'] |
| 4735 | NM_003159.2(CDKL5): c.578A > G (p.Asp193Gly) | 6792 | CDKL5 | ['AGCGCTCCCTATGGAAAGTCCGTGGRCAT GTGGTCGGTGGGCTGTATTCTT'] |
| 4736 | NM_198282.3(TMEM173): c.461A < G (p.Asn154Ser) | 340061 | TMEM173 | ['TGACCATGCCAGCCCATGGGCCACGYTGA AATTCCCTTTTTCACACACTGC'] |
| 4737 | NM_032018.6(SPRTN): c.350A > G (p.Tyr117Cys) | 83932 | SPRTN | ['CTCCTGCATGAAATGATACATGCCTRTTTA TTTGTCACTAATAACGACAAA'] |
| 4738 | NM_001759.3(CCND2): c.838A > G (p.Thr280Ala) | 894 | CCND2 | ['GGAGGATGAACTGGACCAAGCCAGCRCCC CTACAGACGTGCGGGATATCGA'] |
| 4739 | NM_007315.3(STAT1): c.854A > G (p.Gln285Arg) | 6772 | STAT1 | ['AGGGTCATGTTCGTAGGTGTATTTCYGTTC CAATTCCTCCAACTTTTTAAG'] |
| 4740 | NM_139276.2(STAT3): c.1175A > G (p.Lys392Arg) | 6774 | STAT3 | ['GTTGGATTCTTCCATGTTCATCACTYTTGT GTTTGTGCCCAGAATGTTAAA'] |
| 4741 | NM_001037811.2(HSD17B10): c.257A > G (p.Asp86Gly) | 3028 | HSD17B10 | ['GATGCCTGCACAGTTGACAGCTACAYCCA CACGGCCAAACTTTCCTTTTGC'] |
| 4742 | NM_005726.5(TSFM): c.57 + 4A > G | 10102 | TSFM | ['CGCGCGGACCGGGAGCTACCCGGTGRGAA GTCCTGGTGCTGGTACCGACCT'] |
| 4743 | NM_000166.5(GJB1): c.580A > G (p.Met194Val) | 2705 | GJB1 | ['CGAGAAAACCGTCTTCACCGTCTTCRTGCT AGCTGCCTCTGGCATCTGCAT'] |
| 4744 | NM_001077494.3(NFKB2): c.2594A > G (p.Asp865Gly) | 4791 | NFKB2 | ['TTACCCCAGCAGAGGTGAAGGAAGRCAG TGCGTACGGGAGCCAGTCAGTG'] |
| 4745 | NC_012920.1: m.5559A > G | 4578 | MT-TW | ['TGTTACAGAAATTAAGTATTGCAACYTACT GAGGGCTTTGAAGGCTCTTGG'] |
| 4746 | NC_012920.1: m.13514A > G | 4540 | MT-ND5 | ['TTCCTCACAGGTTTCTACTCCAAAGRCCAC ATCATCGAAACCGCAAACATA'] |
| 4747 | NM_007315.3(STAT1): c.2018A > G (p.Lys673Arg) | 6772 | STAT1 | ['GTAATACTTTCCAAAGGCATGGTCTYTGTC AATATTTGGATACAGATACTT'] |
| 4748 | NM_007315.3(STAT1): c.1909A > G (p.Lys637 Glu) | 6772 | STAT1 | ['GGGAAAGTAACAGCAGAAAGTTCTTYCTT CGTGTAGGGTTCAACCGCATGG'] |
| 4749 | NM_000060.3(BTD): c.683A > G (p.Asp228Gly) | 686 | BTD | ['GCATTCGATGTTCCTCTTAAAGTGGRTCTC ATCACCTTTGATACCCCCTTT'] |
| 4750 | NM_004992.3(MECP2): c.27 − 2A > G | 4204 | MECP2 | ['TACTTACATACTTGTTTAACACTTCRGGGA AGAAAAGTCAGAAGACCAGGA'] |
| 4751 | NM_004992.3(MECP2): c.378 − 2A > G | 4204 | MECP2 | ['CTTGTGTCTTTCTGTTTGTCCCCACNGTCCC CAGGGAAAAGCCTTTCGCTC'] |
| 4752 | NM_003159.2(CDKL5): c.100 − 2A > G | 6792 | CDKL5 | ['TTTCCTTCTGCTTCTTTTCCCTTGCRGGAAA CACATGAAATTGTGGCGATC'] |
| 4753 | NM_003159.2(CDKL5): c.464 − 2A > G | 6792 | CDKL5 | ['ACAACTTTGGACTTTGCTATCTTTCRGGTT TTGCTCGTAATCTGTCAGAAG'] |
| 4754 | NM_003159.2(CDKL5): c.978 − 2A > G | 6792 | CDKL5 | ['GATATACTTCTTTTGTTTTTAACATRGAAA CCAAGCCGGCAAAAGTACTGC'] |
| 4755 | NM_032492.3(JAGN1): c.485A > G (p.Gln162Arg) | 84522 | JAGN1 | ['TTGGCAGTGCAAGTGCATGCCTGGCRGTTG TACTACAGCAAGAAGCTCCTA'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4756 | NM_178517.3(PIGW): c.499A > G (p.Met167Val) | 284098 | PIGW | ['AACTGAGCTCTATGGGACAGGAGCARTGG ATTTTGGAGTAGGTGGCTTTGT'] |
| 4757 | NM_004387.3(NKX2-5): c.461A > G (p.Glu154Gly) | 1482 | NKX2-5 | ['TCGCAGGCGCAGGTCTATGAGCTGGRCG GCGCTTCAAGCAGCAGCGGTAC'] |
| 4758 | NM_005859.4(PURA): c.289A > G (p.Lys97Glu) | 5813 | PURA | ['CGCCGAGGTGGGCGCGGGCGGCAACRAGA GCCGCCTTACTCTCTCCATGTC'] |
| 4759 | NM_004046.5(ATP5A1): c.962A > G (p.Tyr321Cys) | 498 | ATP5A1 | ['GCGGAGCAACAGAGACATCTGACGGHAAG CAACAGCCTATGGTACAGAATA'] |
| 4760 | NM_000038.5(APC): c.1744 − 2A > G | 324 | APC | ['GATGACCCATATTCTGTTTCTTACTRGGAA TCAACCCTCAAAAGCGTATTG'] |
| 4761 | NM_000751.2(CHRND): c.1319A > G (p.Asp440Gly) | 1144 | CHRND | ['TTCAATGAGCTGAAGCCAGCTGTGGWTGG GGCAAACTTCATTGTTAACCAC'] |
| 4762 | NM_130466.3(UBE3B): c.1A > G (p.Met1Val) | 89910 | UBE3B | ['GCAGGGTTTGTGCAAGTTTGCAAACRTGTT CACCCTGTCTCAGACCTCGAG'] |
| 4763 | NM_003159.2(CDKL5): c.211A > G (p.Asn71Asp) | 6792 | CDKL5 | ['AATGCTTCGGACTCTCAAGCAGGAARACA TTGTGGAGTTGAAGGAAGCATT'] |
| 4764 | NM_003159.2(CDKL5): c.404 − 2A > G | 6792 | CDKL5 | ['AATTTTTTTTTATCTTGACACTCCRGATAT AAAACCAGAAAATCTCTTAA'] |
| 4765 | NM_003159.2(CDKL5): c.449A > G (p.Lys150Arg) | 6792 | CDKL5 | ['TTAATCAGCCACAATGATGTCCTAARACTG TGTGACTTTGGTAAGTTAAAA'] |
| 4766 | NM_001813.2(CENPE): c.4063A > G (p.Lys1355Glu) | 1062 | CENPE | ['ACTTCAAGGGCTTCTTTTATCGTTTYAAGG TTGTCTCTTTCCTTGGTTAGA'] |
| 4767 | NM_023073.3(C5orf42): c.3290 − 2A > G | 65250 | C5orf42 | ['ATTTTACCAAATTTTTGTATTTGATRGATC CCATTGAAGAGGAAGATGCAA'] |
| 4768 | NM_002977.3(SCN9A): c.2215A > G (p.Ile739Val) | −1 | — | ['GTGTTTAAAACTATGCAAATGGTAAYTGC AAGATCTACAAAAGGATCCATT'] |
| 4769 | NM_002354.2(EPCAM): c.556 − 14A > G | 4072 | EPCAM | ['TATTAGTATTAATTTGTATTATTCANTTTTT TTCCCCAGTATGAGAATAAT'] |
| 4770 | NM_002354.2(EPCAM): c.492 − 2A > G | 4072 | EPCAM | ['TTAATACAGATTTTAAATTCTTTACRGTGC ACTTCAGAAGGAGATCACAAC'] |
| 4771 | NM_000053.3(ATP7B): c.122A > G (p.Asn41Ser) | 540 | ATP7B | ['ATCCAGACCACCTTCATAGCCAACAYTGTC AAAAGCAAAACTCTTCTTCAT'] |
| 4772 | NM_022455.4(NSD1): c.4498 − 3A > G | 64324 | NSD1 | ['ATGTGGGACATTATTTTTCTTTGCRAGGG AGAACTAATGCCTCACAGGAC'] |
| 4773 | NM_022455.4(NSD1): c.5893 − 2A > G | 64324 | NSD1 | ['TAAGTCAGGAGGTATTTCTTGTTCTRGGGT GAATTTGTGAATGAGTATGTG'] |
| 4774 | NM_022455.4(NSD1): c.6059A > G (p.Asn2020Ser) | 64324 | NSD1 | ['AAAGGAAACTATGCTCGGTTCATGARTCA TTGCTGCCAGCCCAACTGTGAA'] |
| 4775 | NM_022455.4(NSD1): c.6356A > G (p.Asp2119Gly) | 64324 | NSD1 | ['GGTGAAATCACAAAGGAGCGAGAAGRTGA GTGTTTAGTTGTGGGGATGCT'] |
| 4776 | NM_133433.3(NIPBL): c.737A > G (p.Asp246 Gly) | 25836 | NIPBL | ['AATCCTAGACATGGTTCAAGTGAGGRCTA CCTACACATGGTGCACAGGCTA'] |
| 4777 | NM_133433.3(NIPBL): c.5428 − 2A > G | 25836 | NIPBL | ['TGTTTTTTCTCTTCATTTTTCTTTRGCTTG ATATGCAACGAGGTGTTCAT'] |
| 4778 | NM_005249.4(FOXG1): c.757A > G (p.Asn253Asp) | 2290 | FOXG1 | ['CCACTACGACGACCCGGGCAAGGGCRACT ACTGGATGCTGGACCCGTCGAG'] |
| 4779 | NM_004380.2(CREBBP): c.4508A > G (p.Tyr1503Cys) | 1387 | CREBBP | ['AAGCCAAAACGACTGCAGGAGTGGTRCAA AAAGATGCTGGACAAGGCGTTT'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4780 | NM_004380.2(CREBBP): c.3983 - 2A > G | 1387 | CREBBP | ['CTCACCTGCTCCTTCTGGACTTCCTRGGGC TGCAGACCACAAGACTGGGAA'] |
| 4781 | NM_001083962.1(TCF4): c.991 - 2A > G | 6925 | TCF4 | ['TTTTTTTTTTCTCCTTATTGTTTTARGATCT ATTCTCCAGATCACACTAAC'] |
| 4782 | NM_178151.2(DCX): c.1027 - 2A > G | 1641 | DCX | ['TTAACTTTGTCTCTTCTCTTCTTATRGGACC TGTACCTGCCTCTGTCCTTG'] |
| 4783 | NM_178151.2(DCX): c.607A > G (p.Thr203Ala) | 1641 | DCX | ['TGTGCGTGTGCTTCTGAACAAGAAGRCAG CCCACTCTTTTGAGCAAGTCCT'] |
| 4784 | NM_178151.2(DCX): c.538A > G (p.Lys180Glu) | 1641 | DCX | ['GGAGAACAAGGACTTTGTGCGCCCCRAGC TGGTTACCATCATCCGCAGTGG'] |
| 4785 | NM_178151.2(DCX): c.520A > G (p.Lys174Glu) | 1641 | DCX | ['CAACAGTGCACAGGCCAGGGAGAACRAGG ACTTTGTGCGCCCCAAGCTGGT'] |
| 4786 | NM_178151.2(DCX): c.451A > G (p.Lys151Glu) | 1641 | DCX | ['CAATCCCAACTGGTCTGTCAACGTADAAA CATCTGCCAATATGAAAGCCCC'] |
| 4787 | NM_178151.2(DCX): c.413A > G (p.Tyr138Cys) | 1641 | DCX | ['GACAACTTCTTTAAAAAGGTGGAGTRCAC CAAGAATGTCAATCCCAACTGG'] |
| 4788 | NM_000252.2(MTM1): c.301A > G (p.Ser101Gly) | 4534 | MTM1 | ['AATTGAAAAAATGGGAGGCGCGACARGTA GAGGAGAAAATTCCTATGGTCT'] |
| 4789 | NM_000252.2(MTM1): c.343 - 2A > G | 4534 | MTM1 | ['ACTGTCATACTTCTCCTTTGCCCCCRGGAC ATGAGAAACCTGAGGTTCGCT'] |
| 4790 | NM_000252.2(MTM1): c.529 - 2A > G | 4534 | MTM1 | ['GACTTGAATTTCTTTTTTTCCTCACRGGGCT TGCCCAATCACCATTGGAGA'] |
| 4791 | NM_000252.2(MTM1): c.550A > G (p.Arg184Gly) | 4534 | MTM1 | ['ACAGGGCTTGCCCAATCACCATTGGRGAA TAACTTTTATTAATAAGTGCTA'] |
| 4792 | NM_000252.2(MTM1): c.629A > G (p.Asp210Gly) | 4534 | MTM1 | ['TTGGTGGTTCCGTATCGTGCCTCAGRTGAT GACCTCCGGAGAGTTGCAACT'] |
| 4793 | NM_000252.2(MTM1): c.1406A > G (p.His469Arg) | 4534 | MTM1 | ['CAATTTTTGATTATAATTTTGGATCRTCTGT ATAGTTGCCGATTTGGTACT'] |
| 4794 | NM_003159.2(CDKL5): c.62A > G (p.Glu21Gly) | 6792 | CDKL5 | ['TTTGAGATCCTTGGGGTTGTAGGTGRAGGT AAGTTGGAATTTTTGCGTTCC'] |
| 4795 | NM_006306.3(SMC1A): c.3254A > G (p.Tyr1085Cys) | 8243 | SMC1A | ['GTGGCTACCAACATTGATGAGATCTRTAA GGCCCTGTCCCGCAATAGCAGT'] |
| 4796 | NM_006306.3(SMC1A): c.616 - 2A > G | 8243 | SMC1A | ['CCTGCCACCATTCCCCTGTTTGCACRGGCT GACCGGTACCAGCGCCTGAAG'] |
| 4797 | NM_003937.2(KYNU): c.592A > G (p.Thr198Ala) | 8942 | KYNU | ['GCCTAACTTGATTTAGGGGGAAGAARCCT TAAGAATAGAGGATATCCTTGA'] |
| 4798 | NM_005343.2(HRAS): c.182A > G (p.Gln61Arg) | -1 | - | ['TTGGACATCCTGGATACCGCCGGCCNGGA GGAGTACAGCGCCATGCGGGAC'] |
| 4799 | NM_012275.2(IL36RN): c.104A > G (p.Lys35Arg) | 26525 | IL36RN | ['CTAGCTGGAGGGCTGCATGCAGGGARGGT CATTAAAGGTTGGTGATGAAAC'] |
| 4800 | NM_152296.4(ATP1A3): c.2318A > G (p.Asn773Ser) | 478 | ATP1A3 | ['TCCATTGCCTACACCCTGACCAGCADTATC CCGGAGATCACGCCCTTCCTG'] |
| 4801 | NM_000891.2(KCNJ2): c.953A > G (p.Asn318Ser) | 3759 | KCNJ2 | ['CAGTGCCGTAGCTCTTATCTAGCAARTGAA ATCTGTGGGGCCACCGCTAT] |
| 4802 | NM_017909.3(RMND1): c.713A > G (p.Asn238Ser) | 55005 | RMND1 | ['TACACTTACAGTTTTGTCTTTCACAYTCCA AAACACAGCAGCTCCTTCCCT] |
| 4803 | NM_005154.4(USP8): c.2150A > G (p.Tyr717Cys) | 9101 | USP8 | ['GAACCTTCCAAACTGAAGCGCTCCTDCTCC TCCCCAGATATAACCCAGGCT'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4804 | NM_014191.3(SCN8A): c.667A > G (p.Arg223Gly) | 6334 | SCN8A | ['CAATGTTTCAGCTCTACGCACTTTCRGGGT ACTGAGGGCTTTGAAAACTAT'] |
| 4805 | NM_021830.4(C10orf2): c.1754A > G (p.Asn585Ser) | 56652 | C10orf2 | ['CCCCAGGCAAGCCAGGAAGCAGACARTGT TCTGATCCTGCAGGACAGGAAG'] |
| 4806 | NM_001164405.1(BHLHA9): c.211A > G (p.Asn71Asp) | 727857 | BHLHA9 | ['GTCCAAGGCGCGGCGCATGGCCGCCRACG TGCGGGAGCGCAAGCGCATCCT'] |
| 4807 | NM_002887.3(RARS): c.5A > G (p.Asp2 Gly) | 5917 | RARS | ['GAGTGAGACGCTGATGGGAGGATGGRCGT ACTGGTGTCTGAGTGCTCCGCG'] |
| 4808 | NM_002887.3(RARS): c.1A > G (p.Met1Val) | 5917 | RARS | ['TGGCGAGTGAGACGCTGATGGGAGGRTGG ACGTACTGGTGTCTGAGTGCTC'] |
| 4809 | NM_005861.3(STUB1): c.194A > G (p.Asn65Ser) | 10273 | STUB1 | ['CCGCTGGTGGCCGTGTATTACACCARCCGG GCCTTGTGCTACCTGAAGATG'] |
| 4810 | NM_005211.3(CSF1R): c.2655 - 2A > G | 1436 | CSF1R | ['ATGGGCATCCTCTGTCCTATCTCCCRGATA CAGCATCATGCAGGCCTGCTG'] |
| 4811 | NM_032228.5(FAR1): c.1094A > G (p.Asp365Gly) | 84188 | FAR1 | ['CATAAGGCCCCAGCATTCCTGTATGRTATC TACCTCAGGATGACTGGAAGA'] |
| 4812 | NM_020461.3(TUBGCP6): c.2546A > G (p.Glu849Gly) | 85378 | TUBGCP6 | ['GCCATCCCAGGCAGGCGAGTGTTGCYCTG CAGACCCAGAATCACAGCCTTG'] |
| 4813 | NM_014305.3(TGDS): c.269A > G (p.Glu90Gly) | 23483 | TGDS | ['TTTGTGAAACTGCTTTTTGAAACAGRGAAA ATAGATATAGTACTACATTTT'] |
| 4814 | NM_014305.3(TGDS): c.892A > G (p.Asn298Asp) | 23483 | TGDS | ['TCTGTTTTGTTTTCCAAGACCCACCRATGA CATGAGATACCCAATGAAGTC'] |
| 4815 | NM_000118.3(ENG): c.1273 - 2A > G | 2022 | ENG | ['GCTCGACAGGATATTGACCACCGCCYGCG GGGATAAAGCCAGGGAGCTGGT'] |
| 4816 | NM_005360.4(MAF): c.172A > G (p.Thr58Ala) | 4094 | MAF | ['CATCGCCGGGGCTCGCTGTCCTCCRCCCC CATGAGCACGCCGTGCAGCTC'] |
| 4817 | NM_002238.3(KCNH1): c.1399A > G (p.Ile467Val) | 3756 | KCNH1 | ['ACCTCTAGCACTTCTCTATGCCACCRTCTT CGGGAATGTGACGACTATTTT'] |
| 4818 | NM_172362.2(KCNH1): c.1508A > G (p.Gln503Arg) | 3756 | KCNH1 | ['TTCGGGAATGTGACGACTATTTTCCRACAG ATGTATGCCAACACCAACAGA'] |
| 4819 | NM_003392.4(WNT5A): c.257A > G (p.Tyr86Cys) | 7474 | WNT5A | ['GGACAGAAGAAACTGTGCCACTTGTRTCA GGACCACATGCAGTACATCGGA'] |
| 4820 | NM_001199252.2(SGOL1): c.67A > G (p.Lys23Glu) | -1 | — | ['GCCAAGTTTTTATTCCTTTTCTCTTYCATTC GCTTCTTTATGTCTTCAAGA'] |
| 4821 | NM_000256.3(MYBPC3): c.2906 - 2A > G | 4607 | MYBPC3 | ['ACTTAGCTACCCACTCTATACCCACRGAAC GGCCACGGCTTCAGCTGCCCA'] |
| 4822 | NM_000256.3(MYBPC3): c.1213A > G (p.Met405Val) | 4607 | MYBPC3 | ['GCTCAAGAATGGCCAGGAGATCCAGRTGA GCGGCAGGTGCAGCCTGGGGTG'] |
| 4823 | NM_005188.3(CBL): c.1228 - 2A > G | 867 | CBL | ['TGTTACTATCTTTTGCTTCTTCTGCRGGAAT CAGAAGGTCAGGGCTGTCCT'] |
| 4824 | NM_000257.3(MYH7): c.5326A > G (p.Ser1776Gly) | 4625 | MYH7 | ['TTCTTCATGCGCTCCAGGTGGGCGCYGGTG TCCTGCTCCTTCTTCAGCTCC'] |
| 4825 | NM_000257.3(MYH7): c.2708A > G (p.Glu903Gly) | 4625 | MYH7 | ['CAAGACAACCTGGCAGATGCTGAGGRGCG CTGTGATCAGCTGATCAAAAAC'] |
| 4826 | NM_000257.3(MYH7): c.1727A > G (p.His576Arg) | 4625 | MYH7 | ['AATATCAAGGGGAAGCCTGAAGCCCRCTT CTCCCTGATCCACTATGCCGGC'] |
| 4827 | NM_000257.3(MYH7): c.1496A > G (p.Glu499Gly) | 4625 | MYH7 | ['CACCACATGTTTGTGCTGGAGCAGGRGGA GTACAAGAAGGAGGGCATCGAG'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4828 | NM_000257.3(MYH7): c.2539A > G (p.Lys847Glu) | 4625 | MYH7 | ['GCTGCTGAAGAGTGCAGAAAGAGAGRAGG AGATGGCCTCCATGAAGGAGGA'] |
| 4829 | NM_000257.3(MYH7): c.1954A > G (p.Arg652Gly) | 4625 | MYH7 | ['CTTTCAGACTGTGTCAGCTCTGCACRGGGT GAGTGGGACACAGCCCCAGCC'] |
| 4830 | NM_000257.3(MYH7): c.1157A > G (p.Tyr386Cys) | 4625 | MYH7 | ['CTTCCAGAGGCTGACAAGTCTGCCTRCCTC ATGGGGCTGAACTCAGCCGAC'] |
| 4831 | NM_000501.3(ELN): c.800 - 2A > G | 2006 | ELN | ['TACATTGCACTGTCCCCATCTCAACRGGTG CTGGAGCAGCCGGAGTCCTCC'] |
| 4832 | NM_000117.2(EMD): c.266 - 2A > G | 2010 | EMD | ['TCTGCTACCGCTGCCCCCCTTCCCARGGCT ACAATGACGACTACTATGAAG'] |
| 4833 | NM_000191.2(HMGCL): c.698A > G (p.His233Arg) | 3155 | HMGCL | ['GTGCCTCTGGCTGCCCTGGCTGTCCRCTGC CATGACACCTATGGTCAAGCC'] |
| 4834 | NM_207352.3(CYP4V2): c.1393A > G (p.Arg465Gly) | 285440 | CYP4V2 | ['CTACGTGCCCTTCTCTGCTGGCCCCRGGAA CTGTATAGGTTTGTATCCATC'] |
| 4835 | NM_013382.5(POMT2): c.1726 - 2A > G | 29954 | POMT2 | ['GTCAGCAGGGTGGTCTCTATTCCACRGGGC CTACGCTTCTCAGGGGTCAAT'] |
| 4836 | NM_000169.2(GLA): c.802 - 2A > G | -1 | — | ['TTTGAATTATTTCATTCTTTTTCTCRGTTAG TGATTGGCAACTTTGGCCTC'] |
| 4837 | NM_020166.4(MCCC1): c.137 - 2A > G | 56922 | MCCC1 | ['GTGTGATTTTCATGGTGTTTTAAACRGGAA GAAACATTACCAAGGTCCTCA'] |
| 4838 | NM_006920.4(SCN1A): c.2557 - 2A > G | 6323 | SCN1A | ['AATATATATTAATCTTTCATTTTCCRGCTG CGAGTTTTCAAGTTGGCAAAA'] |
| 4839 | NM_000501.3(ELN): c.890 - 2A > G | 2006 | ELN | ['CCTCACCCTCTGTGGCTGTGTTTTCRGGCG TTGGGACTCCAGCTGCAGCTG'] |
| 4840 | NM_006306.3(SMC1A): c.2974 - 2A > G | 8243 | SMC1A | ['TGACATTGCTGGGCCTGGGGCTTACRGGAT GCCCAGGCTGAGGAAGAGATC'] |
| 4841 | NM_001110792.1(MECP2): c.520A > G (p.Arg174Gly) | 4204 | MECP2 | ['TGATTTTGACTTCACGGTAACTGGGRGAGG GAGCCCCTCCCGGCGAGAGCA'] |
| 4842 | NM_004646.3(NPHS1): c.1756A > G (p.Arg586Gly) | 4868 | NPHS1 | ['CTTGTCCTGGGACAAGGAAGGGGAGRGGT GGGAGTGCGAGGGATCCCTCCC'] |
| 4843 | NM_003002.3(SDHD): c.275A > G (p.Asp92 Gly) | 6392 | SDHD | ['TATTTGAATCCTTGCTCTGCGATGGRCTAT TCCCTGGCTGCAGCCCTCACT'] |
| 4844 | NM_004793.3(LONP1): c.2353A > G (p.Arg785Gly) | 9361 | LONP1 | ['CACGCTGTTTGTGGAGACATCCCTGRGACG GCCACAGGACAAGGATGCCAA'] |
| 4845 | NC_012920.1: m.4279A > G | 4565 | MT-TI | ['TCAAACCTAAGAAATATGTCTGATARAAG AGTTACTTTGATAGAGTAAATA'] |
| 4846 | NM_005633.3(SOS1): c.1430A > G (p.Gln477Arg) | 6654 | SOS1 | ['ATTTGCTGTAAATCAAATCATGGGCRGCCA AGACTTCCTGGTGCTAGCAAT'] |
| 4847 | NM_000256.3(MYBPC3): c.1227 - 2A > G | 4607 | MYBPC3 | ['TGCCACTTCCCTGCGGCCCCCACCCRGGTA CATCTTTGAGTCCATCGGTGC'] |
| 4848 | NM_002834.3(PTPN11): c.661A > G (p.Ile221Val) | 5781 | PTPN11 | ['CGATCAGCCCCTTAACACGACTCGTDTAA ATGCTGCTGAAATAGAAAGCAG'] |
| 4849 | NM_000257.3(MYH7): c.4664A > G (p.Glu1555Gly) | -1 | — | ['TCCCAGGCCTCCCTGGAGCACGAGGRGGG CAAGATCCTCCGGGCCCAGCTG'] |
| 4850 | NM_000257.3(MYH7): c.2792A > G (p.Glu931Gly) | 4625 | MYH7 | ['AACGAGAGGCTGGAGGATGAGGAGGRGA TGAATGCTGAGCTCACTGCCAAG'] |
| 4851 | NM_000257.3(MYH7): c.2087A > G (p.Asn696Ser) | 4625 | MYH7 | ['CTGGTCATGCACCAGCTGCGCTGCARTGGT GTGCTGGAGGGCATCCGCATC'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4852 | NM_000257.3(MYH7): c.1805A > G (p.Asn602Ser) | 4625 | MYH7 | ['CTGCAGAAGAACAAGGATCCTCTCARTGA GACTGTCGTGGGCTTGTATCAG'] |
| 4853 | NM_000257.3(MYH7): c.1615A > G (p.Met539Val) | 4625 | MYH7 | ['CATGTCCATCCTGGAAGAGGAGTGCRTGTT CCCCAAGGCCACCGACATGAC'] |
| 4854 | NM_000257.3(MYH7): c.1477A > G (p.Met493Val) | 4625 | MYH7 | ['GCTGCAGCAGTTCTTCAACCACCACRTGTT TGTGCTGGAGCAGGAGGAGTA'] |
| 4855 | NM_000257.3(MYH7): c.1331A > G (p.Asn444Ser) | 4625 | MYH7 | ['TTCAACTGGATGGTGACGCGCATCAVTGC CACCCTGGAGACCAAGCAGCCA'] |
| 4856 | NM_000257.3(MYH7): c.1315A > G (p.Met439Val) | 4625 | MYH7 | ['AGGGTGGCATTGATGCGCGTCACCAHCCA GTTGAACATCCTCTCATACACT'] |
| 4857 | NM_000257.3(MYH7): c.1051A > G (p.Lys351Glu) | 4625 | MYH7 | ['TTCAGAGGAGAAAAACTCCATGTATRAGC TGACAGGCGCCATCATGCACTT'] |
| 4858 | NM_000257.3(MYH7): c.789A > G (p.Ile263Met) | 4625 | MYH7 | ['CAGGAAAGTTGGCATCTGCAGACATRGAG ACCTGTGAGTGCCATGAATCTG'] |
| 4859 | NM_000257.3(MYH7): c.617A > G (p.Lys206Arg) | 4625 | MYH7 | ['ATTGCAGCCATTGGGGACCGCAGCARGAA GGACCAGAGCCCGGGCAAGGTA'] |
| 4860 | NM_000363.4(TNNI3): c.616A > G (p.Lys206Glu) | 7137 | TNNI3 | ['ACTGAGTGGAATGGAGGGCCGCAAGVAAA AGTTTGAGAGCTGAGCCTTCCT'] |
| 4861 | NM_000363.4(TNNI3): c.547A > G (p.Lys183Glu) | 7137 | TNNI3 | ['GCAGGTGAAGAAGGAGGACACCGAGRAG GTGAGTGTGGGCTAAGGCCAGGA'] |
| 4862 | NM_000169.2(GLA): c.370 - 2A > G | -1 | — | ['TGACTCTTTTCCTCCCTCTCATTTCRGGTTC ACAGCAAAGGACTGAAGCTA'] |
| 4863 | NM_000051.3(ATM): c.1A > G (p.Met1Val) | 472 | ATM | ['GATGTGTGTTCTGAAATTGTGAACCVTGAG TCTAGTACTTAATGATCTGCT'] |
| 4864 | NM_000051.3(ATM): c.3154 - 2A > G | 472 | ATM | ['TATTTAACCACAGTTCTTTTCCCGTRGGCT GATCCTTATTCAAAATGGGCC'] |
| 4865 | NM_024675.3(PALB2): c.212 - 2A > G | 79728 | PALB2 | ['AGTTATATACATTTTTTCCTCCTCRGAAC CTAAAAATAAAATATGTGTTT'] |
| 4866 | NM_024675.3(PALB2): c.109 - 2A > G | 79728 | PALB2 | ['TTCTGGGGCTGTTTTTGTCTCCTCTRGCGTG CCCAAAGAGCTGAAAAGATT'] |
| 4867 | NM_000546.5(TP53): c.709A > G (p.Met237Val) | 7157 | TP53 | ['CTGTACCACCATCCACTACAACTACRTGTG TAACAGTTCCTGCATGGGCGG'] |
| 4868 | NM_000455.4(STK11): c.889A > G (p.Arg297Gly) | 6794 | STK11 | ['GATGCTTGAGTACGAACCGGCCAAGRGGT TCTCCATCCGGCAGATCCGGCA'] |
| 4869 | NM_017777.3(MKS1): c.1382A > G (p.Tyr461Cys) | 54903 | MKS1 | ['TCTCTGGAACTGGAGGACCTCTCCRTGTA CGGATACCAGGATCCTTCAAG'] |
| 4870 | NM_001231.4(CASQ1): c.731A > G (p.Asp244Gly) | 844 | CASQ1 | ['ATGGAAGAGCCTGTGACCATCCCAGRCAA GCCCAATAGCGAAGAGGAGATT'] |
| 4871 | NM_001242896.1(DEPDC5): c.2355 - 2A > G (p.Arg785_Gly839del) | 9681 | DEPDC5 | ['GTATGAGCAATCATCTGTTGTTTTCRGGAG GGACGAAGATGGTGTGCAGAT'] |
| 4872 | NM_001039550.1(DNAJB2): c.14A > G (p.Tyr5Cys) | 3300 | DNAJB2 | ['TGACCAGTTGCCATGGCATCCTACTRCGAG ATCCTAGACGTGCCGCGAAGT'] |
| 4873 | NM_007294.3(BRCA1): c.5057A > G (p.His1686Arg) | 672 | BRCA1 | ['AATCTAATTACTGAAGAGACTACTCRTGTT GTTATGAAAACAGGTATACCA'] |
| 4874 | NM_006888.4(CALM1): c.389A > G (p.Asp130Gly) | 801 | CALM1 | ['GTAGATGAAATGATCAGAGAAGCAGRTAT TGATGGAGACGGACAAGTCAAC'] |
| 4875 | NM_001082538.2(TCTN1): c.342 - 2A > G | 79600 | TCTN1 | ['TTGTATTATTATTTTTTAATTTTCRGGGGC GACAGCCAGTTTTGTAGTCA'] |

TABLE 7-continued

Diseases/disorders containging A to G Changes.The table includes human gene mutations that may be corrected by changing a guanine (G) to adenine (A).The gene name, gene symbol, and Gene ID are indicated.

| SEQ ID NO: | Name | Gene ID | Gene Symbol | Flanks |
|---|---|---|---|---|
| 4876 | NM_003000.2(SDHB): c.541 − 2A > G | 6390 | SDHB | ['TCCTGCCTCTCTTTTCTCCCCATACRGGAC GGGCTCTACGAGTGCATTCTC'] |
| 4877 | NM_000143.3(FH): c.700A > G (p.Thr234Ala) | 2271 | FH | ['AGTGGAACAGCATCCTGAGTATGAGYACG TCCAATCTTGATGATCTGTGCA'] |
| 4878 | NM_000038.5(APC): c.221 − 2A > G | 324 | APC | ['ATAAAAACTTGTTTCTATTTTATTTRGAGC TTAACTTAGATAGCAGTAATT'] |
| 4879 | NM_000314.6(PTEN): c.527A > G (p.Tyr176Cys) | 5728 | PTEN | ['ATTCCCAGTCAGAGGCGCTATGTGTRTTAT TATAGCTACCTGTTAAAGAAT'] |
| 4880 | NM_030813.5(CLPB): c.1850A > G (p.Tyr617Cys) | 81570 | CLPB | ['CTGGTCGACGGCTACAATGTGCACTRTGGC GCCCGCTCCATCAAACATGAG'] |
| 4881 | NM_030813.5(CLPB): c.1222A > G (p.Arg408Gly) | 81570 | CLPB | ['TCCTGGAACTCGGACATGTCCAGCCHGAT GAAGCCCTGTGTGGAAACAAGC'] |
| 4882 | NM_016069.9(PAM16): c.226A > G (p.Asn76Asp) | −1 | — | ['CTCACCCGTCCCTCTCCTCTGCAGRACTA TGAACACTTATTTAAGGTGAA'] |
| 4883 | NM_058163.1(TSR2): c.191A > G (p.Glu64Gly) | 90121 | TSR2 | ['TACTTAGCTGACTTGGAGCTAGATGRGGTG GAAGACTTCCTTGGAGAGCTG'] |
| 4884 | NM_001031.4(RPS28): c.1A > G (p.Met1Val) | 6234 | RPS28 | ['ATAGGCTGCACACGGCTGGTGTCCAYGAT GGCGGCGCGGCGGCGGTCTGGC'] |
| 4885 | NM_005957.4(MTHFR): c.1114A > G (p.Lys372Glu) | 4524 | MTHFR | ['TCCCATCTTCTGGGCCTCCAGACCARAGAG TTACATCTACCGTACCCAGGA'] |
| 4886 | NM_014946.3(SPAST): c.1165A > G (p.Thr389Ala) | 6683 | SPAST | ['CTTTGGTCCACCTGGGAATGGGAAGRCAA TGCTGGTAAGGGTTCTCTTCAA'] |
| 4887 | NM_000228.2(LAMB3): c.565 − 2A > G | 3914 | LAMB3 | ['TAAATCCATAAGGTTAAGTTGGACCYACA GAGGGAAGGGAAAGAGAAGCGC'] |
| 4888 | NM_000492.3(CFTR): c.3368 − 2A > G | 1080 | CFTR | ['TCATTTACGTCTTTTGTGCATCTATDGGAG AAGGAGAAGGAAGAGTTGGTA'] |
| 4889 | NM_006785.3(MALT1): c.1019 − 2A > G | 10892 | MALT1 | ['AACACCCCCTTTCTTTTTTTTCAARGCGA AGGACAAGGTTGCCCTTTTGA'] |
| 4890 | NM_004771.3(MMP20): c.611A > G (p.His204Arg) | 9313 | MMP20 | ['GGAGAAGGCCTGGGAGGAGATACACRTTT CGACAATGCTGAGAAGTGGACT'] |
| 4891 | NM_000918.3(P4HB): c.1178A > G (p.Tyr393Cys) | 5034 | P4HB | ['CACCCTAGAACTGCTTTCTTTTCAGRTGCC CCATGGTGTGGTCACTGCAAA'] |
| 4892 | NM_177405.2(CECR1): c.355A > G (p.Thr119Ala) | 51816 | CECR1 | ['TGCTCGCATCCCGCAGGCTCACCTGYTTCT CCGGCGTGGAAGAAGTAAGGC'] |
| 4893 | NM_004990.3(MARS): c.1031A > G (p.Tyr344Cys) | 4141 | MARS | ['TACCACATCATCCATGCTGACATCTRCCGC TGGTTTAACATTTCGTTTGAT'] |
| 4894 | NM_025132.3(WDR19): c.407 − 2A > G | 57728 | WDR19 | ['TCTGTATAAAAATAATCTCTTTTTCRGGAA AACATACTAAGAGAATCACTT'] |
| 4895 | NM_000314.6(PTEN): c.139A > G (p.Arg47Gly) | 5728 | PTEN | ['TGCAGAAAGACTTGAAGGCGTATACRGGA ACAATATTGATGATGTAGTAAG'] |
| 4896 | NM_000314.6(PTEN): c.182A > G (p.His61Arg) | 5728 | PTEN | ['GTTTTAAGGTTTTTGGATTCAAAGCDTAAA AACCATTACAAGATATACAAT'] |
| 4897 | NM_000314.6(PTEN): c.254 − 2A > G | 5728 | PTEN | ['TATTCTGAGGTTATCTTTTTACCACRGTTG CACAATATCCTTTTGAAGACC'] |
| 4898 | NM_000314.6(PTEN): c.320A > G (p.Asp107Gly) | 5728 | PTEN | ['GAACTTATCAAACCCTTTTGTGAAGRTCTT GACCAATGGCTAAGTGAAGAT'] |
| 4899 | NM_000314.6(PTEN): c.512A > G (p.Gln171Arg) | 5728 | PTEN | ['CACCAGGGAGTAACTATTCCCAGTCRGAG GCGCTATGTGTATTATTATAGC'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4900 | NM_000314.6(PTEN): c.802 − 2A > G | 5728 | PTEN | ['TTTTCTTTTCTTTTTTTTTTTTTTDGGACAA AATGTTTCACTTTTGGGTA'] |
| 4901 | NM_001103.3(ACTN2): c.1883A > G (p.Glu628Gly) | 88 | ACTN2 | ['ATCCGCGATCAATCCCTGCAGGAGGRGCT GGCTCGCCAGCATGCTAACGAG'] |
| 4902 | NM_003159.2(CDKL5): c.462 − 2A > G | 6792 | CDKL5 | ['GCTTTTAATTGTGTTTGTTTTTTTCRGGGAG TCATTTAATACTTCATGATT'] |
| 4903 | NM_003159.2(CDKL5): c.91A > G (p.Arg31Gly) | 6792 | CDKL5 | ['AGCCTATGGAGTTGTACTTAAATGCRGAC ACAAGGCAAGTACATTATTTTT'] |
| 4904 | NM_003159.2(CDKL5): c.458A > G (p.Asp153Gly) | 6792 | CDKL5 | ['CACAATGATGTCCTAAAACTGTGTGRCTTT GGTAAGTTAAAAAGAAATTAA'] |
| 4905 | NM_003159.2(CDKL5): c.2277 − 2A > G | 6792 | CDKL5 | ['ATATGATAAAAATGTCTTCTCATTTRGGAA AAGTCCTGAAAATATTAGTCA'] |
| 4906 | NM_021098.2(CACNA1H): c.4645A > G (p.Met1549Val) | 8912 | CACNA1H | ['CATCGTCAGCTTCTTCGTGCTCAACRTGTT CGTGGGCGTCGTGGTCGAGAA'] |
| 4907 | NM_003816.2(ADAM9): c.1396 − 2A > G | 8754 | ADAM9 | ['TGTTTAATTTGAATTCTATTTCACTRGTTCC TTCCAGGAGGTACTTTATGC'] |
| 4908 | NM_212472.2(PRKAR1A): c.177 + 3A > G | 5573 | PRKAR1A | ['AATACTTTGAGAGGTTGGAGAAGGTRAAA ATAAATGTGGGGAGATGATGAG'] |
| 4909 | NM_001204830.1(LIPT1): c.535A > G (p.Thr179Ala) | −1 | — | ['CCGGACTACTGCCTATCACCATTGCRCTTT ATTATGTAGTACTGATGGGAC'] |
| 4910 | NM_001165963.1(SCN1A): c.5264A > G (p.Asp1755Gly) | −1 | — | ['AACCCTGGAAGCTCAGTTAAGGGAGRCTG TGGGAACCCATCTGTTGGAATT'] |
| 4911 | NM_001165963.1(SCN1A): c.3880 − 2A > G | −1 | — | ['TAATTGTTATTATTTTTGTGTGTGCRGGTTT CATTGGTCAGTTTAACAGCA'] |
| 4912 | NM_001165963.1(SCN1A): c.2537A > G (p.Glu846Gly) | 6323 | SCN1A | ['TTTATTGTGACGCTTAGCCTGGTAGRACTT GGACTCGCCAATGTGGAAGGA'] |
| 4913 | NM_001165963.1(SCN1A): c.2353A > G (p.Met785Val) | 6323 | SCN1A | ['GTCATTGGATAGTGCTCCATGGCCAHGAA AAGAGTATTTAAGACAATACAG'] |
| 4914 | NM_001165963.1(SCN1A): c.1662 + 3A > G | 6323 | SCN1A | ['AGAGGTACTCCTCCCCACACCAGGTRTGG CACTGCTGAGTTTACTGATGCA'] |
| 4915 | NM_001165963.1(SCN1A): c.1076A > G (p.Asn359Ser) | 6323 | SCN1A | ['TGTGTGAAAGCTGGTAGAAATCCCADTTA TGGCTACACAAGCTTTGATACC] |
| 4916 | NM_001165963.1(SCN1A): c.1048A > G (p.Met350Val) | 6323 | SCN1A | ['TTGCAGCCAATGTCCAGAGGGATATRTGT GTGTGAAAGCTGGTAGAAATCC'] |
| 4917 | NM_001165963.1(SCN1A): c.1046A > G (p.Tyr349Cys) | 6323 | SCN1A | ['ACTTGCAGCCAATGTCCAGAGGGATRTAT GTGTGTGAAAGCTGGTAGAAAT'] |
| 4918 | NM_001165963.1(SCN1A): c.433A > G (p.Met145Val) | 6323 | SCN1A | ['CACTATTTTGACAAACTGTGTGTTTRTGAC AATGAGTAACCCTCCTGATTG'] |
| 4919 | NM_001165963.1(SCN1A): c.383 + 1A > G | 6323 | SCN1A | ['TAGCTATTAAGATTTTGGTACATTCRTATC CTTTTTCAAGTGATTAATATT'] |
| 4920 | NM_001605.2(AARS): c.2251A > G (p.Arg751Gly) | 16 | AARS | ['TCGGCACCTGTGACAGCCACAATCCYCCG GATACCCTTGGCAATGGCTTCT'] |
| 4921 | NM_000124.3(ERCC6): c.2830 − 2A > G | 2074 | ERCC6 | ['TATTCTCCATGCTCGCTCCCGGGCCYGCAA CAGAGAGAGAGACCTCTCA'] |
| 4922 | NM_000124.3(ERCC6): c.2599 − 26A > G | 2074 | ERCC6 | ['ACTGGGAATGTGTATTTGCTTTGCAVACTC CTATCCCCCACCTCCAAACAG'] |
| 4923 | NM_001110556.1(FLNA): c.1829 − 2A > G | 2316 | FLNA | ['ACTGAGGGGACTGGTGGCTGTTGTCRGGC TTCTCGGTGGAAGGGCCATCGC'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4924 | NM_006129.4(BMP1): c.808A > G (p.Met270Val) | 649 | BMP1 | ['GGAGACCTATGACTTCGACAGCATCRTGC ATTACGCTCGGAACACATTCTC'] |
| 4925 | NM_001987.4(ETV6): c.1252A > G (p.Arg418Gly) | 2120 | ETV6 | ['GGAGCCAGGACAAAGGCTTTTGTTCRGGT AGCACTTCCTTTTTCTCCTTTC'] |
| 4926 | NM_014423.3(AFF4): c.760A > G (p.Thr254Ala) | 27125 | AFF4 | ['GTCCAATTCAATGTTACAGAAACCCRCTGC CTATGTGCGGCCCATGGACGG'] |
| 4927 | NM_002055.4(GFAP): c.1085A > G (p.Glu362Gly) | 2670 | GFAP | ['AATGTCAAGCTGGCCCTGGACATCGRGAT CGCCACCTACAGGAAGCTGCTA'] |
| 4928 | NM_002055.4(GFAP): c.256A > G (p.Lys86Glu) | 2670 | GFAP | ['TGACCGCTTTGCCAGCTACATCGAGRAGGT TCGCTTCCTGAACAGCAAAA'] |
| 4929 | NM_006017.2(PROM1): c.2077 - 521A > G | 8842 | PROM1 | ['ATTTGCTGTTCTTCACAGCTTTAGGRTATG TATCCAATGTTTTCTTCAGGT'] |
| 4930 | NM_002755.3(MAP2K1): c.305A > G (p.Glu102Gly) | 5604 | MAP2K1 | ['ACCTTTCTCCAGCTAATTCATCTGGRGATC AAACCCGCAATCCGGAACCAG'] |
| 4931 | NM_001288953.1(TTC7A): c.1715A > G (p.Lys572Arg) | 57217 | TTC7A | ['CGTCCCCACAGCCTGATGTTCACCARGGTG AAGCTGGAGCAGGTGCTGAAA'] |
| 4932 | NM_016218.2(POLK): c.181A > G (p.Asn61Asp) | 51426 | POLK | ['TGAGCTCAAGAAAGAAAAGCAAGTCRACC AACGAATTGAAAATATGATGCA'] |
| 4933 | NM_016218.2(POLK): c.1385A > G (p.Asn462Ser) | 51426 | POLK | ['AGAACTGTTACCATTAAGTTGAAGARTGT GAATTTTGAAGTAAAAACTCGT'] |
| 4934 | NM_016218.2(POLK): c.1477A > G (p.Lys493Glu) | 51426 | POLK | ['ATTTGCCATTGCTAAGGAATTGCTARAAAC AGAAATTGATGCTGATTTTCC'] |
| 4935 | NM_001040431.2(COA3): c.215A > G (p.Tyr72Cys) | 28958 | COA3 | ['GGAAATCGAGTAGAAGGTGTAACCAYCTG GGGAGGTAGGTTCAGGAAACCA'] |
| 4936 | NM_000891.2(KCNJ2): c.901A > G (p.Met301Val) | 3759 | KCNJ2 | ['TGAAATCGTGGTCATACTGGAAGGCRTGG TGGAAGCCACTGCCATGACGAC'] |
| 4937 | NM_144499.2(GNAT1): c.386A > G (p.Asp129Gly) | 2779 | GNAT1 | ['GACATCATCCAGCGGCTGTGGAAGGRCTC CGGTATCCAGGCCTGTTTTGAG'] |
| 4938 | NM_018965.3(TREM2): c.113A > G (p.Tyr38Cys) | 54209 | TREM2 | ['CAGTCCCTGCAGGTGTCTTGCCCCRTGAC TCCATGAAGCACTGGGGGAGG'] |
| 4939 | NM_194277.2(FRMD7): c.556A > G (p.Met186Val) | 90167 | FRMD7 | ['ACTGGACATAGCAAGGAAGCTGGATRTGT ATGGCATCAGGCCTCACCCCGC'] |
| 4940 | NM_001003811.1(TEX11): c.511A > G (p.Met171Val) | 56159 | TEX11 | ['TCACTCTCAACAGTAATCTTCTCCAYGGTC AAGTCAGCCTCAGGGGAGCTC'] |
| 4941 | NM_000921.4(PDE3A): c.1333A > G (p.Thr445Ala) | 5139 | PDE3A | ['AGTTTCTTCCACTTGGACCACCACRCCTC GGCCACAGGTCTACCCACCTT'] |
| 4942 | NM_000033.3(ABCD1): c.887A > G (p.Tyr296Cys) | 215 | ABCD1 | ['GCCAACTCGGAGGAGATCGCCTTCTRTGG GGGCCATGAGGTGGGCAGGTT'] |
| 4943 | NM_000169.2(GLA): c.137A > G (p.His46Arg) | -1 | — | ['AGGACGCCTACCATGGGCTGGCTGCDCTG GGAGCGCTTCATGTGCAACCTT'] |
| 4944 | NM_000033.3(ABCD1): c.1992 - 2A > G | 215 | ABCD1 | ['CCCTGACCCTGTCCCTCTCCTGGCCRGGAA ATACCACACACTTGCTACA'] |
| 4945 | NM_000182.4(HADHA): c.919 - 2A > G | 3030 | HADHA | ['TTGCTCAATTCCAGTCTTTACCACCYAAAA AACATATAAAGCACTTGCTCA'] |
| 4946 | NM_000159.3(GCDH): c.1213A > G (p.Met405Val) | 2639 | GCDH | ['CGAGTATCACGTGATCCGGCACGCCRTGA ACCTGGAGGCCGTGAACACCTA'] |
| 4947 | NM_004006.2(DMD): c.1150 - 2A > G | 1756 | DMD | ['ACAATTGTTAACTTCCTTCTTTGTCRGGGG TACATGATGGATTTGACAGCC'] |

TABLE 7-continued

Diseases/disorders containging A to G Changes. The table includes human gene
mutations that may be corrected by changing a guanine (G) to adenine (A). The gene name,
gene symbol, and Gene ID are indicated.

| SEQ ID NO: | Name | Gene ID | Gene Symbol | Flanks |
|---|---|---|---|---|
| 4948 | NM_019109.4(ALG1): c.1188 − 2A > G | 56052 | ALG1 | ['CTCAGGCTCCCTTGGTTCTCTCTGCRGTTT ACATGAGCTGGTGAAACATGA'] |
| 4949 | NM_004463.2(FGD1): c.2016 − 2A > G | 2245 | FGD1 | ['TCTTTCTTTTTTATTCCCCACCCCARGGACT GAGGAGGAGAAGAAAGACTG'] |
| 4950 | NM_198525.2(KIF7): c.2981A > G (p.Gln994Arg) | 374654 | KIF7 | ['CTGCTGCTGGCTCTGGGCGCTGCCCYGCCG CAGCTGCCCGCTCTTCTCGGA'] |
| 4951 | NM_020366.3(RPGRIP1): c.3749 − 2A > G | 57096 | RPGRIP1 | ['ATGCGTTTTTTCCCTTTCCCAACRGTTGT TAGCCCTGAAGATCTGGCTA'] |
| 4952 | NM_003494.3(DYSF): c.3041A > G (p.Tyr1014Cys) | 8291 | DYSF | ['GTTCCCCCTCCCCCAGGCTGGGAGTRTAGC ATCACCATCCCCCCGGAGCGG'] |
| 4953 | NM_003494.3(DYSF): c.3349 − 2A > G | 8291 | DYSF | ['CTGCCATAACCAGCTTCGTGTCTCCRGGGC GGCGTGATGGATGACAAGAGT'] |
| 4954 | NM_004006.2(DMD): c.4675 − 2A > G | 1756 | DMD | ['ATTACATTTCATTATAATTCTTTTCRGGTA ACAGAAAGAAAGCAACAGTTG'] |
| 4955 | NM_000169.2(GLA): c.620A > G (p.Tyr207Cys) | −1 | — | ['GTGTACTCCTGTGAGTGGCCTCTTTRTATG TGGCCCTTTCAAAAGGTGAGA'] |
| 4956 | NM_022124.5(CDH23): c.146 − 2A > G | −1 | — | ['CTCTGCTCTCTCCCTTGGCTACTCCRGGTTC TTCTGTGACCCAGTTGCTGG'] |
| 4957 | NM_000169.2(GLA): c.801 + 3A > G | −1 | — | ['GGGGTTGGAATGACCCAGATATGGTRAAA ACTTGAGCCCTCCTTGTTCAAG'] |
| 4958 | NM_000019.3(ACAT1): c.473A > G (p.Asn158Ser) | 38 | ACAT1 | ['GCAGGTGGGATGGAGAGCATGTCCARTGT TCCATATGTAATGAACAGAGGA'] |
| 4959 | NM_000553.4(WRN): c.561A > G (p.Lys187=) | 7486 | WRN | ['GTCTGGTTAAACACCTCTTAGGTAARCAGC TCCTGAAAGCAAGTCTATCC'] |
| 4960 | NM_000050.4(ASS1): c.421 − 2A > G | 445 | ASS1 | ['GGCTCTGACCCCTTGTCCTATGTCCDGGTC ATTGCTCCCTGGAGGATGCCT'] |
| 4961 | NM_020166.4(MCCC1): c.640 − 2A > G | 56922 | MCCC1 | ['TTCTGATCTAACAATCCTCATTCCCYAAGA GAGAAAAGATGATTATGACTA'] |
| 4962 | NM_004006.2(DMD): c.10554 − 2A > G | 1756 | DMD | ['TCTTTTTTACTTTTTTGATGCCAATRGGAAT CTGCAAGCAGAATATGACCG'] |
| 4963 | NM_017653.3(DYM): c.621 − 2A > G | 54808 | DYM | ['ACAAGTTTGCTGGTGTATGGAAGACYATA CAAAAAGGAAAAAAAAATCAAA'] |
| 4964 | NM_001098398.1(COPA): c.728A > G (p.Asp243Gly) | −1 | — | ['TCAGAATCAAAGGCATGGGAGGTTGRTAC CTGCCGGGGCCATTACAACAAT'] |
| 4965 | NM_005045.3(RELN): c.2288A > G (p.Asp763Gly) | 5649 | RELN | ['CGTCAGCTAATTACATCTTTCCTTGRCAGC TCACAATCCAGGTGAGTGAAG'] |
| 4966 | NM_207111.3(RNF216): c.1616A > G (p.Tyr539Cys) | 54476 | RNF216 | ['TGCCATCTCTTTGATTTTCTGCTCAHAGAA CTCCTGCTCTTGTTGCACAGC'] |
| 4967 | NM_001035.2(RYR2): c.568A > G (p.Arg190Gly) | 6262 | RYR2 | ['CATCTTAGTTAGCGTGTCCTCTGAARGGTA CTTGGTAAGTGTGGAAAGTAG'] |
| 4968 | NM_001035.2(RYR2): c.11965A > G (p.Asn3989Asp) | 6262 | RYR2 | ['AAATGCAACTGCTTTACCACCAGGTVATGT TGTTAATGGAACGATTGGCAA'] |
| 4969 | NM_001035.2(RYR2): c.12290A > G (p.Asn4097Ser) | 6262 | RYR2 | ['GAACCTGCGAAGGACATCGGCTTCARCGT CGCCGTCCTTCTGACAAACCTC'] |
| 4970 | NM_001035.2(RYR2): c.12533A > G (p.Asn4178Ser) | 6262 | RYR2 | ['AGACAGTTCATATTTGACGTGGTCARCGA AGGCGGAGAGAAAGAAGATG'] |
| 4971 | NM_000090.3(COL3A1): c.2338 − 2A > G | 1281 | COL3A1 | ['ACAGTGACATGGCTTCTCTTTTTCCRGGGT GAAGGTGGTGCCCCCGGACTT'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4972 | NM_198056.2(SCN5A): c.4462A > G (p.Thr1488Ala) | 6331 | SCN5A | ['CTTAGGGGGCCAGGACATCTTCATGRCAG AGGAGCAGAAGAAGTACTACAA'] |
| 4973 | NM_198056.2(SCN5A): c.4453A > G (p.Ile1485Val) | 6331 | SCN5A | ['CTCTTTGCACTTAGGGGGCCAGGACRTCTT CATGACAGAGGAGCAGAAGAA'] |
| 4974 | NM_198056.2(SCN5A): c.2788 - 2A > G | 6331 | SCN5A | ['GGTGAGCCTGACCCATTATCTCGACRGGTC CTGAATCTCTTCCTGGCCTTG'] |
| 4975 | NM_198056.2(SCN5A): c.1247A > G (p.Tyr416Cys) | 6331 | SCN5A | ['GATGGTGGCTTGGTTTTGCTCCTCAYAGGC CATTGCGACCACGGCCAGGAT'] |
| 4976 | NM_004415.2(DSP): c.1141 - 2A > G | 1832 | DSP | ['TTCACTGATCACTCTCATCCTTCACRGTTTT TTGAAGAGGCGCAGTCTACT'] |
| 4977 | NM_000238.3(KCNH2): c.2582A > G (p.Asn861Ser) | 3757 | KCNH2 | ['TGGTCCAGCCTGGAGATCACCTTCANCCTG CGAGATGTGAGTTGGCTGCCC'] |
| 4978 | NM_000238.3(KCNH2): c.1913A > G (p.Lys638Arg) | 3757 | KCNH2 | ['GTCTCTCCCAACACCAACTCAGAGARGAT CTTCTCCATCTGCGTCATGCTC'] |
| 4979 | NM_000238.3(KCNH2): c.1904A > G (p.Asn635Ser) | 3757 | KCNH2 | ['TTCGGCAACGTCTCTCCCAACACCADCTCA GAGAAGATCTTCTCCATCTGC'] |
| 4980 | NM_000238.3(KCNH2): c.1900A > G (p.Thr634Ala) | 3757 | KCNH2 | ['GGGCTTCGGCAACGTCTCTCCCAACRCCAA CTCAGAGAAGATCTTCTCCAT'] |
| 4981 | NM_000238.3(KCNH2): c.1129 - 2A > G | 3757 | KCNH2 | ['CCACACCTCCGCCTTCCCCGGGTGCRGGTC CTGTCCCTGGGCGCCGACGTG'] |
| 4982 | NM_000238.3(KCNH2): c.296A > G (p.Tyr99Cys) | 3757 | KCNH2 | ['GAGCGCAAAGTGGAAATCGCCTTCTVCCG GAAAGATGGTAGGAGCGGGCCG'] |
| 4983 | NM_000238.3(KCNH2): c.133A > G (p.Asn45Asp) | 3757 | KCNH2 | ['GGAGAACTGCGCCGTCATCTACTGCDACG ACGGCTTCTGCGAGCTGTGCGG'] |
| 4984 | NM_001613.2(ACTA2): c.1A > G (p.Met1Val) | 59 | ACTA2 | ['AGAATCCTGTGAAGCAGCTCCAGCTRTGT GTGAAGAAGAGGACAGCACTGC'] |
| 4985 | NM_000218.2(KCNQ1): c.605A > G (p.Asp202Gly) | 3784 | KCNQ1 | ['GCTCCCCCTCTCCTGCACTCCACAGRCCTC ATCGTGGTCGTGGCCTCCATG'] |
| 4986 | NM_000218.2(KCNQ1): c.1033 - 2A > G | 3784 | KCNQ1 | ['GGGAGCCTCCTGTCCATTCCTTCCCVGGGG ATTCTTGGCTCGGGGTTTGCC'] |
| 4987 | NM_000218.2(KCNQ1): c.1515 - 2A > G | 3784 | KCNQ1 | ['CAATCTCCTCTCCTCTCTCCACTGCRGGCT GCGGGAACACCATCGGGCCAC'] |
| 4988 | NM_000218.2(KCNQ1): c.1787A > G (p.Glu596Gly) | 3784 | KCNQ1 | ['ATCGGCGCCCGCCTGAACCGAGTAGRAGA CAAGGTAGGCTCACGCGCCGGC'] |
| 4989 | NM_000138.4(FBN1): c.7916A > G (p.Tyr2639Cys) | 2200 | FBN1 | ['TGCATGTGTCCCGCCGGCTTCCAGTRTGAA CAGTTCAGTGGAGGATGCCAA'] |
| 4990 | NM_000138.4(FBN1): c.4337 - 2A > G | 2200 | FBN1 | ['TTTTGCTTTTTTCTCCCTCCCCCCARGATAT TGATGAGTGCTCCCTTCCGA'] |
| 4991 | NM_000138.4(FBN1): c.3344A > G (p.Asp1115Gly) | 2200 | FBN1 | ['GGTCATTTCCATTTTGCAGATATTGRTGAG TGTCAGAGAGATCCTCTCCTA'] |
| 4992 | NM_001943.3(DSG2): c.880A > G (p.Lys294Glu) | 1829 | DSG2 | ['AGTCAACGTAGAAGTTACGCGCATARAAG TGTTCGATGCAGATGAAATAGG'] |
| 4993 | NM_001927.3(DES): c.1324A > G (p.Thr442Ala) | 1674 | DES | ['TGAGCAAGGGGTTCTGAGGTCCATRCCA AGAAGACGGTGATGATCAAGAC'] |
| 4994 | NM_004572.3(PKP2): c.1171 - 2A > G | 5318 | PKP2 | ['AGAAATATGCATCTGCTTCTTCCCRGGTT AACCAGCTTCGTGGCATCCTC'] |
| 4995 | NM_001256850.1(TTN): c.45629 - 2A > G | -1 | — | ['GATATGAATATTTCACTCTTTTCTCRGGTC CTCCCTCACCACCCCTTGACC'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 4996 | NM_013254.3(TBK1): c.1201A > G (p.Lys401Glu) | 29110 | TBK1 | ['ACTTCATATTTCAGTTTCCCTCCCTRAAGT ACATCCACGTTATGATTTAGA'] |
| 4997 | NM_030973.3(MED25): c.116A > G (p.Tyr39Cys) | 81857 | MED25 | ['TACTTCGAGGGGCTCCGCAAGCACTRCCTG CTCCCGGCCATCGAGTGAGTG'] |
| 4998 | NM_145207.2(SPATA5): c.1883A > G (p.Asp628Gly) | 166378 | SPATA5 | ['TCTATTTTTCAGGTATCCTGGTCAGRTATA GGAGGACTGGAAAGTATCAAA'] |
| 4999 | NM_000016.5(ACADM): c.329A > G (p.Glu110Gly) | 34 | ACADM | ['ACTTTTGATGCTTGTTTAATTAGTGRAGAA TTGGCTTATGGATGTACAGGG'] |
| 5000 | NM_000016.5(ACADM): c.797A > G (p.Asp266Gly) | 34 | ACADM | ['CCTAAAGAAAATGTTTTAATTGGTGRCGG AGCTGGTTTCAAAGTTGCAATG'] |
| 5001 | NM_000532.4(PCCB): c.655 − 2A > G | 5096 | PCCB | ['GACTGTTCTGGAAATCTTTTATTTCRGGAC ACCTCCTACCTGTTCATCACT'] |
| 5002 | NM_004453.3(ETFDH): c.929A > G (p.Tyr310Cys) | 2110 | ETFDH | ['CATACCTATGGAGGATCTTTCCTCTRTCAT TTGAATGAAGGTGAACCCCTA'] |
| 5003 | NM_000255.3(MUT): c.1885A > G (p.Arg629Gly) | 4594 | MUT | ['AAAAATGGGACAAGATGGCCATGACGRAG GAGCAAAAGTTATTGCTACAGG'] |
| 5004 | NM_000255.3(MUT): c.329A > G (p.Tyr110Cys) | 4594 | MUT | ['TTTAGGCCCTGGACCATCCGCCAGTRTGCT GGTTTTAGTACTGTGGAAGAA'] |
| 5005 | NM_000017.3(ACADS): c.1108A > G (p.Met370Val) | 35 | ACADS | ['TCAGGCCATCCAGATCCTGGGCGGRTGG GCTACGTGACAGAGATGCCGGC'] |
| 5006 | NM_174917.4(ACSF3): c.1A > G (p.Met1Val) | 197322 | ACSF3 | ['TCCAGCTCGGCCGCCTGTCAGTGCARTGCT GCCCCATGTGGTGCTCACCTTT'] |
| 5007 | NM_000531.5(OTC): c.919A > G (p.Lys307Glu) | 5009 | OTC | ['GACATTTTTACACTGCTTGCCCAGARAGCC AGAAGAAGTGGATGATGAAGT'] |
| 5008 | NM_000030.2(AGXT): c.248A > G (p.His83Arg) | 189 | AGXT | ['ACACTGGTCATCTCTGGCTCGGGACRCTGT GCCCTGGAGGCCGCCCTGGTC'] |
| 5009 | NM_000030.2(AGXT): c.424 − 2A > G (p.Gly_142Gln145del) | 189 | AGXT | ['CACCCACAGCCGTCCCTGCTTCCTCRGGGC CTGGCCCAGCACAAGCCAGTG'] |
| 5010 | NM_000030.2(AGXT): c.596 − 2A > G | 189 | AGXT | ['CGTCCCGAGCAAACCACCCATCTACRGGGC ATCGACATCCTGTACTCGGGCT'] |
| 5011 | NM_000030.2(AGXT): c.777 − 2A > G | 189 | AGXT | ['TGGACCAAGCCCCCTCGTGTCTTCCRGGTA CCATCACACAATCCCCGTCAT'] |
| 5012 | NM_012203.1(GRHPR): c.84 − 2A > G | 9380 | GRHPR | ['CTCCTGAGGGCCTCCCTTTCCCCGCRGCTG TGAGGTGGAGCAGTGGGACTC'] |
| 5013 | NM_012203.1(GRHPR): c.934A > G (p.Asn312Asp) | 9380 | GRHPR | ['CACCATGTCCTTGTTGGCAGCTAACRACTT GCTGGCTGGCCTGAGAGGGGA'] |
| 5014 | NM_203290.2(POLR1C): c.221A > G (p.Asn74Ser) | 9533 | POLR1C | ['GTGGGAATTGACGCAGCCATTGCCARTGC TTTTCGACGAATTCTGCTAGCT'] |
| 5015 | NM_006516.2(SLC2A1): c.848A > G (p.Gln283Arg) | 6513 | SLC2A1 | ['GCTGTGGTGCTGCAGCTGTCCCAGCRGCT TCTGGCATCAACGCTGTGAGT'] |
| 5016 | NM_006516.2(SLC2A1): c.19 − 2A > G | 6513 | SLC2A1 | ['ATAACAGTGTGGTTTGTTTCTCCGCRGAAG CTGACGGGTCGCCTCATGCTG'] |
| 5017 | NM_021007.2(SCN2A): c.387 − 2A > G | 6326 | SCN2A | ['ACTTTGTCTTCCTTGACGATATTCTRCTTTA TTCAATATGCTCATTATGTG'] |
| 5018 | NM_021007.2(SCN2A): c.851A > G (p.Asp284Gly) | 6326 | SCN2A | ['AATAAATGTTTGCAATGGCCTCCAGRTAAT TCTTCCTTTGAAATAAATATC'] |
| 5019 | NM_021007.2(SCN2A): c.4036A > G (p.Ile1346Val) | 6326 | SCN2A | ['CATGAATGTACTTCTGGTTTGTCTGRTCTTT TGGCTAATATTCAGTATCAT'] |

TABLE 7-continued

Diseases/disorders containing A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 5020 | NM_001165963.1(SCN1A): c.4476 + 1A > G | -1 | — | ['TAATTTCAACCAGCAGAAAAAGAAGDTAA GTATTTCTAATATTTTCTCTCC'] |
| 5021 | NM_001165963.1(SCN1A): c.1277A > G (p.Tyr426Cys) | 6323 | SCN1A | ['ATCCTGGCTGTGGTGGCCATGGCCTRCGAG GAACAGAATCAGGCCACCTTG'] |
| 5022 | NM_000391.3(TPP1): c.833A > G (p.Gln278Arg) | 1200 | TPP1 | ['GGGATTGAGGCCAGTCTAGATGTGCRGTA CCTGATGAGTGCTGGTGCCAAC'] |
| 5023 | NM_017882.2(CLN6): c.767A > G (p.Asp256Gly) | 54982 | CLN6 | ['GGAGAAGAGGAAGAGGCCGTTGCTGYCCA GGAAGAGGCGCTTGCGCTTCTG'] |
| 5024 | NM_002693.2(POLG): c.3470A > G (p.Asn1157Ser) | 5428 | POLG | ['GGGCCCCGCATACCTGGTCAAGAGGYTGG TGATCTGCAAGGCCAGGGCAGC'] |
| 5025 | NM_002693.2(POLG): c.2840A > G (p.Lys947Arg) | 5428 | POLG | ['GTGGGCATCAGCCGTGAGCATGCCARAAT CTTCAACTACGGCCGCATCTAT'] |
| 5026 | NM_002693.2(POLG): c.2636A > G (p.Gln879Arg) | 5428 | POLG | ['CACAAGGGTGTAGCCAGGTGGGGCCYGCA CCATGGCTTTCAACTCACTGCC'] |
| 5027 | NM_000833.4(GRIN2A): c.2449A > G (p.Met817Val) | 2903 | GRIN2A | ['GAGCAGCCAGCTGGACATTGACAACRTGG CGGGCGTATTCTACATGCTGGC'] |
| 5028 | NM_000833.4(GRIN2A): c.1930A > G (p.Ser644Gly) | 2903 | GRIN2A | ['CTTCTTCGCTGTCATATTCCTGGCTRGCTA CACAGCCAATCTGGCTGCCTT'] |
| 5029 | NM_000156.5(GAMT): c.1A > G (p.Met1Val) | 2593 | GAMT | ['GTCGGGTCGCCGTCCAGCCTGCAGCRTGA GCGCCCCAGCGCGACCCCAT'] |
| 5030 | NM_172107.2(KCNQ2): c.848A > G (p.Lys283Arg) | 3785 | KCNQ2 | ['CTGACCACCATTGGCTACGGGGACARGTA CCCCCAGACCTGGAACGGCAGG'] |
| 5031 | NM_172107.2(KCNQ2): c.611A > G (p.Gln204Arg) | 3785 | KCNQ2 | ['GCGCTCCGGAGCCTGCGCTTCCTGCRGATT CTGCGGATGATCCGCATGGAC'] |
| 5032 | NM_172107.2(KCNQ2): c.297 - 2A > G | 3785 | KCNQ2 | ['CTGAGAGCGCGCGTTCCCTGCCCCCRGGTT CCTCCTGGTTTTCTCCTGCCT'] |
| 5033 | NM_001105243.1(PCDH19): c.1019A > G (p.Asn340Ser) | 57526 | PCDH19 | ['GTCACCGTCAGCGTGCTGGACACCARTGA CAATCCGCCGGTCATCAACCTG'] |
| 5034 | NM_001105243.1(PCDH19): c.695A > G (p.Asn232Ser) | 57526 | PCDH19 | ['CTTAGTATCAAGGTGACCGACTCCADTGA CAACAACCGGTGTTTAGCGAG'] |
| 5035 | NM_052859.3(RFT1): c.454A > G (p.Lys152Glu) | 91869 | RFT1 | ['TTCACAGCAGAAGGTGCACTGACCTBGAG CTTCACAAACATATGTGCTTGT'] |
| 5036 | NM_052859.3(RFT1): c.1222A > G (p.Met408Val) | 91869 | RFT1 | ['TCTCCTCCCCAGGTACAATTTTGTRGTGCT GGCCCTGTCCTCCTCATTCCT'] |
| 5037 | NM_020533.2(MCOLN1): c.1406A > G (p.Asn469Ser) | 57192 | MCOLN1 | ['TCTGAGTGCCTGTTCTCGCTCATCARTGGG GACGACATGTTTGTGACGTTC'] |
| 5038 | NM_004456.4(EZH2): c.458A > G (p.Tyr153Cys) | 2146 | EZH2 | ['TTCATTGAAGAACTAATAAAAAATTRTGAT GGGAAAGTACACGGGGATAGA'] |
| 5039 | NM_005045.3(RELN): c.2168A > G (p.Tyr723Cys) | 5649 | RELN | ['ACCACGGATAGAGTAAAAGTTATGGYAAG AGGAGAGCCTGGAACTGCCAAA] |
| 5040 | NM_006772.2(SYNGAP1): c.388 - 2A > G | 8831 | SYNGAP1 | ['CCCACCCCATCCCCATTTCCCCCCCRGCAA GGCTTCCTGAGCCGACGGCTA'] |
| 5041 | NM_001080508.2(TBX18): c.487A > G (p.Lys163Glu) | 9096 | TBX18 | ['GATAGGCACTGAGATGATCATCACCRAGG CCGGCAGGTAATGGGCAAGCTG'] |
| 5042 | NM_004964.2(HDAC1): c.461A > G (p.Asn154Ser) | 3065 | HDAC1 | ['GAGGCATCTGGCTTCTGTTACGTCARTGAT ATCGTCTTGGCCATCCTGGAA'] |
| 5043 | NM_014946.3(SPAST): c.1168A > G (p.Met390Val) | 6683 | SPAST | ['TGGTCCACCTGGGAATGGGAAGACARTGC TGGTAAGGGTTCTCTTCAAATT'] |

TABLE 7-continued

Diseases/disorders containging A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 5044 | NM_000314.6(PTEN): c.71A > G (p.Asp24Gly) | 5728 | PTEN | ['TATCAAGAGGATGGATTCGACTTAGRCTTG ACCTGTATCCATTTCTGCGGC'] |
| 5045 | NM_004380.2(CREBBP): c.4409A > G (p.His1470Arg) | 1387 | CREBBP | ['GGGTCCTGCAGGTATGTGACAGGGCRCAT CTGGGCCTGTCCTCCAAGTGAA'] |
| 5046 | NM_018206.4(VPS35): c.1463A > G (p.Gln488Arg) | 55737 | VPS35 | ['GATCCAGAAGATTTGCTGATGAGCRGAG CCTTGTGGGCCGCTTCATTCAT'] |
| 5047 | NM_152296.4(ATP1A3): c.971A > G (p.Glu324Gly) | 478 | ATP1A3 | ['GGCATCATCGTGGCCAATGTCCCAGRGGG TCTGCTGGCCACTGTCACTGTA'] |
| 5048 | NM_172107.2(KCNQ2): c.710A > G (p.Tyr237Cys) | 3785 | KCNQ2 | ['TCTCAGGAGCTGGTCACTGCCTGGTRCATC GGCTTCCTTTGTCTCATCCTG'] |
| 5049 | NM_001017980.3(VMA21): c.163 + 4A > G | 203547 | VMA21 | ['ACTAAATCTTACATATTTGAAGGTARTCTT AGACCCATTAAAACAAGATGT'] |
| 5050 | NM_000489.4(ATRX): c.740A > G (p.Asn247Ser) | 546 | ATRX | ['TTCTGCAAGAAATGCATTCTACGCARCCTT GGTCGAAAGGAGTTGTCCACA'] |
| 5051 | NM_021147.4(CCNO): c.716A > G (p.His239Arg) | 10309 | CCNO | ['CCCACCATTAGCTTCTTCCTGGAGCRTTTC ACGCACGCTCGCGTGGAGGCG'] |
| 5052 | NM_031924.4(RSPH3): c.631 − 2A > G | 83861 | RSPH3 | ['CTCTAGAGAATCAGGCCGTCCGAGCYAAC AGTGATAGAAAATACTTCTAGA'] |
| 5053 | NM_000069.2(CACNA1S): c.3526 − 2A > G | 779 | CACNA1S | ['TCGCTTTCCCATCCTTTTCCTTCCRGGGCT ACTTTGGAGACCCCTGGAAT'] |
| 5054 | NM_000533.4(PLP1): c.1A > G (p.Met1Val) | 5354 | PLP1 | ['CAATTGGAGTCAGAGTCCCAAAGACRTGG GTAAGTTTCAAAAACTTTAGCA'] |
| 5055 | NM_207352.3(CYP4V2): c.1396A > G (p.Asn466Asp) | 285440 | CYP4V2 | ['CGTGCCCTTCTCTGCTGGCCCCAGGRACTG TATAGGTTTGTATCCATCTGA'] |
| 5056 | NM_033409.3(SLC52A3): c.403A > G (p.Thr135Ala) | 113278 | SLC52A3 | ['ACAAAGAAGGTGGTGAGGTAGTAGGYGG GCAGCCGGCTCATGAACGGCAGG'] |
| 5057 | NM_033409.3(SLC52A3): c.62A > G (p.Asn21Ser) | 113278 | SLC52A3 | ['CAGGGGCAGCTCTACCCAGAGCCCAYTGA TGGTCACCCAGGAGCCCATTCC'] |
| 5058 | NM_017662.4(TRPM6): c.3173A > G (p.Tyr1058Cys) | 140803 | TRPM6 | ['CAAGCTGTCTACCTCTTCGTGCAATRTATC ATCATGGTGAACCTGTTGATT'] |
| 5059 | NM_006642.3(SDCCAG8): c.221 − 2A > G | 10806 | SDCCAG8 | ['AATAAACCCTCTGCTTTTGCTCTATRGTTA ATCAGCTCAAAGATTTGTTGC'] |
| 5060 | NM_022455.4(NSD1): c.5990A > G (p.Tyr1997Cys) | 64324 | NSD1 | ['CAAGAACATGATATCACTAATTTCTRTATG CTCACCCTAGACAAAGTAAGT'] |
| 5061 | NM_000352.4(ABCC8): c.563A > G (p.Asn188Ser) | 6833 | ABCC8 | ['GGGATGCTGCTCCTCGTGGAGGTCARTGTC ATCAGGGTGAGGGTAAGCAGG] |
| 5062 | NM_000275.2(OCA2): c.1427A > G (p.Asn476Ser) | 4948 | OCA2 | ['GATGGCAGTGGCAGCTCCTCCAATGYTTGT GAAGATACTTCTGCAATCAG'] |
| 5063 | NM_001848.2(COL6A1): c.1003 − 2A > G | 1291 | COL6A1 | ['ATTTTCTAGTTTTCTTCCTCTTTCCRGGGGG AGATGGGGTACCCAGGCCTG'] |
| 5064 | NM_003560.2(PLA2G6): c.1349 − 2A > G | 8398 | PLA2G6 | ['CAGCATGCCCTGCTCTGTGCCTCACRGAACC TACAGGATCTCATGCACATCT'] |
| 5065 | NM_178151.2(DCX): c.280A > G (p.Asn94Asp) | 1641 | DCX | ['TGACCTGACGCGATCTCTGTCTGACRCACAT CAACCTGCCTCAGGGAGTGCG'] |
| 5066 | NM_000425.4(L1CAM): c.2351A > G (p.Tyr784Cys) | 3897 | L1CAM | ['TCCAACACGTCCACCTTCGTGCCCRTGAG ATCAAAGTCCAGGCCGTCAAC'] |
| 5067 | NM_000052.6(ATP7A): c.2173 − 2A > G | 538 | ATP7A | ['TCAATGATTATCATTCCTATATTGCRGTTTT TCGGAGGCTGGTACTTCTAC'] |

TABLE 7-continued

Diseases/disorders contaigning A to G Changes. The table includes human gene mutations that may be corrected by changing a guanine (G) to adenine (A). The gene name, gene symbol, and Gene ID are indicated.

| SEQ ID NO: | Name | Gene ID | Gene Symbol | Flanks |
|---|---|---|---|---|
| 5068 | NM_020247.4(ADCK3): c.1286A > G (p.Tyr429Cys) | 56997 | ADCK3 | ['CTGCTGAAGGGCCACCCCTTCTTCTRTGTG CCTGAGATTGTGGATGAGCTC'] |
| 5069 | NM_000143.3(FH): c.554A > G (p.Gln185Arg) | 2271 | FH | ['AAACAGCAAAGCTCACATACTGACCYGGC TTTTATTAACATGATCGTTGGG'] |
| 5070 | NM_033109.4(PNPT1): c.1453A > G (p.Met485Val) | 87178 | PNPT1 | ['AAACTTCCGCCACATGCAGATGCCAKAGA AGATGACCCTATAGAAAGAAAA'] |
| 5071 | NM_005888.3(SLC25A3): c.158 − 9A > G | 5250 | SLC25A3 | ['TACTTACTTGATTTTTTTTTTCCARTCAAA CAGAGCAGTATAGCTGTGAC'] |
| 5072 | NM_181426.1(CCDC39): c.610 − 2A > G | 339829 | CCDC39 | ['TTGTGCTGCTTTATCCAATTCTAACYGTCA AACAGAGAGCAAAGAACATTT'] |
| 5073 | NM_153704.5(TMEM67): c.725A > G (p.Asn242Ser) | 91147 | TMEM67 | ['ATTGTTCTGTTGTAGGTATATGCCARTCTA ACATCTTGTCAAGCTCTTGGA'] |
| 5074 | NM_000166.5(GJB1): c.305A > G (p.Glu102Gly) | 2705 | GJB1 | ['CACGTGGCTCACCAGCAACACATAGRGAA GAAAATGCTACGGCTTGAGGGC'] |
| 5075 | NM_019098.4(CNGB3): c.1193A > G (p.Tyr398Cys) | 54714 | CNGB3 | ['AATTAAAGTTCGAACTGCCCAATAAYAAC ATCTCAGATACCTGTGAAAACA'] |
| 5076 | NM_000070.2(CAPN3): c.1194 − 9A > G | 825 | CAPN3 | ['CCATATGGCTCTCTCTCTTCTTCCARCCTCT CAGGATGTCCTATGAGGATT'] |
| 5077 | NM_002860.3(ALDH18A1): c.2345A > G (p.Tyr782Cys) | 5832 | ALDH18A1 | ['AGGAATAGGGAGGTTCTCATGAAGABATT TTAAACTTCCATGCTCTGAGAA'] |
| 5078 | NM_001414.3(EIF2B1): c.824A > G (p.Tyr275Cys) | 1967 | EIF2B1 | ['CAGAGTGATTAAGGAAGGGGCAGTGYAGT CGACCCACGGATGCTCCTCTTT'] |
| 5079 | NM_182896.2(ARL13B): c.461A > G (p.Asn154Ser) | 200894 | ARL13B | ['TGTCTATCTCTGGAAAAATTGGTCARTGAG CACAAGTGCCTGTGTCAGATA'] |
| 5080 | NM_001134831.1(AHI1): c.1152 − 2A > G | 54806 | AHI1 | ['TAGTAAGATGAAACAGGCCGTCCACYGTA CAAAAAAGATACTTCCATTAA'] |
| 5081 | NM_153704.5(TMEM67): c.978 + 3A > G | 91147 | TMEM67 | ['TCAGTTTTAAAGGAGAAAACCAGGTRAAA GTGTCTAATATCATTAGAGGAT'] |
| 5082 | NM_015681.3(B9D1): c.95A > G (p.Tyr32Cys) | 27077 | B9D1 | ['CCAGTCCTGGCCGTACACAAAGCAGYACT TGCAGTAGAGGTCATCATACTC'] |
| 5083 | NM_014049.4(ACAD9): c.1A > G (p.Met1Val) | 28976 | ACAD9 | ['CTGAGGCTGGGAACATCGGGCAGCWTGA GCGGCTGCGGGCTCTTCCTGCG'] |

TABLE 8 xCas9v3 Mutations (K294R/Q1256K Series)

| xCas9 3.0 | xCas9 3.1 | xCas9 3.2 | xCas9 3.3 | xCas9 3.4 |
|---|---|---|---|---|
|  |  | N175T |  |  |
| P230F |  |  |  |  |
|  |  |  | D257N |  |
| S267G |  | S267G | S267G |  |
| K294R | K294R | K294R | K294R | K294R |
|  |  |  | T466A |  |
| E480K | E480K | E480K | E480K | E480K |
| E543D | E543D | E543D | E543D | E543D |
|  | A711E |  |  |  |
|  | E1207G |  |  |  |
|  |  |  | I1063V |  |
| E1219V | E1219V | E1219V | E1219V | E1219V |
| Q1256K | Q1256K | Q1256K | Q1256K | Q1256K |

TABLE 9 xCas9v3 Mutations (A262T/S409I Series)

| xCas9 3.5 | xCas9 3.6 | xCas9 3.7 | xCas9 3.8 | xCas9 3.9 | xCas9 3.10 | xCas9 3.11 | xCas9 3.12 |
|---|---|---|---|---|---|---|---|
| E108G | E108G |  |  |  |  | E108G | E108G |
|  | S217A |  |  |  |  |  |  |
| A262T | A262T | A262T | A262T | A262T | A262T | A262T | A262T |
|  |  | R324L |  |  |  |  |  |
| S409I | S409I | S409I | S409I | S409I | S409I | S409I | S409I |
| E480K | E480K | E480K | E480K | E480K | E480K | E480K | E480K |
| E543D | E543D | E543D | E543D | E543D | E543D | E543D | E543D |
|  |  |  | D605D | D605D |  |  |  |
| K673E |  |  |  |  |  | K673E |  |
| M694I | M694I | M694I | M694I | M694I | M694I | M694I | M694I |
| E1219V | E1219V | E1219V | E1219V | E1219V | E1219V | E1219V | E1219V |
|  |  |  | H1264Y |  |  |  |  |
| L1365I | L1365I |  |  |  | L1365I |  | L1365I |

TABLE 10

PAM Depletion Scores (xCas9v3.0-3.6 Mutations)

| | 22-4 xCas9 3.0 | 22-10 xCas9 3.1 | 22-11 xCas9 3.2 | 22-14 xCas9 3.3 | 22-21 xCas9 3.4 | 22-65 xCas9 3.5 | 22-66 xCas9 3.6 |
|---|---|---|---|---|---|---|---|
| AAA | 0.61 | 0.69 | 1.38 | 0.90 | 0.98 | 1.29 | 1.47 |
| AAC | 0.67 | 0.77 | 0.78 | 0.71 | 0.93 | 0.80 | 1.55 |
| AAG | 13.88 | 15.70 | 32.70 | 28.75 | 22.79 | 48.60 | 92.02 |
| AAT | 0.52 | 0.59 | 0.87 | 0.63 | 0.76 | 0.87 | 0.84 |
| ACA | 0.52 | 0.52 | 0.48 | 0.51 | 0.57 | 0.59 | 0.72 |
| ACC | 0.54 | 0.50 | 0.48 | 0.48 | 0.47 | 0.46 | 0.55 |
| ACG | 10.15 | 30.07 | 41.38 | 108.50 | 32.19 | 25.52 | 158.44 |
| ACT | 0.46 | 0.47 | 0.39 | 0.41 | 0.44 | 0.40 | 0.50 |
| AGA | 13.22 | 28.30 | 34.42 | 57.31 | 38.26 | 31.93 | 170.85 |
| AGC | 7.55 | 5.84 | 11.17 | 8.69 | 7.63 | 13.13 | 5.54 |
| AGG | 12.23 | 188.82 | 37.97 | 182.49 | 194.93 | 82.99 | 355.32 |
| AGT | 13.19 | 9.75 | 17.03 | 16.09 | 10.90 | 19.84 | 22.47 |
| ATA | 0.58 | 0.56 | 0.51 | 0.52 | 0.51 | 0.53 | 0.49 |
| ATC | 0.52 | 0.50 | 0.45 | 0.45 | 0.47 | 0.42 | 0.38 |
| ATG | 11.38 | 14.85 | 23.55 | 40.11 | 20.48 | 30.27 | 108.77 |
| ATT | 0.48 | 0.46 | 0.43 | 0.42 | 0.43 | 0.41 | 0.39 |
| CAA | 1.55 | 2.00 | 6.63 | 5.06 | 3.42 | 6.29 | 4.66 |
| CAC | 0.57 | 0.65 | 0.99 | 0.75 | 0.86 | 0.93 | 3.20 |
| CAG | 15.05 | 11.83 | 26.90 | 26.86 | 22.15 | 32.07 | 137.31 |
| CAT | 4.41 | 6.06 | 17.67 | 7.55 | 6.30 | 8.13 | 7.87 |
| CCA | 0.48 | 0.46 | 0.41 | 0.43 | 0.42 | 0.40 | 0.39 |
| CCC | 0.53 | 0.51 | 0.46 | 0.45 | 0.45 | 0.43 | 0.44 |
| CCG | 3.35 | 2.67 | 6.87 | 6.98 | 4.69 | 8.56 | 5.44 |
| CCT | 0.53 | 0.50 | 0.45 | 0.49 | 0.46 | 0.43 | 0.38 |
| CGA | 9.23 | 49.45 | 43.50 | 106.20 | 62.04 | 27.17 | 116.32 |
| CGC | 13.79 | 8.59 | 17.62 | 15.06 | 12.16 | 21.40 | 11.61 |
| CGG | 16.85 | 223.84 | 46.41 | 346.14 | 96.28 | 90.82 | 252.73 |
| CGT | 12.66 | 23.87 | 36.06 | 42.02 | 20.18 | 27.33 | 179.69 |
| CTA | 0.54 | 0.50 | 0.45 | 0.47 | 0.47 | 0.45 | 0.49 |
| CTC | 0.51 | 0.48 | 0.43 | 0.44 | 0.45 | 0.42 | 0.38 |
| CTG | 5.39 | 3.40 | 6.92 | 8.28 | 5.95 | 11.34 | 4.20 |

TABLE 10-continued

| | | | | | | |
|---|---|---|---|---|---|---|
| CTT | 0.52 | 0.52 | 0.46 | 0.46 | 0.44 | 0.44 | 0.82 |
| GAA | 10.98 | 7.67 | 14.45 | 11.25 | 9.75 | 11.86 | 6.86 |
| GAC | 0.88 | 1.35 | 4.85 | 2.92 | 2.40 | 5.25 | 4.15 |
| GAG | 11.85 | 55.33 | 39.91 | 118.83 | 109.84 | 85.83 | 390.44 |
| GAT | 7.69 | 5.68 | 10.55 | 9.22 | 6.41 | 11.03 | 9.53 |
| GCA | 0.49 | 0.49 | 0.47 | 0.52 | 0.53 | 0.59 | 0.61 |
| GCC | 0.53 | 0.52 | 0.50 | 0.50 | 0.49 | 0.46 | 0.52 |
| GCG | 13.68 | 13.44 | 22.56 | 46.72 | 32.75 | 35.86 | 97.69 |
| GCT | 0.51 | 0.50 | 0.45 | 0.48 | 0.46 | 0.45 | 0.61 |
| GGA | 9.74 | 82.32 | 39.45 | 172.39 | 102.30 | 85.53 | 77.46 |
| GGC | 12.21 | 10.04 | 17.84 | 15.18 | 14.04 | 27.07 | 17.46 |
| GGG | 18.90 | 381.76 | 70.36 | 281.12 | 164.21 | 111.87 | 718.40 |
| GGT | 10.87 | 22.11 | 32.25 | 88.31 | 40.66 | 40.16 | 257.92 |
| GTA | 0.56 | 0.59 | 0.77 | 0.72 | 0.76 | 1.03 | 1.55 |
| GTC | 0.52 | 0.51 | 0.46 | 0.52 | 0.49 | 0.45 | 0.58 |
| GTG | 11.43 | 16.42 | 28.54 | 72.25 | 33.31 | 47.65 | 382.48 |
| GTT | 0.48 | 0.45 | 0.41 | 0.43 | 0.43 | 0.42 | 0.76 |
| TAA | 0.58 | 0.67 | 1.59 | 0.99 | 1.04 | 1.69 | 1.53 |
| TAC | 0.56 | 0.54 | 0.51 | 0.51 | 0.52 | 0.50 | 0.44 |
| TAG | 11.34 | 10.19 | 15.99 | 22.04 | 15.24 | 27.89 | 35.59 |
| TAT | 0.56 | 0.64 | 1.26 | 0.85 | 0.89 | 1.21 | 2.60 |
| TCA | 0.50 | 0.48 | 0.43 | 0.45 | 0.46 | 0.45 | 0.44 |
| TCC | 0.50 | 0.48 | 0.43 | 0.46 | 0.44 | 0.42 | 0.47 |
| TCG | 10.38 | 8.24 | 14.95 | 15.64 | 9.96 | 15.57 | 34.80 |
| TCT | 0.52 | 0.50 | 0.45 | 0.44 | 0.46 | 0.41 | 0.46 |
| TGA | 9.68 | 61.64 | 44.45 | 188.12 | 99.42 | 46.89 | 186.41 |
| TGC | 13.64 | 9.07 | 15.11 | 11.69 | 11.22 | 15.01 | 8.15 |
| TGG | 12.90 | 223.88 | 63.67 | 259.65 | 115.56 | 80.51 | 210.65 |
| TGT | 11.53 | 18.90 | 31.99 | 36.30 | 18.72 | 21.90 | 122.87 |
| TTA | 0.61 | 0.57 | 0.52 | 0.54 | 0.51 | 0.52 | 0.30 |
| TTC | 0.53 | 0.50 | 0.44 | 0.45 | 0.44 | 0.43 | 0.27 |
| TTG | 13.57 | 6.61 | 10.15 | 13.27 | 7.38 | 14.26 | 12.24 |
| TTT | 0.53 | 0.49 | 0.44 | 0.45 | 0.48 | 0.44 | 0.28 |

PAM Depletion Scores (xCas9v3.7-3.12 Mutations)

| | 22-68 xCas9 3.7 | 22-75 xCas9 3.8 | 22-78 xCas9 3.9 | 22-82 xCas9 3.10 | 22-87 xCas9 3.11 | 22-90 xCas9 3.12 |
|---|---|---|---|---|---|---|
| AAA | 0.92 | 1.00 | 4.30 | 0.63 | 0.48 | 1.67 |
| AAC | 8.72 | 3.59 | 1.55 | 1.59 | 0.94 | 1.34 |
| AAG | 23.44 | 20.16 | 16.46 | 10.63 | 26.46 | 22.44 |
| AAT | 1.03 | 0.89 | 1.22 | 1.07 | 0.76 | 0.96 |
| ACA | 0.80 | 0.92 | 0.52 | 0.68 | 1.09 | 0.83 |
| ACC | 0.42 | 1.37 | 0.32 | 1.03 | 0.81 | 0.53 |
| ACG | 11.20 | 6.65 | 21.80 | 1.38 | 1.23 | 0.88 |
| ACT | 0.27 | 0.38 | 0.24 | 0.88 | 0.54 | 0.66 |
| AGA | 11.63 | 11.95 | 14.60 | 0.89 | 1.42 | 1.78 |
| AGC | 1.03 | 11.25 | 8.05 | 1.54 | 1.77 | 2.39 |
| AGG | 8.05 | 11.61 | 21.28 | 1.37 | 33.28 | 113.98 |
| AGT | 11.10 | 6.85 | 12.73 | 0.39 | 2.70 | 0.91 |
| ATA | 0.73 | 0.79 | 0.58 | 1.04 | 0.70 | 0.94 |
| ATC | 0.43 | 0.47 | 0.28 | 0.63 | 0.86 | 0.87 |
| ATG | 15.46 | 13.03 | 4.76 | 2.21 | 2.39 | 1.73 |
| ATT | 0.62 | 0.30 | 0.53 | 0.59 | 0.91 | 0.74 |
| CAA | 8.96 | 6.08 | 1.97 | 1.46 | 0.53 | 0.67 |
| CAC | 1.65 | 1.31 | 0.81 | 0.60 | 0.75 | 0.73 |
| CAG | 3.46 | 1.99 | 1.44 | 23.50 | 9.51 | 13.76 |
| CAT | 20.52 | 44.57 | 18.70 | 16.29 | 15.96 | 0.36 |
| CCA | 0.40 | 0.31 | 0.64 | 0.87 | 0.55 | 0.64 |
| CCC | 0.35 | 0.54 | 0.55 | 1.12 | 0.56 | 0.69 |
| CCG | 4.35 | 5.28 | 5.57 | 1.37 | 0.94 | 0.83 |
| CCT | 0.40 | 1.04 | 0.36 | 1.22 | 0.67 | 0.59 |
| CGA | 4.47 | 7.60 | 5.26 | 1.35 | 1.36 | 2.02 |
| CGC | 13.35 | 10.98 | 5.45 | 4.03 | 5.37 | 3.66 |
| CGG | 6.06 | 5.52 | 25.23 | 31.85 | 19.44 | 34.65 |
| CGT | 17.13 | 7.41 | 17.31 | 0.63 | 1.44 | 0.66 |
| CTA | 0.76 | 0.50 | 0.50 | 1.97 | 1.45 | 1.05 |
| CTC | 0.40 | 0.26 | 0.65 | 0.58 | 0.45 | 0.81 |
| CTG | 5.64 | 9.49 | 6.82 | 1.35 | 1.41 | 2.11 |
| CTT | 0.50 | 0.63 | 0.68 | 0.54 | 0.73 | 0.88 |
| GAA | 9.81 | 6.07 | 4.68 | 2.07 | 0.87 | 1.09 |
| GAC | 3.91 | 3.95 | 2.82 | 0.44 | 0.86 | 0.56 |
| GAG | 23.26 | 21.32 | 9.88 | 16.93 | 18.42 | 40.73 |
| GAT | 5.06 | 9.85 | 1.07 | 0.75 | 1.06 | 0.63 |
| GCA | 0.56 | 0.81 | 0.79 | 1.46 | 0.44 | 0.89 |
| GCC | 0.35 | 0.52 | 0.71 | 0.65 | 3.67 | 0.73 |
| GCG | 16.11 | 12.53 | 9.43 | 1.59 | 1.98 | 2.22 |
| GCT | 0.42 | 0.88 | 0.27 | 0.66 | 1.14 | 0.76 |
| GGA | 3.01 | 18.40 | 33.07 | 27.28 | 16.20 | 46.82 |

TABLE 10-continued

| | | | | | | |
|---|---|---|---|---|---|---|
| GGC | 6.03 | 3.83 | 11.69 | 8.03 | 22.56 | 3.92 |
| GGG | 12.16 | 10.26 | 15.08 | 17.30 | 25.85 | 128.03 |
| GGT | 11.25 | 13.77 | 2.94 | 12.71 | 16.11 | 16.22 |
| GTA | 1.38 | 1.08 | 1.24 | 0.75 | 3.52 | 1.09 |
| GTC | 0.96 | 0.31 | 0.50 | 0.93 | 0.72 | 0.81 |
| GTG | 6.68 | 17.93 | 26.86 | 9.93 | 9.61 | 2.72 |
| GTT | 0.45 | 0.33 | 0.99 | 0.65 | 1.61 | 1.01 |
| TAA | 3.04 | 2.16 | 1.84 | 1.21 | 1.08 | 0.68 |
| TAC | 0.61 | 0.52 | 0.68 | 0.95 | 0.68 | 0.86 |
| TAG | 4.76 | 15.71 | 1.10 | 8.15 | 8.25 | 8.87 |
| TAT | 1.62 | 2.10 | 1.01 | 0.73 | 0.74 | 0.66 |
| TCA | 0.41 | 0.66 | 0.58 | 0.46 | 0.77 | 0.68 |
| TCC | 0.54 | 0.29 | 0.38 | 1.36 | 0.86 | 0.82 |
| TCG | 1.41 | 4.20 | 9.11 | 0.84 | 0.46 | 0.69 |
| TCT | 0.47 | 0.44 | 0.38 | 0.60 | 1.00 | 0.94 |
| TGA | 22.42 | 5.39 | 15.72 | 1.78 | 3.13 | 3.69 |
| TGC | 6.78 | 6.81 | 11.35 | 2.41 | 6.55 | 4.08 |
| TGG | 20.36 | 11.36 | 11.56 | 9.97 | 21.64 | 19.87 |
| TGT | 10.32 | 8.82 | 21.17 | 0.94 | 0.79 | 0.73 |
| TTA | 0.65 | 0.29 | 0.77 | 0.94 | 1.35 | 0.75 |
| TTC | 0.62 | 1.07 | 0.55 | 0.86 | 1.07 | 0.58 |
| TTG | 8.41 | 6.07 | 9.07 | 0.67 | 0.56 | 0.72 |
| TTT | 0.43 | 0.56 | 0.44 | 0.68 | 0.60 | 0.75 |

REFERENCES

1. Humbert O, Davis L, Maizels N. Targeted gene therapies: tools, applications, optimization. Crit Rev Biochem Mol. 2012; 47(3):264-81. PMID: 22530743.
2. Perez-Pinera P, Ousterout D G, Gersbach C A. Advances in targeted genome editing. Curr Opin Chem Biol. 2012; 16(3-4):268-77. PMID: 22819644.
3. Urnov F D, Rebar E J, Holmes M C, Zhang H S, Gregory P D. Genome editing with engineered zinc finger nucleases. Nat Rev Genet. 2010; 11(9):636-46. PMID: 20717154.
4. Joung J K, Sander J D. TALENs: a widely applicable technology for targeted genome editing. Nat Rev Mol Cell Biol. 2013; 14(1):49-55. PMID: 23169466.
5. Charpentier E, Doudna J A. Biotechnology: Rewriting a genome. Nature. 2013; 495, (7439):50-1. PMID: 23467164.
6. Pan Y, Xia L, Li A S, Zhang X, Sirois P, Zhang J, Li K. Biological and biomedical applications of engineered nucleases. Mol Biotechnol. 2013; 55(1):54-62. PMID: 23089945.
7. De Souza, N. Primer: genome editing with engineered nucleases. Nat Methods. 2012; 9(1):27. PMID: 22312638.
8. Santiago Y, Chan E, Liu P Q, Orlando S, Zhang L, Urnov F D, Holmes M C, Guschin D, Waite A, Miller J C, Rebar E J, Gregory P D, Klug A, Collingwood T N. Targeted gene knockout in mammalian cells by using engineered zinc-finger nucleases. Proc Natl Acad Sci USA. 2008; 105(15):5809-14. PMID: 18359850.
9. Cargill M, Altshuler D, Ireland J, Sklar P, Ardlie K, Patil N, Lane C R, Lim E P, Kalyanaraman N, Nemesh J, Ziaugra L, Friedland L, Rolfe A, Warrington J, Lipshutz R, Daley G Q, Lander E S. Characterization of single-nucleotide polymorphisms in coding regions of human genes. Nat Genet. 1999; 22(3):231-8. PMID: 10391209.
10. Jansen R, van Embden J D, Gaastra W, Schouls L M. Identification of genes that are associated with DNA repeats in prokaryotes. Mol Microbiol. 2002; 43(6):1565-75. PMID: 11952905.
11. Mali P, Esvelt K M, Church G M. Cas9 as a versatile tool for engineering biology. Nat Methods. 2013; 10(10):957-63. PMID: 24076990.
12. Jore M M, Lundgren M, van Duijin E, Bultema J B, Westra E R, Waghmare S P, Wiedenheft B, Pul U, Wurm R, Wagner R, Beijer M R, Barendregt A, Shou K, Snijders A P, Dickman M J, Doudna J A, Boekema E J, Heck A J, van der Oost J, Brouns S J. Structural basis for CRISPR RNA-guided DNA recognition by Cascade. Nat Struct Mol Biol. 2011; 18(5):529-36. PMID: 21460843.
13. Horvath P, Barrangou R. CRISPR/Cas, the immune system of bacteria and archaea. Science. 2010; 327(5962): 167-70. PMID: 20056882.
14. Wiedenheft B, Sternberg S H, Doudna J A. RNA-guided genetic silencing systems in bacteria and archaea. Nature. 2012; 482(7385):331-8. PMID: 22337052.
15. Gasiunas G, Siksnys V. RNA-dependent DNA endonuclease Cas9 of the CRISPR system: Holy Grail of genome editing? Trends Microbiol. 2013; 21(11):562-7. PMID: 24095303.
16. Qi L S, Larson M H, Gilbert L A, Doudna J A, Weissman J S, Arkin A P, Lim W A. Repurposing CRISPR as an RNA-guided platform for sequence-specific control of gene expression. Cell. 2013; 152(5):1173-83. PMID: 23452860.
17. Perez-Pinera P, Kocak D D, Vockley C M, Adler A F, Kabadi A M, Polstein L R, Thakore P I, Glass K A, Ousterout D G, Leong K W, Guilak F, Crawford G E, Reddy T E, Gersbach C A. RNA-guided gene activation by CRISPR-Cas9-based transcription factors. Nat Methods. 2013; 10(10):973-6. PMID: 23892895.
18. Mali P, Aach J, Stranges P B, Esvelt K M, Moosburner M, Kosuri S, Yang L, Church G M. CAS9 transcriptional activators for target specificity screening and paired nickases for cooperative genome engineering. Nat Biotechnol. 2013; 31(9):833-8. PMID: 23907171.
19. Gilbert L A, Larson M H, Morsut L, Liu Z, Brar G A, Torres S E, Stern-Ginossar N, Brandman O, Whitehead E H, Doudna J A, Lim W A, Weissman J S, Qi L S. CRISPR-mediated modular RNA-guided regulation of transcription in eukaryotes. Cell. 2013; 154(2):442-51. PMID: 23849981.
20. Larson M H, Gilbert L A, Wang X, Lim W A, Weissman J S, Qi L S. CRISPR interference (CRISPRi) for sequence-specific control of gene expression. Nat Protoc. 2013; 8(11):2180-96. PMID: 24136345.

21. Mali P, Yang L, Esvelt K M, Aach J, Guell M, DiCarlo J E, Norville J E, Church G M. RNA-guided human genome engineering via Cas9. *Science*. 2013; 339(6121): 823-6. PMID: 23287722.
22. Cole-Strauss A, Yoon K, Xiang Y, Byrne B C, Rice M C, Gryn J, Holloman W K, Kmiec E B. Correction of the mutation responsible for sickle cell anemia by an RNA-DNA oligonucleotide. *Science*. 1996; 273(5280):1386-9. PMID: 8703073.
23. Tagalakis A D, Owen J S, Simons J P. Lack of RNA-DNA oligonucleotide (chimeraplast) mutagenic activity in mouse embryos. *Mol Reprod Dev.* 2005; 71(2):140-4. PMID: 15791601.
24. Ray A, Langer M. Homologous recombination: ends as the means. *Trends Plant Sci.* 2002; 7(10):435-40. PMID 12399177.
25. Britt A B, May G D. Re-engineering plant gene targeting. *Trends Plant Sci.* 2003; 8(2):90-5. PMID: 12597876.
26. Vagner V, Ehrlich S D. Efficiency of homologous DNA recombination varies along the *Bacillus subtilis* chromosome. *J Bacteriol.* 1988; 170(9):3978-82. PMID: 3137211.
27. Saleh-Gohari N, Helleday T. Conservative homologous recombination preferentially repairs DNA double-strand breaks in the S phase of the cell cycle in human cells. *Nucleic Acids Res.* 2004; 32(12):3683-8. PMID: 15252152.
28. Lombardo A, Genovese P, Beausejour C M, Colleoni S, Lee Y L, Kim K A, Ando D, Urnov F D, Galli C, Gregory P D, Holmes M C, Naldini L. Gene editing in human stem cells using zinc finger nucleases and integrase-defective lentiviral vector delivery. *Nat Biotechnol.* 2007; 25(11): 1298-306. PMID: 17965707.
29. Conticello S G. The AID/APOBEC family of nucleic acid mutators. *Genome Biol.* 2008; 9(6):229. PMID: 18598372.
30. Reynaud C A, Aoufouchi S, Faili A, Weill J C. What role for AID: mutator, or assembler of the immunoglobulin mutasome? *Nat Immunol.* 2003; 4(7):631-8.
31. Bhagwat A S. DNA-cytosine deaminases: from antibody maturation to antiviral defense. *DNA Repair* (Amst). 2004; 3(1):85-9. PMID: 14697763.
32. Navaratnam N, Sarwar R. An overview of cytidine deaminases. *Int J Hematol.* 2006; 83(3):195-200. PMID: 16720547.
33. Holden L G, Prochnow C, Chang Y P, Bransteitter R, Chelico L, Sen U, Stevens R C, Goodman M F, Chen X S. Crystal structure of the anti-viral APOBEC3G catalytic domain and functional implications. *Nature.* 2008; 456 (7218):121-4. PMID: 18849968.
34. Chelico L, Pham P, Petruska J, Goodman M F. Biochemical basis of immunological and retroviral responses to DNA-targeted cytosine deamination by activation-induced cytidine deaminase and APOBEC3G. *J Biol Chem.* 2009; 284(41). 27761-5. PMID: 19684020.
35. Pham P, Bransteitter R, Goodman M F. Reward versus risk: DNA cytidine deaminases triggering immunity and disease. *Biochemistry.* 2005; 44(8):2703-15. PMID 15723516.
36. Chen X, Zaro J L, Shen W C. Fusion protein linkers: property, design and functionality. *Adv Drug Deliv Rev.* 2013; 65(10):1357-69. PMID: 23026637.
37. Slaymaker, I. M. et al. Rationally engineered Cas9 nucleases with improved specificity. *Science*, doi: 10.1126/science.aad5227 (2015).
38. Kleinstiver, B. P. et al. Engineered CRISPR-Cas9 nucleases with altered PAM specificities. *Nature* 523, 481-485, doi:10.1038/nature14592 (2015).
39. Pattanayak, V. et al. High-throughput profiling of off-target DNA cleavage reveals RNA-programmed Cas9 nuclease specificity. *Nature Biotechnology* 31, 839-843, doi:10.1038/nbt.2673 (2013).
40. Shcherbakova, D. M. & Verkhusha, V. V. Near-infrared fluorescent proteins for multicolor in vivo imaging. *Nature Methods* 10, 751-754, doi:10.1038/nmeth.2521 (2013).
41. Kleinstiver, et al., High-fidelity CRISPR-Cas9 nucleases with no detectable genome-wide off-target effects. *Nature* 529, 490-495 doi:10.1038/nature16526 (2016).

All publications, patents, patent applications, publication, and database entries (e.g., sequence database entries) mentioned herein, e.g., in the Background, Summary, Detailed Description, Examples, and/or References sections, are hereby incorporated by reference in their entirety as if each individual publication, patent, patent application, publication, and database entry was specifically and individually incorporated herein by reference. In case of conflict, the present application, including any definitions herein, will control.

EQUIVALENTS AND SCOPE

Those skilled in the art will recognize, or be able to ascertain using no more than routine experimentation, many equivalents of the embodiments described herein. The scope of the present disclosure is not intended to be limited to the above description, but rather is as set forth in the appended claims.

Articles such as "a," "an," and "the" may mean one or more than one unless indicated to the contrary or otherwise evident from the context. Claims or descriptions that include "or" between two or more members of a group are considered satisfied if one, more than one, or all of the group members are present, unless indicated to the contrary or otherwise evident from the context. The disclosure of a group that includes "or" between two or more group members provides embodiments in which exactly one member of the group is present, embodiments in which more than one members of the group are present, and embodiments in which all of the group members are present. For purposes of brevity those embodiments have not been individually spelled out herein, but it will be understood that each of these embodiments is provided herein and may be specifically claimed or disclaimed.

It is to be understood that the invention encompasses all variations, combinations, and permutations in which one or more limitation, element, clause, or descriptive term, from one or more of the claims or from one or more relevant portion of the description, is introduced into another claim. For example, a claim that is dependent on another claim can be modified to include one or more of the limitations found in any other claim that is dependent on the same base claim. Furthermore, where the claims recite a composition, it is to be understood that methods of making or using the composition according to any of the methods of making or using disclosed herein or according to methods known in the art, if any, are included, unless otherwise indicated or unless it would be evident to one of ordinary skill in the art that a contradiction or inconsistency would arise.

Where elements are presented as lists, e.g., in Markush group format, it is to be understood that every possible subgroup of the elements is also disclosed, and that any element or subgroup of elements can be removed from the group. It is also noted that the term "comprising" is intended to be open and permits the inclusion of additional elements or steps. It should be understood that, in general, where an embodiment, product, or method is referred to as comprising particular elements, features, or steps, embodiments, products, or methods that consist, or consist essentially of, such elements, features, or steps, are provided as well. For purposes of brevity those embodiments have not been individually spelled out herein, but it will be understood that each of these embodiments is provided herein and may be specifically claimed or disclaimed.

Where ranges are given, endpoints are included. Furthermore, it is to be understood that unless otherwise indicated or otherwise evident from the context and/or the understanding of one of ordinary skill in the art, values that are expressed as ranges can assume any specific value within the stated ranges in some embodiments, to the tenth of the unit of the lower limit of the range, unless the context clearly dictates otherwise. For purposes of brevity, the values in each range have not been individually spelled out herein, but it will be understood that each of these values is provided herein and may be specifically claimed or disclaimed. It is also to be understood that unless otherwise indicated or otherwise evident from the context and/or the understanding of one of ordinary skill in the art, values expressed as ranges can assume any subrange within the given range, wherein the endpoints of the subrange are expressed to the same degree of accuracy as the tenth of the unit of the lower limit of the range.

In addition, it is to be understood that any particular embodiment of the present invention may be explicitly excluded from any one or more of the claims. Where ranges are given, any value within the range may explicitly be excluded from any one or more of the claims. Any embodiment, element, feature, application, or aspect of the compositions and/or methods of the invention, can be excluded from any one or more claims. For purposes of brevity, all of the embodiments in which one or more elements, features, purposes, or aspects is excluded are not set forth explicitly herein.

wherein the amino acid sequence of the Cas9 protein is not identical to the amino acid sequence of a naturally occurring Cas9 protein.

2. The Cas9 protein of claim 1 comprising an amino acid sequence that is at least 95% identical to the amino acid sequence of a Cas9 protein as provided by SEQ ID NO: 9.

3. The Cas9 protein of claim 1, wherein the amino acid sequence of the Cas9 protein comprises at least two substitutions selected from the group consisting of S267G, K294R, F405I, S409I, E480K, E543D, M694I, E1219V, N1224K, Q1256K, and L1362P of the amino acid sequence provided in SEQ ID NO: 9.

4. A fusion protein comprising the Cas9 protein of claim 1, wherein the Cas9 protein is fused to an effector domain.

5. The fusion protein of claim 4, wherein the effector domain comprises an enzyme domain.

6. The fusion protein of claim 4, wherein the effector domain comprises a nuclease domain, a nickase domain, a recombinase domain, a deaminase domain, a methyltransferase domain, a methylase domain, an acetylase domain, an acetyltransferase domain, a transcriptional activator domain, or a transcriptional repressor domain.

7. The fusion protein of claim 5, wherein the enzyme domain is a nuclease domain.

8. A dimer of the fusion protein of claim 7.

9. A fusion protein comprising a first Cas9 protein fused to a second Cas9 protein, wherein the first Cas9 protein is the Cas9 protein of claim 1.

10. A complex comprising the Cas9 protein of claim 1 and a guide RNA bound to the Cas9 protein.

11. A complex comprising the fusion protein of claim 9, a first guide RNA bound to the first Cas9 protein of the fusion protein, and a second guide RNA bound to the second Cas9 protein of the fusion protein.

12. A method comprising contacting a DNA molecule with the Cas9 protein of claim 1 and a guide RNA, wherein the guide RNA is about 15-100 nucleotides long and comprises a sequence of at least 10 contiguous nucleotides that is complementary to a target sequence.

SEQUENCE LISTING (5089 sequences)

SEQ ID NO: 1 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 2 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 3 - DNA, 4212 bp, Artificial Sequence
  Synthetic polynucleotide
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 4 - protein, 1368 aa, Artificial Sequence
  Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 5 - protein, 5 aa, Artificial Sequence
  Synthetic polypeptide
GGGGS

SEQ ID NO: 6 - protein, 5 aa, Artificial Sequence
  Synthetic polypeptide
EAAAK

SEQ ID NO: 7 - protein, 16 aa, Artificial Sequence
  Synthetic polypeptide
SGSETPGTSESATPES

SEQ ID NO: 8 - protein, 1368 aa, Artificial Sequence
  Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 9 - protein, 1368 aa, Streptococcus pyogenes [sequence omitted]

SEQ ID NO: 10 - protein, 1359 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 11 - protein, 1355 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFANEIAKVDESFFQRLDESFLTDDDKTFDSHPIFGNKAEEDAYHQKFPTIYHLRKHLADSSEKADLRLVYLALAHMIKFRGHFLIEGELNAENTDVQKIFADFVGVYNRTFDDSHLSEITVDVASILTEKISKSRRLENLIKYYPTEKKNTLFGNLIALALGLQPNFKTNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNILSKIKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGGNPDNIVIEMARENQTTNRGRSQSQQRLKKLQNSLKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDISSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKLGEE

SEQ ID NO: 12 - protein, 1359 aa, Streptococcus mitis
KKGYSIGLDIGTNSVGFAVITDDYKVPSKKMKVLGNTDKRFIKKNLIGALLFDEGTTAEARRLKRTARRRYTRRKNRLRYLQEIFSEEMSKVDSSFFHRLDDSFLIPEDKRESKYPIFATLTEEKEYHKQFPTIYHLRKQLADSKEKTDLRLIYLALAHMIKYRGHFLYEEAFDIKNNDIQKIFNEFISIYDNTFEGSSLSGQNAQVEAIFTDKISKSAKRERVLKLFPDEKSTGLFSEFLKLIVGNQADFKKHFDLEDKAPLQFSKDTYDEDLENLLGQIGDDFTDLFVSAKKLYDAILLSGILTVTDPSTKAPLSASMIERYENHQNDLAALKQFIKNNLPEKYDEVFSDQSKDGYAGYIDGKTTQETFYKYIKNLLSKFEGTDYFLDKIEREDFLRKQRTFDNGSIPHQIHLQEMNAILRRQGEYYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVNQLFKENRKVTEKDIIHYLHNVDGYDGIELKGIEKQFNASLSTYHDLLKIIKDKEFMDDAKNEAILENIVHTLTIFEDREMIKQRLAQYDSLFDEKVIKALTRRHYTGWGKLSAKLINGICDKQTGNTILDYLIDDGKINRNFMQLINDDGLSFKEIIQKAQVIGKTDDVKQVVQELSGSPAIKKGILQSIKIVDELVKVMGHAPESIVIEMARENQTTARGKKNSQQRYKRIEDSLKILASNILKENPTDNNQLQNDRLFLYYLQNGKDMYTGEALDINQLSSYDIDHIIPQAFIKDDSLDNRVLTSSKDNRGKSDNVPSIEVVQKRKAFWQQLLDSKLISERKFNNLTKAERGGLDERDKVGFIKRQLVETRQITKHVAQILDARYNTEVNEKDKKNRTVKIITLKSNLVSNFRKEFRLYKVREINDYHHAHDAYLNAVVAKAILKKYPKLEPEFVYGEYQKYDLSKDPKEVEKATEKYFFYSNLLNFFKEEVHYADGTIVKRENIEYSKDTGEIAWNKEKDFAIIKKVLSLPQVNIVKKREVQTGGFSKESILPKGNSDKLIPRKTKDILLDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPGHLEYIQKHRNEFKDLLNLVSEFSQKYVLADANLEKIKSLYADNEQADIEILANSFINLLTFTALGAPAAFKFFGKDIDRKRYTTVSEILNATLIHQSITGLYETWIDLSKLGED

SEQ ID NO: 13 - protein, 986 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGNPYEARVKGLSQKLSEEEFSAALLHLAKRRGVHNVNEVEEDTGNELSTKEQISRNSKLEEKYVAELQLERLKKDGEVRGSINRKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKENAELLDQIAKILTIYQSSEDIQEELTNLNSELTQEEIEQISNLKGYTGTHNLSLKAINLILDELWTNDNQIAIFNRLKLVPKKVDLSQQKEIPTTLVDDFILSPVVKRSFIQSIKVINAIIKKYGLPNDIIIELAREKNSKDAQKMINEMQKQTNEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDQKDFINRNLVDTRYATRGLMNLLRSYFRVNNLDVKVKSINGGFTSFLRRKWKFKKERNKGYKHHAEDALIIANADFIFKEWKKLDKNQMFEEKETEQEYKEIFITPHQIKHIKDFKDYKYSHRVDKKPNREVNNLNGLYDKDNDKLKKLINKSPEKLLMYHHDPQTYQKKLIMEQYGDEKNLYKYYEETGNYLTKYSKKDNGPVIKKIKYYGNKLNAHLDITDDYPNSVKLSLKPYRFDVYLDNGVYKFVTVKNLDVIKKENYYEVNSKAYEEAKKKKISNQAEFIASFYNNDLIKINGELYRVIGVNNDLLNRIEVNMIDITYREYLENMNDKRPPRIIKTIASKTQSIKKLYEVKSKKHPQIIKKG

SEQ ID NO: 14 - protein, 1044 aa, Streptococcus pyogenes
LSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 15 - protein, 1359 aa, Streptococcus pyogenes; identical to SEQ ID NO: 10

SEQ ID NO: 16 - protein, 1359 aa, Streptococcus pyogenes
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 17 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSNNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 18 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 19 - protein, 1359 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTVWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 20 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVETTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 21 - protein, 1358 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 22 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGLTIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 23 - protein, 1358 aa, Streptococcus pyogenes
MDKKYSIGLDIGTNSVGWAVITDDYKVPSKKLKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYETRIDLSQLGGD

SEQ ID NO: 24 - protein, 1358 aa, Streptococcus pyogenes
MDKKYSIGLDIGTNSVGWAVITDDYKVPSKKLKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYEIRIDLSQLGGD

SEQ ID NO: 25 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKASLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 26 - protein, 1359 aa, Streptococcus pyogenes
MDKKYSIGLDIGTNSVGWAVITDDYKVPSKKFKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 27 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFIKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNFGAPAAFIYFDTTIGRNRYKSIKEVLDATLIHQSITGLYETRIDLSQLGGD

SEQ ID NO: 28 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 29 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGGLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 30 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINANGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 31 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKKNGLFGNLIALLLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKKYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 32 - protein, 1359 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNRKDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 33 - protein, 1184 aa, Streptococcus pyogenes
PDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 34 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 35 - protein, 1358 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDTKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYETRIDLSQLGGD

SEQ ID NO: 36 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKIVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 37 - protein, 1270 aa, Streptococcus pyogenes
MAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 38 - protein, 536 aa, Streptococcus pyogenes MGAS2111
QELDINRLSGYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 39 - protein, 305 aa, Streptococcus pyogenes SS1447
IETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 40 - protein, 1359 aa, Artificial Sequence
  Synthetic polypeptide
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 41 - protein, 1341 aa, Artificial Sequence
  Synthetic polypeptide
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQMTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 42 - protein, 1356 aa, Artificial Sequence
  Synthetic polypeptide
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFQRLDESFLRWDDDNKKLGRYPIFGNKADVVKYHQEFPTIYHLRKHLADSSEKADLRLVYLALAHMIKFRGHFLIEGELNAENTDVQKIFADFVGVYDRTFDDSHLSEITVDAASILTEKISKSRRLENLIKYYPTEKKNTLFGNLIALALGLQPNFKMNFKLSEDAKLQFSKDSYEEDLGELLGKIGDDYADLFTSAKNLYDAILLSGILIVDDNSTKAPLSASMIKRYVEHQEDLEKLKEFIKANKSELYHDIFKDKNKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFSWAEYHSDEKITPWNFDKVIDKEKSAEKFITRMTLNDLYLPEEKVLPKHSHVYETYAVYNELTKIKYVNEQGKDSFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTADQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQNSLKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTESDENDKVIRDVKVITLKSNLVSQFRKDFEFYKVREINDYHHAHDAYLNAVVGTALLKKYPKLASEFVYGEYKKYDISSDKATAKYFFYSNLMNFFKRVIRYSNGKVIVRPVVEYSKDTEDIAWDKKSNFRTICKVLSYPQVNIVKKVETQTGGFSKESILPKGDSDKLIPRKTKKAYWDTKKYGGFDSPTVAYSVFVVADVEKGKAKKLKTVKELVGISIMERSFFEENPVEFLENKGYHNIREDKLIKLPKYSLFEFEGGKRRLLASASELQKGNEMVIPGHLVKLLYHAQRINSFNSTKYLDYVSAHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKIGEE

SEQ ID NO: 43 - protein, 1365 aa, Streptococcus agalactiae
MNKPYSIGLDIGTNSVGWSIITDDYKVPAKKIRVLGNTDKEYIKKNLIGALLFDGGNTAADRRLKRTARRRYTRRRNRILYLQEIFAEEMSKVDDSFFHRLEDSFLVEEDKRGSKYPIFATLQEEKYYHEKFPTIYHLRKELADKKEKADLRLVYLALAHIIKFRGHFLIEDDRFDVRNTDIQKQYQAFLEIFDTTFENNDLLSQDVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIVADSSKDGYAGYIEGKTNQEAFYKYLSKLLTKQEGSEYFLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKRLDIYKDFFTESQLKKLYRRHYTGWGRLSAKLINGIRNKENQKTILDYLIDDGSANRNFMQLIKDAGLSFKPIIDKARTGSHSDNLKEVIGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFVFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQFMKFLYLASRYNESKGKPEEIEKKQEFVNQHVSYFDDIFQIINDFSKRVILADANLEKINRLYQDNKENIPVDELANNIINLFTFTSLGAPAAFKFFDKIVDRKRYTSTKEVLNSTLIHQSITGLYETRIDLGKLGED

SEQ ID NO: 44 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFPTIYHLRKELADKQEKADLRLIYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGLYRRKKLSKIVRATRKMFFYSNLMNMFKRVVRLADGSIVVRPVIETGRYMGKTAWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSKFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLSKLGED

SEQ ID NO: 45 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNITFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 46 - protein, 1369 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTIFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGETIDRLQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 47 - protein, 1363 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIIQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 48 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDDLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 49 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 50 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGGD

SEQ ID NO: 51 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 52 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVVGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 53 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLRQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 54 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSAYMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHISYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 55 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQHYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 56 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWERLSAKLINGIRNKENQKTILDYLIDDGSANRNFMQLIKDAGLSFKPIIDKARTGSHLDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEVQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQYMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 57 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHLDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEVQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQYMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 58 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 59 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 60 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPKVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHKSITGLYETRIDLGKLGED

SEQ ID NO: 61 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPLLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLDIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 62 - protein, 1365 aa, Streptococcus agalactiae
  misc_feature (117)..(117): Xaa can be any naturally occurring amino acid
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYXIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 63 - protein, 1365 aa, Streptococcus agalactiae
MNKPYSIGLDIGTNSVGWSIITDDYKVPAKKMRVLGNTDKEYIKKNLIGALLFDGGNTAADRRLKRTSRRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 64 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTCRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 65 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 66 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGETLDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEREFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 67 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQFITGLYETRIDLGKLGED

SEQ ID NO: 68 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 69 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 70 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSEKKPKYVKDQVENHHLSDDRLFLYYLQNGKDMYTDDELDIDNLSQYDIDLIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 71 - protein, 1365 aa, Streptococcus agalactiae
MNKPYSIGLDIGTNSVGWSIITDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLFYLALAHIIKFRGHFLIEDDSFDVRNTDIQRQYQAFLEIFDTTFENNHLLSQNIDIEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLIDDGKSNRNFMQLIHDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 72 - protein, 1365 aa, Streptococcus agalactiae
MNKPYSIGLDIGTNSVGWSIITDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLFYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLIDDGKSNRNFMQLIHDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 73 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFPTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 74 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTALSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 75 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVAADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 76 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKASLSDSMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 77 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVEIRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 78 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTVKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 79 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDELFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGGD

SEQ ID NO: 80 - protein, 1365 aa, Streptococcus agalactiae; identical to SEQ ID NO: 49

SEQ ID NO: 81 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNKGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 82 - protein, 1365 aa, Streptococcus agalactiae
MNKPYSIGLDIGTNSVGWSIITDDYKVPAKKMRVLGNTDKEYIKKNLIGALLFDGRNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 83 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDSFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHKSITGLYETRIDLGKLGED

SEQ ID NO: 84 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVIKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 85 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVASILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 86 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIESKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 87 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNLSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIIDRKRYTSTKEVLNSTLIHQSITGLYETRIDLGKLGED

SEQ ID NO: 88 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKDIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 89 - protein, 1365 aa, Streptococcus agalactiae 138P
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKIILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDILKEYPTDNQALQNERLFLYYLQNGRDMYTGEALDIDSLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 90 - protein, 1365 aa, Streptococcus agalactiae H36B
  misc_feature (9)..(9): Xaa can be any naturally occurring amino acid
MNKPYSIGXDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 91 - protein, 1365 aa, Streptococcus agalactiae ILRI112
MNKPYSIGLDIGTNSVGWSIITDDYKVPAKKMRVLGNTDKEYIKKNLIGALLFDGGNTAADRRLKRIARRRYTRRRNRILYLQEIFAEKMSKVDDSFFHRLEDSFLVEEDKRGSKYPIFATLQEEKDYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPDQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEELVDKEASAEAFIHCMTNNDLYLPEEKVLPKHSLIYEKFTVYNELTKVRYKNEQGETYFFDSNIKQEIFDGVFKEYRKVSKKQLLDFLAKEFEEFRIVDVTGLDKENKAFNASLGTYHDLEKILGKDFLDNPDNESILEDIVQTLTLFEDREMIKKRLDIYKDFFTESQLKKLYRRHYTGWGRLSAKLINGIRNKENQKTILDYLIDDGSANRNFMQLIKDAGLSFKSIISKAQSGSHSDNLKEVVSELAGSPAIKKGILQSLKIVDELVKVMGYKPEQIVVEMARENQTTNQGRRNSRQRYKLLDDGVRNLASNILKEYPTDNQALQNERLFLYYLQNGRDMYTEKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQFMKFLYLASRYNESKGKPEEIEKKQEFVNQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 92 - protein, 1351 aa, Streptococcus anginosus
MNQKYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVDEDKRGERHPIFGNIAAEVKYHDEFPTIYHLRKHLADISQKADLRLVYLALAHMIKFRGHFLIEGQLKAENTNVQALFKDFVEVYDKTVEESHLSEITVDALSILTEKVSKSRRLENLIAHYPAEKKNTLFGNLIALFLGLQPNFKTNFQLSEDAKLQFSKDTYEEDLEGLLGEVGDEYADLFASAKNLYDAILLSGILTVDDNSTKAPLSASMVKRYEEHQKDLKKFEDFIKVNALDQYNAIFKDKNKKGYAGYIESGVKQDEFYKYLKGILLQINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENAQIIEDIIQTLTLFEDREMIRQRLQKYSDIFTKAQLKKLERRHYTGWGRLSYKLINGIRNKENKKTILDYLIDDGYANRNFMQLINDDALSFKEEIAKAQIIGDVDDIANVVHDLPGSPAIKKGILQSVKIVDELVKVMGHNPANIIIEMARENQTTDRGRRNSQQRLKLLQDSLKPVNIKNVENQQLQNDRLFLYYIQNGKDMYTGETLDINNLSQYDIDHIIPQAYIKDDSFDNRVLTSSSENRGKSDNVPSIEVVCARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVSDKEIGKATAKYFFYSNLMNFFKKEVKFADGTVVERPDIETSEDGEIAWNKQTDFKIVRKVLSYPQVNIVKKTEVQTHGLDRPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASRGEIHKGNELFVPQKFTTLLYHAKRINNPINKDHIEYVKKHRDDFKELLNYVLEFNEKYVGATKNGERLKEAVADFDSKSNEEICTSFLGLFELTSLGSASDFEFLGVKIPRYRDYTPSSLLKDSTLIHQSITGLYETRIDLSKLGED

SEQ ID NO: 93 - protein, 1341 aa, Streptococcus anginosus
MKKEYSIGLDIGTNSVGWAVITDDYKVPAKKMKVLGNTDKQSIKKNLLGALLFDSGETAEATRLKRTARRRYTRRKNRLRYLQEIFTEEMNKVDENFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQPNFKTNFQLSEDAKLQFSKDTYEEDLEELLGEIGDEYADLFASAKNLYDAILLSGILAVDDNTTKAPLSASMVKRYEEHQKDLKKLKDFIKVNAPDQYNAIFKDKNKKGYAGYIESGVEQDEFYKYLKGILLKINGSGDFLDKIDCEDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKNPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 94 - protein, 1341 aa, Streptococcus anginosus
MKKEYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVEEDKRGSRYPIFGNIAAEVKYHDDFPTIYHLRKHLVDISQKADLRLVYLALAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYEEHQKDLKKLKDFIKVNAPAQYDDIFKDETKNGYAGYIENGVKQDEFYKYLKNTLSKIDGSDYFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNASLGTYHDLRKILDKSFLDDKVNEKIIEDIIQTLTLFEDREMIRQRLQKYSDIFTTQQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 95 - protein, 1341 aa, Streptococcus anginosus T5; identical to SEQ ID NO: 93

SEQ ID NO: 96 - protein, 1360 aa, Streptococcus caballi
MTKKNYSIGLDIGTNSVGWAVITDDYKVPAKKMKVLGNTDKKYIKKNLLGALLFDSGETAEATRLKRTARRRYTRRKNRLRYLQDIFTEEMAKVDDSFFQRLDESFLTDNDKNFDSHPIFGNKAEEDAYHQKFPTIYHLRKHLADSTEKADLRLVYLALAHMIKFRGHFLIEGELNAENTDVQKLFTDFVGVYDRTFDDSHLSEITVDAASILTEKISKSRRLENLINNYPKEKKNTLFGNLIALALGLQPNFKTNFKLSEDAKLQFSKDTYEEDLEELLGKIGDDYADLFTSSKNLYDAILLSGILTVDDNSTKAPLSASMIKRYVEHHEDLEKLKEFIKANKSELYHDIFKDKTQNGYAGYIENGVKQDEFYKYLKGILTKINGSDYFLDKIEREDFLRKQRTFDNGSIPHQIHLQEMHAILRRQGDYYPFLKENQEEIEKILTFRIPYYVGPLARKDSRFAWAEYRSDEKITPWNFDKVIDKEKSAEKFITRMTLNDLYLPEEKVLPKHSHVYETFAVYNELTKVKYVNEQGKDSFFDSNMKQEIFDHVFKENRKVTKEKLLNYLDKEFPEYRIQDLVGLDKENKSFNASLGTYHDLKKILDKSFLDDKVNEEVIEDIIKTLTLFEDREMIQQRLQKYSDIFTKQQLKKLERRHYTGWGRLSYKLINGIRNKENNKTILDYLIDDGSANRNFMQLINDDALSFKQIIQEAQVVGDVDDIETVVHDLPGSPAIKKGILQSVKIVDELIKVMGDNPDNIVIEMARENQTTNRGRSQSQQRLKKLQNSLKPSYIEDKVENSHLQNDQLFLYYIQNGKDMYTGDELDIDHLSDYDIDHIIPQAFIKDDSIDNRVLTSSAKNRGKSDDVPSLGIVRARKAEWVRLYKSGLISKRKFDNLTKAERGGLTEADKAGFIKRQLVETRQITKHVAQILDARFNTERDENDKVIRDVKVITLKSNLVSQFRKEFKFYKVREINDYHHAHDAYLNAVVGTALLKKYPKLAPEFVYGEYKKYDVSSDDHSEMGKATAKYFFYSNLMNFFKRVIRYSNGKVIVRPVVEYSKDTGEIAWNKRTDFEKVRKVLSYPQVNIVKKVETQTGGFSKESILPKGDSDKLIPRKTKKVLWEPKKYGGFDSPTVAYSVLVVADVEKGKTKKLKTVKELVGISIMERSFFEKNPVEFLKNKGYQNVQEDKLMKLPKYSLFEFEGGRRRLLASATELQKGNEIMLSAHLVALLYHAHRIGNFNSAEHLKYVSEHKKEFEEVLSCVENFANVYVDVEKNLSKIRAAADSMDNFSIEEISDSFINLLTLTALGAPADFNFLGEKIPRKRYNSTKECLNATLIHQSITGLYETRIDLSKLGEE

SEQ ID NO: 97 - protein, 1355 aa, Streptococcus canis
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 98 - protein, 1341 aa, Streptococcus constellatus
MGKPYSIGLDIGTNSVGWAVVTDDYKVPAKKMKVLGNTDKQSIKKNLLGALLFDSGETAEATRLKRTARRRYTRRKNRLRYLQEIFTGEMNKVDENFFQRLDDSFLVDEDKRGEHHPIFGNIAAEVKYHDDFPTIYHLRRHLADTSKKADLRLVYLALAHMIKFRGHFLYEGDLKAENTDVQALFKDFVEEYDKTIEESHLSEITVDALSILTEKVSKSSRLENLIAHYPTEKKNTLFGNLIALSLDLHPNFKTNFQLSEDAKLQFSKDTYEEDLEGFLGEVGDEYADLFASAKNLYDAILLSGILTVDDNSTKAPLSASMVKRYEEHQKDLKKLKDFIKVNAPDQYNAIFKDKNKKGYASYIESGVKQDEFYKYLKGILLKINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYEAFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIDDVDDIANVVHDLPGSPAIKKGILQSVKIVDELVKVMGHNPANIIIEMARENQTTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWDPKKYGGFDSPVVAYSILVFADVEKGKSKKLRKVQDMVGITIMEKKRFEKNPVDFLEQRGYRNVRLEKIIKLPKYSLFELENKRRRLLASAKELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 99 - protein, 1355 aa, Streptococcus constellatus
MTQKYSIGLDIGTNSVGWAIVTDDYKVPAKKMKILGNTNKQYIKKNLLGALLFDSGETAKATRLKRTARRRYTRRKNRLRYLQEIFIEEMNKVDENFFQRLDDSFLVTEDKRGSKYPIFGTLKEEKEYYKEFETIYHLRKRLADSTGKVDLRLVYLALAHMIKFRGHFLIEGQLKAENTDVQTLFNDFVEVYDKTIEESHLAEITVDALSILTEKVSKSRRLENLVKCYPTEKKNTLFGNLIALSLGLQPNFKTNFQLSEDAKLQFSKDTYEEDLEELLGKIGDDYADLFTSAKNLYDTILLSGILAVDDNSTKALLSASMIKRYEEHQKDLKKLKDFIKVNAPAQYDDIFKDETKNGYAGYIENGVKQDEFYKYLKNTLSKIDGSGYFLDKIEREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYEIFTVYNELTKVKYVNEQGEAKFFDANMKQEIFDHVFKENPKVTKDKLLNYLDKEFDEFRIVDLTGLDKENKAFNASLGTYHDLRKILDKSFLDDKANEKTIEDIIQTLTLFEDREMIRQRLQKYSDIFTKAQLKKLERRHYTGWGRLSYKLINGIRNKENNKTILEYLVDDGYANRNFMQLINDDTLPFKQIIKDAQAIDDVDDIELIVHDLPGSPAIKKGILQSIKIVDELVKVMGYNPDNIVIEMARENQTTTKGRRNSQQRLKLLQDSLTPVSIKNVENQQLQNDRLFLYYIQNGKDMYTGEELDIHHLSDYDIDHIIPQAFIKDDSIDNRVLTSSAKNRGKSDNVPNLEVVCDRKADWIRLREAGLISQRKFDNLTKAERGGLTENDKAGFIHRQLVETRQITKHVAQILDARFNPKRDDNKKVIRDVKIITLKSNLVSQFRRDFKLYKVREINDYHHAHDAYLNAVVGTALLKKYPKLTSEFVYGEYKKYDVSDNDEIGKATAKYFFYSNLMNFFKTEVKFADGTVVERPDIETSEDGEIAWNKQTDFKIVRKVLSYPQVNIVKKVEKQTGRFSKESILPKGDSDKLIARKTKENYWDTKKYGGFDSPTVAYSVLVVADIKKGKAKKLKTVKELVGISIMERPFFEKNPIMFLESKGYRNIQKDKLIKLPKYSLFEFEGGRRRLLASAVELQKGNEMVLPQYLNNLLYHAHRIDNSDNSEHLKYITEHKEEFGKLLSYIENFAKSYVDVDKNLEKIQLAVEKIDSFSVKEISNSFIHLLTLTALGAPADFNFLGEKIPRKRYTSTKECLNATLIHQSITGLYETQTDLSKLGED

SEQ ID NO: 100 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKILTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYTKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGMTLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 101 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEEKINASGVDAKAILSARLSKSKRLENLIAQLPGEKKNGLFGNLIALSLGLTPNFKSNFDLAEDAKLQLSKDTYDDDLDNLLAQIGNQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 102 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWNKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 103 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 104 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKCKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 105 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 106 - protein, 1345 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKDGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKMLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERTAFEENPVVFLEARGYREIQEHLIIKLPKYSLFELENGRRRLLASSELQKGNELFLPVDYMTFLYLAAHYHELTGSSEDVLRKKYFVDRHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 107 - protein, 1345 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKDGFANRNFMQLIHDSELSFIDEIAKAQVIGKTEYSKDLVGNLASSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKTLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERIAFEENPVVFLEAKGYREIQEHLIIKLPKYSLFELENGRRRLLASSELQKGNELFLPVDYMTFLYLAAHYHELTGSSEDVLRKKYFVERHLHYFDDIIQMINDFAERHILASSNLEKINHTYHNNSDLPINERAENIINVFTFVALGAPAAFKFFDATIDRKRYTSTKEVLNATLIHQSVTGLYETRIDLSQLGEN

SEQ ID NO: 108 - protein, 1345 aa, Streptococcus equi
MKKPYTIALDIGTNSVGWVVVTDDYRVPTKKMKVLGNTERKTIKKNLIGALLFDSGDTAEGTRLKRTARPRYTRRKNRLRFLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKDGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQLQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKTLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERIAFEENPVVFLEAKGYREIQEHLIIKLPKYSLFELENGRRRLLASSELQKGNELFLPVDYMTFLYLAAHYHELTGSSEDVLRKKYFVERHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 109 - protein, 1360 aa, Streptococcus equinus
MEKTYSIGLDIGTNSVGWAVITDDYKVPAKKMKVLGNTDKKYIKKNLLGALLFDSGETAEATRLKRAARRRYTRRKNRLRYLQEIFAKEMAKVDESFFQRLEESFLTDDDKTFDSHPIFGNKAEEDTYHQEFPTIYHLRKHLADSPEKVDLRLVYLALAHMIKFRGHFLIEGQLNAENTDVQKIFADFVGVYDRTFDDSHLSEITVDAASILTEKISKSRRLENLIKQYPTEKKNTLFGNLVALALGLQPNFKTNFKLSEDAKLQFSKDTYDEDLEELLGKIGDDYADLFTAAKNLYDAILLSGILTVDDNSTKAPLSASMIKRYEEHHEDLEKLKTFIKVNNFDKYHEIFKDKSKNGYAGYIENGVKQDIFYKHLKSIISEKNGGQYFLDKIEREDFLRKQRTFDNGSIPYQIHLQEMRTILRRQGEYYPFLKENQAKIEKILTFRIPYYVGPLARKNSRFAWAKYHSDEPITPWNFDEVVDKEKSAEKFITRMTLNDLYLPEEKVLPKHSYVYETFAVYNELTKIKYVNEQGKSFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDIFTSQQLKKLERRHYTGWGRLSYKLINGIRNKENNKTILDFLIDDGDANRNFMQLINDDSLSFKTTIQEAQVVGDVDDIEAVVHDLPGSPAIKKGILQSVKIVDELVKVMGHNPQNIVIEMARENQITGYGRNRSNQRLKRLQDSLKPSYVDSKVENSHLQNDRLFLYYIQNGKDMYTGEELDIDHLSDYDIDHIIPQAFIKDNSIDNRVLTSSAKNRGKSDDVPSIEIVRNRKSYWYKLYKSGLISKRKFDNLTKAERGGLTETDKAGFIKRQLVETRQITKHVAQILDARFNTKCDENDKVIRDVKVITLKSSLVSQFRKEFKFYKVREINDYHHAHDAYLNAVVGTALLKKYPKLAPEFVYGEYKKYDVSSDNHSELGKATAKYFFYSNLMNFFKTEVKYADGRVFERPDIETNADGEVVWNKQRDFNIVRKVLSYPQVNIVKKVEVQTGGFSKESILPKGDSDKLIPRKTKKLQWETQKYGGFDSPTVAYSVLVVADVEKGKTRKLKTVKELVGISIMERSSFEENPVSFLEKKGYHNVQEDKLIKLPKYSLFEFEGGRRRLLASATELQKGNEVVLPQYMVNLLYHSQHVNNSHKPEHLNYVKQHKDEFKDIFNLIISIARINILKPKVVDNLINEFTEYGQEDISSLSESFINLLKFISFGAPGAFKFLKLDVKQSNLRYKSTTEALSATLIHQSVTGLYETRIDLSKLGEE

SEQ ID NO: 110 - protein, 1353 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFYRLDESFLTTDEKDFERHPIFGNKAEEDAYHQKFPTIYHLRNYLADSSEKADLRLVYLALAHMIKYRGHFLIEGKLNAENTDVQKLFTDFVGVYDRTFDDSHLSEITVDVASTLTEKISKSRRLENLIKYYPTEKKNTLFGNLIALALGLQPNFKMNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNTLSKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQSSLKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDISSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLTATLIHQSITGLYETRIDLSKLGEE

SEQ ID NO: 111 - protein, 1354 aa, Streptococcus gallolyticus
MTEKNYSIGLDIGTNSVGWAVITDDYKVPAKKMKVLGNTDKKYIKKNLLGALLFDNGETAEATRLKRTARRRYTRRKNRLRYLQEIFAEEMAKVDESFFYRLDESFLTTDDKDFERHPIFGNKADEIKYHQEFPTIYHLRKHLADSHEKADLRLIYLALAHMIKFRGHFLIEGELNAENTDVQKLFEAFVEVYDRTFDDSNLSEITVDASSILTEKFSKSRRLENLIKHYPTEKKNTLFGNLVALALGLQPNFKTSFKLSEDAKLQFSKDTYEEDLEELIGKIGDEYADLFTSAKNLYDAILLSGILTVADNTTKAPLSASMIKRYNEHQVDLKKLKEFIKNNASDKYDEIFNDKDKNGYAGYIENGVKQDEFYKYLKTTLSKIDGSDYFLDKIEREDFLRKQRTFDNGSIPHQIHLQEMHAILRRQGEHYAFLKENQAKIEKILTFRIPYYVGPLARKNSRFAWAEYHSDEKITPWNFDEIIDKEKSAEKFITRMTLNDLYLPEEKVLPKHSLVYETYTVYNELTKVKYVNEQGKSNFFDANMKQEIFEHVFKENRKVTKDKFLNYLNKEFPEYRIQDLIGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKSILDYLIDDGYANRNFMQLISDDTLPFKQIIKDAQIIGDIDDVTSVVRELPGSPAIKKGILQSVKIVDELVKVMGHNPDNIVIEMARENQTTNRGRNQSQQRLKKLQDSLKPSYIEGKVENNHLQDDRLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTENDKAGFIKRQLVETRQITKHVAQILDSRFNTERDENDKVIRNVKVITLKSNLVSQFRKDFKFYKVREINDYHHAHDAYLNAVVGTALLKKYPKLAPEFVYGEYKKYDISGDKATAKYFFYSNLMNFFKRVIRYSNGKVVVRPVIECSKDTGEIAWNKQTDFEKVRRVLSYPQVNIVKKVETQTGGFSKESILPKGNSDKLIPRKTKKFRWDTPKYGGFDSPNIAYSVFVIADVEKGKAKKLKTVKELVGISIMERSSFEENPVVFLEKKGYQNVQEDNLIKLPKYSLFEFEGGRRRLLASASELQKGNEVVLSRHLVELLYHAHRVNSFNNSEHLKYVSEHKKEFGEVLSCVENFAKSYVDVEKNLGKIRAVADKIDTFSIEDISISFVNLLTLTALGAPADFNFLGEKIPRKRYTSTKECLNATLIHQSITGLYETRIDLSKLGEE

SEQ ID NO: 112 - protein, 1355 aa, Streptococcus gallolyticus; identical to SEQ ID NO: 11

SEQ ID NO: 113 - protein, 1358 aa, Streptococcus infantarius
MEKSYSIGLDIGTNSVGWAVITDDYKVPAKKMKVLGNTDKKYIKKNLLGALLFDSGETAEVTRLKRTARRRYTRRKNRLRYLQEIFAKEMTKVDESFFQRLEESFLTDDDKTFDSHPIFGNKAEEDAYHQKFPTIYHLRKYLADSQEKADLRLVYLALAHMIKYRGHFLIEGELNAENTDVQKLFNVFVETYDKIVDESHLSEIEVDASSILTEKVSKSRRLENLIKQYPTEKKNTLFGNLIALALGLQPNFKTNFKLSEDAKLQFSKDTYEEDLEELLGKVGDDYADLFISAKNLYDAILLSGILTVDDNSTKAPLSASMIKRYVEHHEDLEKLKEFIKINKLKLYHDIFKDKTKNGYAGYIDNGVKQDEFYKYLKTILTKIDDSDYFLDKIERDDFLRKQRTFDNGSIPHQIHLQEMHSILRRQGDYYPFLKENQAKIEKILTFRIPYYVGPLARKDSRFAWANYHSDEPITPWNFDEVVDKEKSAEKFITRMTLNDLYLPEEKVLPKHSHVYETFTVYNELTKIKYVNEQGESFFFDANMKQEIFDHVFKENRKVTKAKLLSYLNNEFEEFRINDLIGLDKDSKSFNASLGTYHDLKKILDKSFLDDKTNGQIIEDIVLTLTLFEDRDMIHERLQKYSDFFTSQQLKKLERRHYTGWGRLSYKLINGIRNKENNKTILDFLIDDGHANRNFMQLINDESLSFKTIIQEAQVVGDVDDIEAVVHDLPGSPAIKKGILQSVKIVDELVKVMGDNPDNIVIEMARENQTTGYGRNKSNQRLKRLQDSLKPSYVDSKVENSHLQNDRLFLYYIQNGKDMYTGEELDIDRLSDYDIDHIIPQAFIKDNSIDNKVLTSSAKNRGKSDDVPSIEIVRNRRSYWYKLYKSGLISKRKFDNLTKAERGGLTEADKAGFIKRQLVETRQITKHVAQILDARFNTKRDENDKVIRDVKVITLKSNLVSQFRKEFKFYKVREINDYHHAHDAYLNAVVGTALLKKYPKLTPEFVYGEYKKYDVSSDDYSEMGKATAKYFFYSNLMNFFKTEVKYADGRVFERPDIETNADGEVVWNKQKDFDIVRKVLSYPQVNIVKKVEAQTGGFSKESILSKGDSDKLIPRKTKKVYWNTKKYGGFDSPTVAYSVLVVADIEKGKAKKLKTVKELVGISIMERSFFEENPVSFLEKKGYHNVQEDKLIKLPKYSLFEFEGGRRRLLASATELQKGNEVMLPAHLVELLYHAHRIDSFNSTEHLKYVSEHKKEFEKVLSCVENFSNLYVDVEKNLSKVRAAAESMTNFSLEEISASFINLLTLTALGAPADFNFLGEKIPRKRYTSTKECLSATLIHQSVTGLYETRIDLSKLGEE

SEQ ID NO: 114 - protein, 1358 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 115 - protein, 1263 aa, Streptococcus iniae
  misc_feature (1257)..(1257): Xaa can be any naturally occurring amino acid
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYYFXEVKSSF

SEQ ID NO: 116 - protein, 1257 aa, Streptococcus iniae
  misc_feature (1255)..(1255): Xaa can be any naturally occurring amino acid
  misc_feature (1257)..(1257): Xaa can be any naturally occurring amino acid
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYXFX

SEQ ID NO: 117 - protein, 199 aa, Streptococcus iniae IUSA1
MEQDEFEKDPIAFLEKKGYQDIQTSSIIKLPKYSLFELENGRKRLLASKELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 118 - protein, 1271 aa, Streptococcus iniae SF1
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYYFDVRLSQVFRVTNVEF

SEQ ID NO: 119 - protein, 1345 aa, Streptococcus intermedius
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIEDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYIGPLARGKSDFSWLSRKSADKITPWNFDEIVDKESSAEAFINRMTNYDLYLPNQKVLPRHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKNLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIANIEKGKSKKLKLVKDLVGITIMERTIFEKNPVAFLERKGYRNVQEENIVKLPKYSLFELENGRRRLLASARELQKGNEIVLPNHLGTMLYHAKNIHKVDEPKHLDYVKKHKDEFKELLDVVSNFSKKNILAESNLEKIEELYAQNNNKDITELASSFINLLTFTAIGAPAAFKFFDNNIDRKRYTSTTEILNATLIHQSITGLYETRIDLSRLGGD

SEQ ID NO: 120 - protein, 1333 aa, Streptococcus massiliensis
MKKPYSIGLDIGTNSVGWAVVMEDYKVPSKKMKVLGNTDKQSIKKNLIGALLFDSGETAVERRLNRTTSRRYDRRRNRIRYLQHIFAEEMNRADENFFHRLKESFFVEEDKTYSKYPIFGTLEEEKNYHKNYPTIYHLRKTLADTPDKMDIRLIYLALAHIIKYRGHFLIEGDLDIENIGIQDSFKSFIEEYNTQFGTKLDSTTKVEAIFTENSSKAKRVETILGLFPDETAAGNLDKFLKLMLGNQADFKKVFDLEEKITLQFSKDSYEEDLELLLSKIDEEYAALFDLAKKVYDAVLLSNILTVKEKNTKAPLSASMIKRYEEHKDDLKAFKRFFRERLPEKYETMFKDLTKPSYAAYVSGAVTEDDFYKFSKGLLIDVEGAEYFLEKIEREDFLRKQRTFDNGAIPNQVHVKELQAIILNQSKYYPFLAENKEKIEKILTFRIPYYVGPLARGNSSFAWLQRKSDEAIRPWNFEQVVDMETSASRFIERMTLHDLYLPDEKVLPRHSLIYEKYTVFNELTKVRFTPEGGKEVYFSKTDKENIFDSLFKRYRKVTKRKLKDFIEKELGYGYIDIDNIKGVEEQFNASYTTYQDLLKIIGDKEFLDNEENKDLLEEIIYILTVFEDRKMIEKRLSELNIPFENKIIKKLARKKYTGWGNLSRKLIDGIRNRETNRTILGHLIDDGFSNRNLMQLINDDGLDFKEIIRKAQTIENIDTNQALVSSLPGSPAIKKGILQSLNIVDEIIAIMGYAPTNIVIEMARENQTTQKGRDNSAQRLKKIEDGIKLGSDLLKQNPIQDNKDLQKEKLFLYYMQNGIDLYTGQPLNCDPDSLAFYDVDHIVPRSYIKNDSFDNKVLTTSKGNRKKLDDVPAKEVVEKMENTWRRLHAAGLISDIKLSYLMKGELTEEDKAGFIRRQLVETRQITKHVARLLDEKLNRKKNENGEKLRTTKIITLKSVFASRFRANFDLYKLRELNHYHHAHDAYLNAVVAQALLKVYPKFERELVYGSYVKESIFSRKATERMRMYNNILKFISKDKKDQETGEIVWDKKEIENIVKKVIYSSPVNIVKKREEQSGALFKQSNMAVGYNNKLIPRKKDWSVDKYGGFIEPAESYSLAIFYTDINGKKPKKKSTIIAISRMEKKDYEKEPERFLAQKGFERVEKTIKLPKYSLFEMEKGRRRLLASSGELQKGNQVLLPEHLIRLLSYAKKVDVLVKSKDDDYDLEEHRAEFAELLDCIKKFNDMYILASSNMSKIEEIYQKNIDAPIEEVARSFVLLNFTMMGAATDFKFFGQIIPRKRYPSTTECLKSTLIHQSVTGLYETRIDLSKLGEN

SEQ ID NO: 121 - protein, 1361 aa, Streptococcus mitis
NNKPYSIGLDIGTNSVGWAVITDDYKVPSKKMKVLGNTDKHFIKKNLLGALLFDEGTTAEDRRLKRTARRRYTRRKNRLRYLQEIFTEEMSKVDISFFHRLDDSFLVPEDKRGSKYPIFATLEEEKEYHKNFPTIYHLRKHLADSKEKADFRLIYLALAHIIKYRGHFLYEESFDIKNNDIQKIFNEFISIYDNTFEGSSLNGQNAQVEAIFTDKISKSAKRERVLKLFPDEKSTGLFSEFLKLIVGNQADFKKHFDLEEKAPLQFSKDTYDEDLENLLVQIGDDFADLFLVAKKLYDAILLSGILTVTDPSTKAPLSASMIDRYENHQKDLAALKQFIKTNLPEKYDEVFSDQSKDGYAGYIDGKTTQEAFYKYIKNLLSKLEGADYFLDKIEREDFLRKQRTFDNGSIPHQIHLQEMNAIIRRQGEHYPFLQENKEKIEKILTFRIPYYVGPLARGNRDFAWLTRNSDQAIRPWNFEEIVDKARSAEDFINKMTNYDLYLPEEKVLPKHSLLYETFAVYNELTKVKFIAEGLRDYQFLDSGQKQQIVTQLFKEKRKVTEKDIIQYLHNVDSYDGIELKGIEKQFNASLSTYHDLLKIIKDKEFMDDSKNEAILENIVHTLTIFEDREMIKQRLAHYASIFDEKVIKALTRRHYTGWGKLSAKLINGIYDKQSKKTILDYLIDDGEINRNFMQLINDDGLSFKEIIQKAQVVGKTNDVKQVVQELPGSPAIKKGILQSIKLVDELVKVMGHAPESIVIEMARENQTTARGKKNSQQRYKRIEDALKNLAHNILKEHPTDNIQLQNDRLFLYYLQNGKDMYTGKSLDINQLSSCDIDHIIPQAFIKDDSLDNRVLTSSKDNRGKSDNVPSLEIVQKRKAFWQQLLDSKLISERKFNNLTKAERGGLDERDKVGFIKRQLVETRQITKHVAQILDARFNTEVTEKDKKDRSVKIITLKSNLVSNFRKEFRLYKVREINDYHHAHDPYLNAVVAKAILKKYPKLEPEFVYGDYQKYDLTKDPKEVEKATEKYFFYSNLLNFFKEEVHYADGTIVKRENIEYSKDTGEIAWNKEKDFATIKKVLSLPQVNIVKKTEEQTGGLFDNNIVSKKKVVDASKLTPIKSGLSPEKYGGYARPTIAYSVLVIADIEKGKAKKLKRIKEMVGITVQDKKKFEANPIAYLEECGYKNINPNLIIKLPKYSLFEFNNGQRRLLASSIELQKGNELIVPYHFTALLYHAQRINKISEPIHKQYVETHQSEFKELLTAIISLSKKYIQKPNVESLLQQAFDQSDKDIYQLSESFISLLKLISFGAPGTFKFLGVEISQSNVRYQSVSSCFNATLIHQSITGLYETRIDLSKLGED

SEQ ID NO: 122 - protein, 1359 aa, Streptococcus mitis; identical to SEQ ID NO: 12

SEQ ID NO: 123 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 124 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELIKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 125 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSYPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFRNLVALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 126 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 127 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 128 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 129 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 130 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 131 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLTQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 132 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDRNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 133 - protein, 1336 aa, Streptococcus mutans
MKKSYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVMPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLEATLIHQSITGLYETRIDLNKLGGD

SEQ ID NO: 134 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 135 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDFFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQSEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGETAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 136 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 137 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 138 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 139 - protein, 1336 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLEATLIHQSITGLYETRIDLSKLGGD

SEQ ID NO: 140 - protein, 1345 aa, Streptococcus mutans
MKKPYSIGLDIGTNSVGWSVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRIDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 141 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 142 - protein, 1345 aa, Streptococcus mutans
MKKPYSIGLDIGTNSVGWAVVTDDYKVSAKKMKVLGNTDKSHIKKNLLGALLFDSGNTAEDRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHTHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 143 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSYKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 144 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGCFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 145 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 146 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVNDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 147 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFGGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 148 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMMQVDESFFQRLDDSFLVEEDKRGSRYPIFGTLKEEKKYHKEFKTIYHLREKLANSTEKADLRLVYLSLAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYKEHKEELAAFKRFIKEKLPKKYEEIFKDDTKNGYAGYVGADATEEEFYKYVKGILNKVEGADVWLDKIDREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENEQIIEDIIQTLTLFEDREMIRQRLQKYSDIFTKAQLKKLERRHYTGWGRLSYKLINGIRDKQSNKTILGYLIDDGYSNRNFMQLINDDALSFKEEIAKAQVIGEMDGLNQVVSDIAGSPAIKKGILQSLKIVDELVKVMGHNPANIVIEMARENQTTAKGRRSSQKRYKRLEEAIKDLNHKILKEHPTDNQALQNDRLFLYYLQNGRDMYTEDPLDINRLSDYDIDHIIPQAFIKDNSIDNRVLTRSDKNRGKSDDVPSEEVVHKMKPFWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKGDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLETLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLNKLGGD

SEQ ID NO: 149 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMDKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 150 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 151 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKHQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 152 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGQRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPDHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 153 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVKHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 154 - protein, 1345 aa, Streptococcus mutans
MKKPYSIGLDIGTNSVGWAVVTDDYKVPDKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 155 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 156 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIIGNQADFKKHFELEEKAPLQFSKDTYEEELEVLLAQIGDNYAELFLSAKKLYDSILLSGILTVTDVGTQAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 157 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 158 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGECHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGNGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 159 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKVPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 160 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQNLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 161 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKSKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 162 - protein, 1336 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYLKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLEATLIHQSITGLYETRIDLSKLGGD

SEQ ID NO: 163 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLVQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 164 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 165 - protein, 1336 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMNKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLEATLIHQSITGLYETRIDLSKLGGD

SEQ ID NO: 166 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYYENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 167 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILKATLIHQSITGLYETRIDLSKLGGD

SEQ ID NO: 168 - protein, 1338 aa, Streptococcus mutans NLML4
MDLIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 169 - protein, 1362 aa, Streptococcus oralis
ENKNYSIGLDIGTNSVGWAVITDDYKVPSKKMKVLGNTDKRFIKKNLIGALLFDEGTTAEARRLKRTARRRYTRRKNRLRYLQEIFAEEMSKVDSSFFHRLDDSFLIPEDKKGSKYPIFATLIEEKEYHKQFPTIYHLRKQLADSKEKTDLRLIYLALAHMIKYRGHFLYEDTFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFVAAKKLYDAILLSGILTVTDPSTKAPLSASMIERYENHQKDLATLKQFIKTNLPEKYDEVFSDQSKDGYAGYIDGKTTQESFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFLDSRQKKDIFYTLFKAEDKRKVTEKDIIQYLHTVDGYDGIELKGIEKQFNASLSTYHDLLKIIKDKEFMDDPNNEEILENIVHTLTIFEDREMIKQRLAQYDSLFDEKVIKALTRRHYTGWGKLSSKLINGIRDKQTGKTILDYLMDDGYNNRNFMQLINDDELSFKEIIKKAQVVGKTDDVKQVVQELPGSPAIKKGILQSIKLVDELVKVMGHEPESIVIEMARENQTTARGKKNSQQRYKRIEDSLKILASKILKEHPTDNIQLQNDRLFLYYLQNGRDMYTGKPLDINQLSSYDIDHIVPQAFIKDDSLDNRVLTSLKDNRGKSDNVPSLEVVEKMKTFWQQLLDSKLISYRKFNNLTKAERGGLDERDKVGFIKRQLVETRQITKHVAQILDARYNTEVNEKDKKNRTVKIITLKSNLVSNFRKEFRLYKIREINDYHHAHDAYLNAVVAKAILKKYPKLEPEFVYGDYQKYDLSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKRLKTVKTLVGITIMEKATFEKSPIAFLENKGYHNVRKENILCLPKYSLFELKNGRRRMLASAKELQKGNEIVLPVHLTTLLYHAKNIHRLDEPEHLEYIQKHRNEFKGLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 170 - protein, 1360 aa, Streptococcus oralis
ENKNYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLAEEKEYHKQFPTIYHLRKQLADSKEKTDLRLIYLALAHMIKYRGHFLYEDTFDIKNNDIQKIFSEFISIYDNTFEGSSLSGQNAQVEAIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLAVLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKEFMDDSKNEEILENIVHTLTIFEDREMIKQRLAQYDSLFDEKVIKALIRRHYTGWGKLSAKLIDGICDKQTGNTILDYLIDDGKNNRNFMQLINDDGLSFKEITQKAQVVGKTDDVKQVVQELPGSPAIKKGILQSIKIVDELVKVMGHTPESIVIEMARENQTTARGKKNSQQRYKRIEDALKNLASNILKEHPTNNIQLQNDRLFLYYLQNGRDMYTGKPLDINQLSSYDIDHIVPQAFIKDDSLDNRVLTSLKDNRGKSDNVPSIEVVQKRKAFWQQLLDSKLISERKFNNLTKAERGGLDERDKVGFIKRQLVETRQITKHVAQILDARFNKEVNEKDKKNRTVKIITLKSNLVSNFRKEFRLYKVREINDYHHAHDAYLNAVVAKAILKKYPKLEPEFVYGDYQKYDLSRNPKEVEKATEKYFFYSNLLNFFKEEVHYADGTIVKRENIEYSKDTGEIAWNKEKDFATIKKVLSYPQVNIVKKREVQTGGFSKESILPKGNSDKLIPRKTKDILWETTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPEHLEYIQKHRNEFKDLLNLVSEFSQKYVLADANLEKIQNLYADNEQADIEILANSFINLLTFTALGAPAAFKFFGKDIDRKRYTTVSEILNATLIHQSITGLYETRIDLSKLGED

SEQ ID NO: 171 - protein, 1358 aa, Streptococcus parasanguinis
KKPYSIGLDIGTNSVGWAVITDDYKVPAKKMKVLGNTNKESIKKNLIGALLFDAGNTAADRRLKRTARRRYTRRRNRILYLQEIFAAEMNKVDESFFHRLDDSFLVPEDKRGSKYPIFGTLEEEKEYHKQFPTIYYLRKILADSKEKVDLRLIYLALAHIIKYRGHFLYEDSFDIKNNDIQKIFNEFTILYDNTFEESSLSKGNAQVEEIFTDKISKSAKRDRVLKLFPDEKSTGLFSEFLKLIVGNQADFKKHFDLEEKAPLQFSKDTYEEDLESLLGQIGDVYADLFVVAKKLYDAILLAGILSVKDPGTKAPLSASMIERYDNHQNDLSALKQFVRRNLPEKYAEVFSDDSKDGYAGYIDGKTTQEGFYKYIKNLISKIEGAEYFLEKIEREDFLRKQRTFDNGSIPHQIHLQEMNAILRHQGEYYPFLKENKDKIEQILTFRIPYYVGPLARGNSDFAWLSRNSDEAIRPWNFEEMVDKSSSAEDFIHRMTNYDLYLPEEKVLPKHSLLYETFTVYNELTKVKYIAEGMKDYQFLDSGQKKQIVNQLFKEKRKVTEKDIIHYLHNVDGYDGIELKGIEKHFNSSLSTYHDLLKIIKDKEFMDDPKNEEIFENIVHTLTIFEDRVMIKQRLNQYDSIFDEKVIKALTRRHYTGWGKLSAKLINGIRDKKTSKTILDYLIDDGYSNRNFMQLINDDGLSFKETIQKAQVVGETNDVKQVVQELPGSPAIKKGILQSIKIVDELVKVMGHAPESVVIEMARENQTTNKGKSKSQQRLKTLSDAISELGNILKEHPTDNIQLQNDRLFLYYLQNGKDMYTGEALDINQLSNYDIDHIIPQAFIKDDSLDNRVLTSSKDNRGKSDNVPSLEIVEKMKGFWQQLLDSKLISERKFNNLTKAERGGLDERDKVGFIKRQLVETRQITKHVAQILDDRFNAEVNEKNQKLRSVKIITLKSNLVSNFRKEFGLYKVREINDYHHAHDAYLNAVVAKAILKKYPKLEPEFVYGDYQKYDLTKDPKEIEKATEKYFFYSNLLNFFKDKVYYADGTIIQRGNVEYSKDTGEIAWNKKRDFAIVRKVLSYPQVNIVKKTEEQTGGFSKESILPKGNSDKLIPRKTKNVQLDTTKYGGFDSPVIAYSILLVADVEKGKSKKLKTVKSLIGITIMEKVKFEANPVAFLEGKGYQNVVEENIIRLPKYSLFELENGRRRMLASAKELQKGNEMVLPSYLIALLYHAKRIQKKDEPEHLEYIKQHHSEFNDLLNFVSEFSQKYVLAESNLEKIKNLYIDNEQTNMEEIANSFINLLTFTAFGAPAVFKFFGKDIERKRYSTVTEILKATLIHQSLTGLYETRIDLSKLGEE

SEQ ID NO: 172 - protein, 1327 aa, Streptococcus parauberis
MKVLGNTDRQTVKKNMIGTLLFDSGETAEARRLKRTARRRYTRRINRIKYLQSIFDDEMSKIDSAFFQRIKDSFLVPDDKNDDRHPIFGNIKDEVDYHKNYPTIYHLRKKLADSDEKADLRLIYLALAHIIKFRGHFLIEGDLDSQNTDVNALFLKLVDTYNLMFEDDIDTQTIDATVILTEKMSKSRRLENLIAKIPNQKKNTLFGNLISLSLGLTPNFKANFELSEDAKLQISKESFEEDLDNLLAQIGDQYADLFIAAKNLSDAILLSDILTVKGVNTKAPLSASMVQRFNEHQDDLKLLKKLVKVQLPEKYKEIFDIKDKNGYAGYINGKTSQEDFYKYIKPILSKLKGAESLISKLEREDFLRKQRTFDNGSIPHQIHLNELKSIIRRQEKYYPFLKDKQVRIEKIFTFRIPYFVGPLANGNSSFAWVKRRSNESITPWNFEEVVEQEASAKVFIERMTNFDTYLPEEKVLPKHSLLYEMFTVYNELTKVKYQAEGMRKPEFLSSEEKIEIVSNLFKTERKVTVKQLKENYFNKIRCLDSITISGVEDKFNASLGTYHDLLNIIKNQKILDDEQNQDSLEDIVLTLTLFEDEKMIAKRLSKYESIFDPSILKKLKKRHYTGWGRLSQKLINGIRDKQTGKTILDFLIDGQANRNFMQLINDPSLDFASIIKEAQEKTIKSEKLEETIANLAGSPAIKKGILQSVKIVDEVVKVMGYEPSNIVIEMARENQSTQRGINNSRERLRKLEEVHKNIGSKILKEHEISNAQLQSDRVYLYLLQDGKDMYTGKDLDFDRLSQYDIDHIIPQSFIKDNSIDNIVLTSQESNRGKSDNVPYIAIVNKMKSYWQHQLKSGAISQRKFDNLTKAERGGLSEYDKAGFIKRQLVETRQITKHVAQILNNRFNNNVDDSSKNKRPVKIITLKSKMVSDFRKEFGFYKIREVNDYHHAHDAYLNAVVGTALLKKYPKLEAEFVYGDYKHYDLSDTSLGKATAKMFFYSNIMNFFKKEVRLADGTVITRPQIETNTETGEIVWDKVKDIKTIRKVLSIPQINVVKKTEVQTGGFSKESILSKRDSDKLIPRKNNWDPKKYGGFGSPIIAYSVLVVAKVTKGKSQKTKSVKELVGITIMEQNEFEKDRITFLEKKGYQDIQESLIIKLPKFSLFELENGRKRLLASELQKGNELSLPNKYIQFLYLASRYTSFSGKEEDREKHRHFVESHLHYFDEIKDIIADFSRRYILADANLEKILTLYNEKNQFSIEEQATNMLNLFTFTGLGAPATLKFFNVDIDRKRYTSSTEILNSTLIRQSITGLYETRIDLSKIGGD

SEQ ID NO: 173 - protein, 1355 aa, Streptococcus phocae
KKSYSIGLDIGTNSVGWAVITDDYKVPAKKMKVLGNTSRQSIKKNMIGALLFDEGGPAASTRVKRTTRRRYTRRKNRLCYLRDIFESEMHTIDKHFFLRLEDSFLHKSDKRYEAHPIFGTLQEEKAYHDNYPTIYHLRKALADNTEKADLRLIYLALAHIIKFRGHFLIEGALSANNTDVQQLVHALVDAYNIMFEEDLDIEAIDVKAILTEKISKTRRLENLISNIPGQKKNGLFGNLIALSLGLTPNFKSHFNLPEDAKLQLAKDTYDEELNNLLTQIGDEYADLFLSAKNLSDAILLSDILTVNGDGTQAPLSASLIKRYEEHRQDLALLKQMFKEQLPDLYRDVFTDENKDGYAGYISGKTSQEAFYKYIKPILETLDGAEDFLTKINREDFLRKQRTFDNGSIPHQIHLGELQAILERQQAYYPFLKDNQEKIEKILTFRIPYYIGPLARGNSRFAWLTRTSDQKITPWNFDEMVDQEASAQAFIERMTNFDEYLPQEKVLPKHSLTYEYFTVYNELTKVKYVTEGMTKPEFLSAGQKEQIVELLFKKYRKVTVKQLKEDFFSKIECFDTVDISGVEDKFNASLGTYHDLLKIIKDKAFLDNSENENIIEDIILTLTLFEDKEMIANRLAVYEDLFDQNVLKQLKRRHYTGWGRLSKQLINGMRDKHTGKTILDFLKDGFINRNFMQLINDDNLSFKEEIKKAQEGGLKDSINDQIRDLAGSPAIKKGILQTINIVDEIVKIMGKAPQHIVVEMARDVQKTDIGVKQSRERMKRVQEVLKKLGSQLLKEHPVENFQLQNERLYLYYLQNGKDMYTGEELSISNLSHYDIDHIIPRSFIKDDSIDNKVLTRSEHNRGKTDNVPSIEVVKRMKPYWQKLLDTKVISQRKFDNLTKAERGGLQESDKANFIQRQLVETRQITKHVAQILDSRFNTERDEKDRPIRRVKVITLKSKFVSDFRQDFGFYKLREINDYHHAHDAYLNAVVGTALLKMYPKLASEFVYGDYQKYDLSGKASGHATAKYFFYSNLMNFFKSEVKLANGNIIKRSPIEVNEETGEIVWDKTKDFGTVRKVLSAPQVNIVKKTEIQTGGFSNETILSKGKSSKLIPRKNKWRDTTKYGGFNTPTVAYSVLVVAKVEKGKAKKLKPVKELVGITIMERTKFEANPIAFLESKGYHDIQEHLMITLPKYSLFELENGRRRLLASELQKGNEMVLPQHLVTFLYRVSKRDKGTQSENMEYISNHKEKFIEIFHYIIRYAEKNVIKPKVIERLNDTFNQKFNDSDLTELSISFLNLFKFTSFGAPEKFTFLNSEIKQDDVRYRSTKECLNSTLIHQSVTGLYETRIDLSQFGGD

SEQ ID NO: 174 - protein, 1361 aa, Streptococcus pseudopneumoniae
SNKPYSIGLDIGTNSVGWAVITDDYKVPSKKMKVLGNTDKHFIKKNLIGALLFDEGTTAEDRRLKRTARRRYTRRKNRLRYLQEIFSEEISKVDNSFFHRLDDSFLVPEDKRGSKYPIFATLTEEKEYYKQFPTIYHLRKQLADSKEKADLRLIYLTLAHMIKYRGHFLYEESFDIKNNDIQKIFNEFISIYDNTFEGSSLSGQNAQVEAIFTDKISKSTKRERVLKLFPDQKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKNNLPEKYDEVFSDQSKEGYAGYIDSKTTQEAFYKYIKNLLSKIDGADYLLDKIEREDFLRKQRTFDNGSIPHQIHLQEMNAILRRQGEHYPFLKENREKIEKILTFRIPYYVGPLARGNRDFAWLTRNSDQAIRPWNFEEIVDKASSAEAFINKMTNYDLYLPEEKVLPKHSLLYETFAVYNELTKVKFIAEGLRDYQFLDSGQKKKIINQLFKEKRKVTEKDLIHYLHNVDGYDGIELKGIEKQFNASLSTYHDLLKIIKDKRFMDEPKNQEILENIVHTLTIFEDREMIKQRLAQYASIFDEKVIKTLTRRHYTGWGKLSAKLINCIRDRKTGKTILDYLIDDGYNNRNFMQLINDDGLSFKEIIQESQVVGKPDDVKQIVQELPGSSAIKKGILQSIKLVDELVKVMGHDPESIVIEMARENQTTARGKKNSQQRYKRIEDSLKILASNILKEHPTDNIQLQNDRLFLYYLQNGKDMYTGNPLDINHLSSYDIDHIIPQAFIKDDSLDNRVLTSSKDNRGKSDNVPSLEVVQKRKAFWQQLLESKLISERKFNNLTKAERGGLNERDKVGFIKRQLVETRQITKHVAQILDSRFNTKVNEKNQKIRTVKIITLKSNLVSNFRKEFRLYKVREINDYHHAHDAYLNAVVAKAILKKYPKLEPEFVYGDYQKYDLSRDPKEIEKATEKYFFYSNLLNFFKEEVHYADGTIVKRENIEYSKDTGEIAWNKEIDFATIRKILSLSQVNIVKKTEEQTGGLFDNNIVSKKKVVDASKLIPIKSGLSPEKYGGYARPTIAYSVLVIADIEKGKAKKLKRIKEMVGITIQDKKKFEANPTAYLEEYGYKNINPNLIIKLPKYSLFKFNDGQRRLLASSIELQKGNELILPYHFTTLLYHAQRINKISEPIHKQYVETHQSEFEELLTTIISLSKKYIQKPIVESLLQQAFEQADKDIYQLSESFISLLKLTSFGAPGAFRFLGVEISQSNVRYQSVSSCFNATLIHQSITGLYETRIDLSKLGED

SEQ ID NO: 175 - protein, 1361 aa, Streptococcus pseudopneumoniae
SNKPYSIGLDIGTNSVGWVIITDDYKVPSKKMKVLGNTDKHFIKKNLIGALLFDEGTTAEDRRLKRTARRRYTRRKNRLRYLQEIFAEEMNKVDSSFFHRLDDSFLVPEDKRGSKYPIFATLAEEKEYHKNFPTIYHLRKQLADSKEKADLRLIYLALAHMIKYRGHFLYEEAFDIKNNDIQKIFNEFINIYDNTFEGSSLSGQNEQVEAIFSDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYQNHQNDLASLKQFIKNNLPEKYDEVFSDQSKDGYAGYVDGKTTQEAFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDSKNEEILENIVHTLTIFEDREMIKQRLAQYDSIFDEKVIKALTRRHYTGWGKLSAKLINGIRDKQTGKTILDYLIDDGYSNRNFMQLINDDGLSFKEIIQKAQVFGKTNDVKQVVQELPGSPAIKKGILQSIKIVEELVKVMGHEPESIVIEMARENQTTTRGKKNSQQRYKRIENSLKILASKILKEHPTDNNQLQNDRLFLYYLQNGKDMYTGEALDINQLSSCDIDHIIPQAFIKDDSLDNRVLTSSKENRGKSDNVPCLEVVDKMKVFWQQLLDFKLISYRKFNNLTKAERGGLDERDKVGFIRRQLVETRQITKHVAQILDSRFNTEVTEKDKKNRNVKIITLKSNLVSNFRKEFGLYKVREINDYHHAHDAYLNAVVAKAILKKYPKLEPEFVYGDYQKYDLSKDPKDIEKATEKYFFYSNLLNFFKEEVHYADGTIVKRENIEYSKDTGEIAWNKEKDFATIKKILSLPQVNIVKKTEEQTGGLFDNNIVSKKKVVDASKLIPIKSGLSPEKYGGYARPTIAYSVLVIADIEKGKTKKLKRIKEMIGITVQDKKIFESNPIAYLEECGYKNINPNLIIKLPKYSLFEFNGGQRRLLASSIELQKGNELILPYHFTALLYHTQRINKISEPIHKQYVEAHQNEFKELLTTIISLSKKYIQKPNVESLLQQAFEQADKDIYQLSESFISLLKLTSFGAPGAFKFLGVEISQSSVRYKPNSQFLDATLIHQSITGLYETRIDLSKLGED

SEQ ID NO: 176 - protein, 1363 aa, Streptococcus pseudopneumoniae
SNKPYSIGLDIGTNSVGWAVITDDYKVPSKKMTVLGNTDKHFIKKNLIGALLFDEGTTAEDRRLKRTARRRYTRRKNRLRYLQEIFSGEMSKVDSSFFHRLDDSFLVPEDKRGSKYPIFATLVEEKEYHKQFPTIYHLRKQLADSKEKADLRLIYLVLAHMIKYRGHFLYEEAFDIKNNDIQKIFNEFISIYDNTFEGSSLSGQNAQVETIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLTTLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHTVDGYDGIELKGIEKQFNASLSTYHDLLKIIKDKEFMDDSKNEAILENIVHTLTIFEDREMIKQRLAQYDSLFDKKVIKALTRRHYTGWGKLSAKLINGICDKQTGNTILDYLIDDGEINRNFMQLINDDGLSFKKIIQKSQVVGETDDVKQVVRELPGSPAIKKGILQSIKIVDELVKVMDHAPESIVIEMARENQTTARGKKNSQQRYKRIEDSLKILASNILKENPTDNNQLQNDRLFLYYLQNGKDMYTGEALDINQLSSYDIDHIIPQAFIKDDSLDNRVLTSSKDNRGKSDNVPSLEVVQKRKAFWQQLLDSKLISERKFNNLTKAERERDGLNELDKVGFIKRQLVETRQITKHVAQILDARFNKEVTEKDKKNRNVKIITLKSNLVSNFRKEFRLYKVREINDYHHAHDAYLNAVVAKAILKKYPKLEPEFVYGDYQKNDLSKDPKDIEKATEKYFFYSNLLNFFKEEVHYADGTIVKRENIEYSKDTGEIAWNKEKDFATIKKVLSYPQVNIVKKTEEQTGGLFDNNIVSKEKVVDASKLIPIKSGLSPEKYGGYARPTIAYSVLVIADIEKGKTKKLKRIKEMVGITIQDKKKFEANPIAYLEECGYKNINPNLIIKLPKYSLFEFNGGQRRLLASSIELQKGNELILPYHFTALLYHAQRINKFSEPIHKQYVEAHQNEFKELLTIIISLSKKYIQKPNVESLLHQAFEQADNDIYQLSESFISLLKLTSFGAPGAFKFLGAEISQSSVRYKPNSQFLDTTLIHQSITGLYETRIDLSKLGED

SEQ ID NO: 177 - protein, 1360 aa, Streptococcus pseudoporcinus
YSYSIGLDIGTNSVGWAVINEDYKVPAKKMTVFGNTDRKTIKKNLLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKDDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 178 - protein, 1316 aa, Streptococcus pseudoporcinus SPIN 20026
MLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKDDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 179 - protein, 1359 aa, Streptococcus sanguinis
KKPYSIGLDIGTNSVGWAVVTDDYKVPAKKMRVFGDTDRSHIKKNLLGTLLFDDGNTAESRRLKRTARRRYTRRRNRILYLQEIFTESMNEIDESFFHRLDDSFLVPEDKRGSKYPIFATLQEEKEYHKQFPTIYHLRKQLADSKEKSDVRLIYLALAHMIKYRGHFLYEETFDIKNNDIQKIFNEFINIYDNTFEGSSLSGQNAQVEAIFTDKISKSAKRERVLKLFPDEKSTGLFSEFLKLIVGNQADFKKHFDLEEKAPLQFSKDTYDEELENLLGQIGDDFADLFLIAKKLYDAILLSGILTVTDPSTKAPLSASMIERYENHQKDLAALKQFIKNNLPEKYVEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARDNRDFSWLTRNSDEPIRPWNFEEVVDKARSAEDFIHRMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNANLSTYHDLLKITKDKEFMDDPKNEEILENIVHTLTIFEDREMIKQRLAQYDTLFDEKVIKALTRRHYTGWGKLSAKLINGIRDKQSGKTILDYLIDDDKINRNFMQLINDDGLSFKEIIQKAQVVGKTDDVKQVVQELPGSPAIKKGILQSIKIVDELVKVMGYALESIVIEMARENQTTARGKKNSQQRYKRIEDALKNLAPNILKENPTDNIQLKNDRLFLYYLQNGKDMYTGKPLDINQLSSYDIDHIIPQAFIKDDSIDNRVLTSSKDNRGKSDNVPSLEVVQKRKAFWQQLLDSKLISERKFNNLTKAERGGLDERDKVGFIRRQLVETQQITKNVAQILDARFNTEVKEKNQKIRTVKIITLKSNLVSNFRKEFGLYKVREINNYHHAHDAYLNAVVAKAILKKYPKLEPEFVYGDYQKYDLFKPSKEIEKATEKYFFYSNLLNFFKEEVLYADGTIRKRENIEYSKDTGEIAWDKEKDFATIKKVLSYPQVNIVKKREVQTGGFSKESILPKGNSDKLIPRKTKDILWDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVCLTTLLYHSKNLHKLDEPEHLEYIQKHRNEFKDLLNLVSEFSQKYILAEANLEKIKDLYADNEQADIEILANSFINLLTFTALGAPAAFKFFGKDVDRKRYTTVSEILNATLIHQSITGLYETRIDLSKLGEE

SEQ ID NO: 180 - protein, 1362 aa, Streptococcus sanguinis
KKPYSIGLDIGTNSVGWAVITDDYKVPSKKMKVLGNTDKHFIKKNLIGALLFDEGTTAEDRRLKRTSRRRYTRRKNRLRYLQEIFSEEISKLDSSFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSTKRERVLKLFSDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQEDLAALKQFIKNNLSEKYAEVFSDQSKDGYAGFIDGKTTQEAFYKYIKNLLSKLEGADYFLNKIEREDFLRKQRTFDNGSIPHQIHLQEMNAILRRQGEHYLFLKENREKIEKILAFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKDKRKVTEKDIIHYLHNVDGYDGIELKGIEKQFNASLSTYHDLLKIIKDKEFMDNPKNGEILENIIHTLTIFEDREMIKQRLAQYDTLFDEKVIKALTRRHYTGWGKLSAKLINGIRDKQTGKTILEYLIDDGDCNRNFMQLINDDGLSFKEIIQKAQVVGKTDDVKQVVQEIPGSPAIKKGILQSIKIVDELVKVMGHNPESIVIEMARENQTTAKGKKNSQQRYKRIEDALKNLAPNILKENPTDNIQLQNDRLFLYYLQNGKDMYTGKAIDINQLSNYDIDHIIPQAFIKDDSLDNRVLTSSKDNRGKSDNVPSIEVVQKRKAFWQQLLDSKLISERKFNNLTKAKRGGLDERDKVGFIKRQLVETRQITKHVAQLLDTRFNTEVNEENQKIRTVKIITLKSNLVSNFRKEFGLYKVREINDYHHAHDAYLNAVVAKAILKKYPKLEPEFVYGDYQKYDLSKASNTIDKATEKYFFYSNLLNFFKEKVRYADGTIKKRENIEYSNDTGEIAWNKEKDFATIKKVLSLPQVNIVKKTEEQTGGLFDNNIVSKKKVVDASKLIPIKSSLSPEKYGGYARPTIAYSVLVIADIEKGKGKAKKLKRIKEIVGITIQDKKKFESNPVTYLEECGYKNINSNLIIKLPKYSLFEFNDGQRRLLASSIELQKGNELILPYHLTALLYHAQRINKISEPIHKQYVEAHQNEFKELLTTIISLSKKYIQKPNVELLLQQAFDQADKDIYQLSESFISLLKLTSFGAPGAFKFLGVEISQSSVRYKPNSQFLDTTLIHQSITGLYETRIDLSKLGED

SEQ ID NO: 181 - protein, 1360 aa, Streptococcus sp. F0441
ENKNYSIGLDIGTNSVGWSVITDDYKVPSKKMKVLGNTDKHFIKKNLIGALLFDEGTTAEARRLKRTARRRYTRRKNRLRYLQEIFSEEIGKVDSSFFHRLDDSFLIPEDKRGSKYPIFATLAEEKKYHKQFPTIYHLRKQLADSKEKTDLRLIYLALAHMIKYRGHFLYEEAFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFLVAKKLYDAILLSGILTVTNPSTKAPLSASMIERYENHQKDLASLKQFIKNNLPEKYDEVFSDQSEDGYAGYIDGKTTQETFYKYIKNLLSKFEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKAFMDDAKNEAILENIVHTLTIFEDREMIKQRLAQYDSLFDEKVIKALTRRHYTGWGKLSAKLINGISDKQTGNTILDYLIDDGEINRNFMQLINDDGLSFKEIIQKAQVVGKTNDVKQVVQELPGSPAIKKGILQSIKIVDELVKVMGHAPESIVIEMARENQTTARGKKNSQQRYKRIEDSLKILASKILKEHPTDNIQLQNDRLFLYYLQNGKDMYTGEALDINQLSSCDIDHIIPQAFIKDDSLDNRVLTSSKDNRGKSDNVPSLEVVDKMKVFWQQLLDSKLISYRKFNNLTKAERGGLNELDKVGFIKRQLVETRQITKHVAQILDARFNKEVTEKDKKNRTVKIITLKSNLVSNFRKEFELYKVREINDYHHAHDAYLNAVVAKAILKKYPKLEPEFVYGDYQKYDLSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKKLKTVKTLVGITIMEKDAFEKNPIAFLENKGYHNVCKENILCLPKYSLFELENGRRRLLASAKELQKCNEIVLPVYLTTLLYHSKNVHKLDEPGHLEYIQKHRNEFKDLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 182 - protein, 1360 aa, Streptococcus sp. FF10
MKKPYSIGLDIGTNSVGWSVVTDDYKVPAKKMKVLGNTDKEYIKKNLIGALLFDSGETAEATRMKRTARRRYTRRRNRILYLQDIFSPELNQVDESFLHRLDDSFLVAEDKRGERHVIFGNIADEVKYHKEFPTIYHLRKHLADSSEKADLRLVYLALAHIIKYRGHFLIDEPIDIRNMNSQNLFKEFLLAFDGIQVDCYLASKHTDISGIITAKISKSRKVEAVLEQFPDQKKNSFFGNMVSLVFGLMPNFKSNFELDEDAKLQFSRDSYDEDLENLLGIIGDEYADVFVAAKKVYDSILLSGILTTNNHSTKAPLSASMIDRYDEHNSDKKLLRDFIRTNIGKEVFKEVFYDTSKNGYAGYIDGKTNQEDFYKYLKNLLQKVDGGDYFIEKIEREDFLRKQRTFDNGSIPHQVHLDEMKAILRRQGEFYPFLKENAEKIQQILTFKIPYYVGPLARGNSRFAWASYNSNEKMTPWNFDNVIDKTSSAQAFIERMTNNDLYLPDQKVLPKHSLLYQKFAVYNELTKIKYVTETGEARLFDVFLKKEIFDGLFKKERKVTKKKILNFLDKNFDEFRITDIQGLDNETGNFNASYGTYHDLLKIIGDKEFMDSSDNVDVLEDIVLSLTLFEDREMIKQRLLKYEDIFSKKVIANLTRRHYTGWGRLSAKLINGIKDKHSRKTILDYLIDDGHSNRNFMQLINDDNLSFKDEIANSQVIGDGDDLHQVVQELAGSPAIKKGILQSLKIVDELVKVMGYNPEQIVVEMARENQTTARGRNNSQQRLGSLTKAIQDFGSDILKRYPVENNQLQNDQLYLYYLQNGKDMYTGDTLDIHNLSQYDIDHIIPQSFIKDNSLDNRVLTNSKSNRGKSDNVPSNEVVKRMKGFWLKQLDAKLISQRKFDNLTKAERGGLSAEDKAGFIKRQLVETRQITKHVARILDERFNRDFDKNDKRIRNVKIVTLKSNLVSNFRKEFGFYKVREINNFHHAHDAYLNAVVAKALLIRYPKLEPEFVYGEYPKYNSYRERKATEKMFFYSNIMNMFKTTIKLADGRVVEKPVIEANEETGEIAWDKTKHFANVKKVLSYPQVSIVKKVEEQTGGFSKESILPKGGSDKLIARKTKNNYLSTQKYGGFDSPTVAYSIMFVADIEKGKSKRLKTVKEMIGITIMERSRFESNSVTFLEEKGYRNIRENTIIKFPKYSLFELENGRRRLLASAIELQKGNEMFLPQQFVNLLYHAQHANKEDSVIYLEKHRHELSELFHHIIGVSEKTILKPKVEMTLNEAFEKHFEFDEVSELAQSFISLLKFTAFGAPGGFKFLDADIKQSNLRYQTVTEVLSSTLIHQSVTGLYETRIDLSKLGGE

SEQ ID NO: 183 - protein, 1364 aa, Streptococcus sp. M334
SNKSYSIGLDIGTNSVGWAVITDDYKVPSKKMKVLGNTDKHFIKKNLIGALLFDEGTTAEDRRLKRTARRRYTRRKNRLRYLQEIFSQEISKVDSSFFHRLDDFFLVPEDKRGSKYPIFATLVEEKEYHKKFPTIYHLRKHLADSKEKTDLRLIYLALAHMIKYRGHFLYEESFDIKNNDIQKIFSEFISIYDNTFEGKSLSGQNAQVEAIFTDKISKSTKRERVLKLFPDEKSTGLFSEFLKLIVGNQADFKKHFDLEEKAPLQFSKDTYDEDLENLLGQIGDDFADLFLVAKKLYDAILLSGILTVKDLSTKAPLSASMIERYENHQKDLAALKQFIQNNLQEKYDEVFSDQSKDGYAGYIDGKTTQEAFYKYIKNLLSKFEGADYFLDKIEREDFLKKQRTFDNGSIPHQIHLQEMNAIIRRQGEHYPFLQENKEKIEKILTFRIPYYVGPLARGNGDFAWLTRNSDQAIRPWNFEEIVDQASSAEDFINKMTNYDLYLPEEKVLPKHSLLYETFAVYNELTKVKFIAEGLTRYQFLDKKQKKDIFDTFFKAENKRKVTEKDIIHYLHNVDGYDGIELKGIEKQFNASLSTYHDLLKIIKDKAFMDDSKNEEILENIIHTLTIFEDREMIKQRLAQYDSLFDEKVIKALTRRHYTGWGKLSAKLINGIRDKKSGKTILDYLIDDGEINRNFMQLIHDDGLSFKEIIQKAQVFGKTNDVKQVVQELPGSPAIKKGILQSIKIVDELVKVMGHAPESIVIEMARENQTTARGKKNSQQRYKRIEDSLKNLASNILKENPTDNIQLQNDRLFLYYLQNGRDMYTGKPLEINQLSNYDIDHIIPQAFIKDDSLDNRVLTSSKDNRGKSDNVPSLEVVEKMKAFWQQLLDSKLISERKFNNLTKAERERGGLNELDKVGFIKRQLVETRQITKHVAQFLDARFNKEVTEKDKKNRNVKIITLKSNLVSNFRKEFGLYKVREINDYHHAHDAYLNAVLAKAILKKYPKLEPEFVYGDYQKYDLSREPKEVEKATQKYFFYSNLLNFFKEEVHYADGTIVKRENIEYSKDTGEIAWNKEKDFATVKKVLSLPQVNIVKKTEVQTGGFSKESILPKGNSDKLIPRKTKEILWDTTKYGGFDSPVIAYSILLIADIEKGKAKKLKTVKTLVGITIMEKATFEKNPITFLENKGYHNVRKENILCLPKYSLFELESGRRRMLASAKELQKGNEIVLPVYLTTLLYHSKNVHKLDEPEHLEYIQKHRYEFKDLLNLVSEFSQKYVLADANLEKIKNLYADNEQADIEILANSFINLLTFTALGAPAAFKFLGKDVDRKRYTTVSEILNATLIHQSITGLYETRIDLSKLGED

SEQ ID NO: 184 - protein, 1360 aa, Streptococcus sp. taxon 056
NNNNYSIGLDIGTNSVGWAVITDDYKVPSKKMRVLGNTDKRFIKKNLIGALLFDEGTTAEDRRLKRTARRRYTRRKNRLRYLQEIFAEEMSKVDSSFFHRLDDSFLVPEDKSGSKYPIFATLAEEKEYHKKFPTIYHLRKHLADSKEKADLRLIYLALAHITKYRGHFLYEEAFDIKNNDIQKIFNEFINIYDNTFEGSSLSGQNAQVEAIFTGKISKSVKREHVLKLFPDEKSTGLFSEFLKLIVGNQADFKKHFDLEEKASLQFSKDTYDEDLENLLGQIGDDFADLFLVAKKLYDAILLSGILTVTDPSTKAPLSASMIERYENHQEDLAALKQFIKNNLPEKYAEVFSDQSKDGYAGYIDGKTTQEAFYKYIKNLLSKFEGADYFLDKIEREDFLRKQRTFDNGSIPHQIHLQEMNAILRRQGEHYPLLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFFDSGQKKQIVNQLFKEKRKVTEKDIIHYLHNVDGYDGIELKGIEKQFNASLSTYHDLLKIIKDKEFMDNHKNQEILENIVHTLTIFEDREMIKQRLAQYDSIFDEKVIKALTRRHYTGWGKLSAKLINGICDKKTGKTILDYLIDDGYNNRNFMQLINDDGLSFKEIIQKAQVVGKTDDLTQVVRELSGSPAIKKGILQSIKIVDELVKIMGYAPESIVIEMARENQTTAKGKKNSQQRYKRIEDALKNLAPTISKENPTDNIQLQNDRLFLYYLQNGKDMYTGEALDINQLSSYDIDHIIPQAFIKDDSLDNRVLTSSKDNRGKSDNVPSLEVVKKRKAFWQQLLDSKLISERKFNNLTKAERGGLDERDKVGFIKRQLVETRQITKHVARILDARFNTEVSEKNQKIRSVKIITLKSNLVSNFRKEFKLYKVREINDYHHAHDAYLNAVVAKAILKKYPKLEPEFVYGDYQKYDLSKDPKEVEKATEKYFFYSNLLNFFKEEVHYADGTIVKRENIEYSKDTGEIAWNKEKDFVTIKKVLSYPQVNIVKKREVQTGGFSKESILPKGNSDKLIPRKTKDILWDTTKYGGFDSPVIAYSILLIADIEKGKAKKLKTVKTLVGITIMEKAAFEKNPITFLENKGYHNVRKENILCLPKYSLFELENGRRRLLASAKELQKGNEIVLPVYLTTLLYHSKNVHKLDEPEHLEYIQKHRYEFKDLLNLVSEFSQKYVLAEANLEKIKSLYVDNEQADIEILANSFINLLTFTALGAPAAFKFFGKDVDRKRYTTVSEILNATLIHQSITGLYETRIDLSKLGED

SEQ ID NO: 185 - protein, 1359 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKKYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHKKDLALLKNFIHQNLSDSYKEVFNDKLKDGYAGYIEGKTTQENFYRFIKKAIEKIEGSDYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 186 - protein, 1361 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLTLALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 187 - protein, 1361 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 188 - protein, 1359 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKKYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHKKDLALLKNFIHQNLSDSYKEVFNDKLKDGYAGYIEGKTTQENFYRFIKKAIEKIEGSDYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFKTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 189 - protein, 1351 aa, Streptococcus suis
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLGKEFDEFRIVDLTGLDKENKVFNSSLGTYHDLRKILDKSFLDNKENEQIIEDIIQTLTLFEDREMIRQRLQKYSDIFTKAQLKKLERCHYTGWGRLSYKLINGIRNKENKKTILDYLIDDGYANRNFMQLINDDALSFKEEIAKAQVIGETDDLNQVVSDIAGSPAIKKGILQSLKIVDELVKVMGYNPANIVIEMARENQTTDKGRRNSQQRLKLLQDSLKPVNIKNVENQQLQNDRLFLYYIQNGKDMYTGETLDINNLSQYDIDHIIPQAFIKDDSFDNRVLTSSSENRGKSDNVPSIEVVRARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVSDKEIGKATAKYFFYSNLMNFFKKEVKFADGTVVERPDIETSEDGEIAWNKQTDFKIVRKVLSYPQVNIVKKTEVQTHGLDRPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASRGEIHKGNELFVPQKFTTLLYHAKRINNPINKDHIEYVKKHRDDFKELLNYVLEFNEKYVGATKNGERLKEAVADFDSKSNEEICTSFLGLFELTSLGSASDFEFLGVKIPRYRDYTPSSLLKDSTLIHQSITGLYETRIDLSKLGED

SEQ ID NO: 190 - protein, 1256 aa, Brochothrix thermosphacta
MWGVSLFEAGKTAAERRGYRSTRRRLNHRKFRLRLLEDMFEKEILSKDPSFFIRLKEAFLSPKDEQKQFLFNDKDYTDADYYEQYKTIYHLRYDLISQHRQFDIREVYLAIHHLIKYRGHFIYEDQTFTTDGNQLQHHIKAIITMINSTLNRIIPETIDINVFEKILLDRMMNRSSKVKFLIELTGKQDKPLLKELFNLIVGLKAKPASIFEQENLATIVETMNMSTEQVQLDLLTLADVLADEEYDLLLTAQKIYSAIILDESMDGYEYFAEAKKESYRKHQEELVLVKKMLKSNAITNDERAKFEYFYTDYIGYEESKSKEERLFKHIELLLAKENVLTTVEHALLEKNITFASLLPLQRSSRNAVIPYQVHEKELVAILENQATYYPFLLEQKDNIHKLLTFRIPYYVGPLADQKDSEFAWMVRKQAGKITPFNFEEMVDIDASSEAFIKRMTNKCTYLIHEDVIPKHSFSYAKFEVLNELNKIRLDGKPIDIPLKKRIFEGLFLEKTKVTQTSLKKWLAEHEHMTVSVVQGTQKETEFATSLQAFHRFVKIFDRETVSNPANEEMFEKIIYWSTVFEDKKIMRRKLSEYPQLTEQQQVQLAQVRFRGWGRLSQRLINRIKTPEDHKLSINEILQTNENFMQIIRNKDYLFKKIIEEQFENETALLNKQRIDELAASPANKKGIWQAIKIVKELEKVLQQPAENIFIEFARSDEESKRSTPRDKFIEKAYAETDTEHLKELKQRSKQLSSQRLFLYFIQNGKCMYSGEHLDIERLDSYEVDHILPQSYIKDNSIENLALVKKVENQRKKDSLLLNSSIINQNYSRWEQLKNAGLIGEKKFRNLTRTKITDRDKEGFIARQLVETRQITKHVTQLLQQEYKDTTKVFAIKATLVSGLRRKFEFIKNRNVNDYHHAQDAFLVAFLGTNITSNYPKIEMEYLFKGYQHYLNEVGKAAKPKFTFIVENLSKQQNSTTGEVKWNPEVDIAKLKRILNFKQCNIVRKVEEQSGALFKETIYPVEESSSKTIPLKKHLDTAIYGGYTAVNYASYALIQFKKGRKLKREIIGIPLAVQTRIDNSETSLQAYIAEQIKSEVEILNGRILKYQLISNNGNRLYIAGSERHNARQLIVSDEAAKVIWLISTKQADEAMFLKYYRLEHLEAVFEELIRKQAADYQIFEKLIKKIEVNFYSCTYNEKVKVIELLKITQANATNGDLKLLKMSNREGRLGSVSVALDFKIINQSVTGLYQSIEDYNN

SEQ ID NO: 191 - protein, 1290 aa, Catenibacterium mitsuokai
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGDNYNLFIDEDFNDYTYYHKYPTIYHLRKALCESTEKADPRLIYLALHHIVKYRGNFLYEGQKFNMDASNIEDKLSDIFTQFTSFNNIPYEDDKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRKAPVDEFYKYVKKCIEKVDTPEAKQILNDIELENFLLKQNSRTNGSVPYQMQLDEMIKIIDNQAEYYPILKEKREQLLSILTFRIPYYFGPLETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADSVTVLDVLESRLNLMEIINDKDLGYAQMIEEATSCPEDGKFTYEEVERLAGSPALKRGIWQSLQIVEEITKVMKCRPKYIYIEFERSEEKERTESKIKKLENVYKDEQTSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRNKNDQKGFVINSMNYPYEVDGKLIWNPDLINEIKKCFYYKDCYCTTKLDQKSGQLFNTVLSNDAHADKGAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSEYVNARQLVLNEKQCALIADIYNAIYKQDYDNLDDILMIQLYIELTNKMKVLYPAYRGIAEKFESYVVISKEEKANIIQMLIVMHRGPQNGNIVYDDFKISDRIGRLKTKNHNLNIVFISQSPTGIYTKKYKL

SEQ ID NO: 192 - protein, 1359 aa, Artificial Sequence; identical to SEQ ID NO: 10
  Synthetic polypeptide

SEQ ID NO: 193 - protein, 1313 aa, Clostridiales bacterium S5-A11
MKNYTIGLDIGTNSVGWAVIKDDLTLVRKKIKISGNTDKKEVKKNLWGSFLFEQGDTAQDTRVKRIARRRYERRRFRIRELQKIFDKSMGEVDSNFFHRLDESFLVEEDKEYSKYPIFSNEKEDKNYYDKYPTIYHLRKDLADSNQKADLRLIYLALAHMIKYRGHFLIEGDLKMDGISISESFQEFIDSYNEVCALEDENNDELLTQIENIFKQDISRSKKLDQAIALFQGKRQSLFGIFLTLIVGNKANFQKIFNLEDDIKLDLKEEDYDENLEELLSNIDEGYRDVFLQAKNVYNAIELSKILKTDGKETKAPLSAQMVELYNQHREDLKKYKDYIKAYLPEKYGETFKDATKNGYAGYIDGKTSQEDFYKFVKAQLKGEENGEYFLEAIENENFLRKQRSFYNGVIPYQIHLQELTAVLDQQEKHYSFLKENRDKIISLLTFRIPYYVGPLAKGESRFAWLERSNSEEKIKPWNFDKIVDIDKSAELFIENLTSRDTYLPDEPVLPKRSLIYQKFTIFNELTKISYIDERGILQNFSSREKIAIFNDLFKNKSKVTKNQLVKYIENKEQIIAPEIKGIEDSFNSNYSTYIDLDMKLLEKDEDEILEEIIKILTIFEDRKMRKRQLMKFKDKLSEKAINQLSKKHYTGWGQLSEKLINGIRDEQSNKTILDYLIDNGCPKNMNRNFMQLINDDTLSFKEKIRKAQDINQVNDIKEIVKDLPGSPAIKKGIYQSIRIVDEIIRKMKDRPKNIVIEMARENQTTQEGKNKSKARLKKIQEGLENLDSHVEKQALDEEMLKSPKYYLYCLQNGKDIYTGKDLDIGQLQTYDIDHIIPRSFITDNSFDNLVLTSSTVNRGKLDNVPSPDIVRQQKGFWKQLLRAGLMSQRKFNNLTKGKLTDRDRQQFINRQLVETRQITKHVANLLSHHLNEKKEVGEINIVLLKSALTSQFRKKFDFYKVREVNDYHHAHDAYLNGVIALKLLELYPYMAKDLIYGKYSYHRKGDKATQAKYKMSNIIERFSQDLLANPDGEIAWEKDKDLNTIRKVLSSKQINIIKKAEEGKGRLFKETINSRPSKKTEKRIPIKNNLDPNIYGGYIEEKMAYYIAINYLENGKTKKAIVGISIKDKKDFEGQTTEYLGKIGFNKASIINSFKNYTLFELENGSRRMIVGKGELQKGNQMYLPQNLLEFVYHLKHYNEDETSHKFIVEHKAYFDELLNYIVEFANKYLELENSIEKIKDLYHGKGPDVEEKELVESFINLLAITKCGPAADITFLGEKISRKRYRSTNCLWGSEVIFQSPTGLYETRLRLE

SEQ ID NO: 194 - protein, 1359 aa, Artificial Sequence; identical to SEQ ID NO: 10
  Synthetic polypeptide

SEQ ID NO: 195 - protein, 1327 aa, Dolosigranulum pigrum
MQKNYTIGLDIGTNSVGWAVMKDDYTLIRKRMKVLGNTDIKKIKKNFWGVRLFDEGETAKETRLKRGTRRRYQRRRNRLIYLQDIFQQPMLAIDENFFHRLDDSFFVPDDKSYDRHPIFGSLEEEVAYHNTYPTIYHLRKHLADNPEKADLRLVYTALAHIVKYRGHFLIEGELNTENTSISETFEQFLDTYSDIFKEQLVGDISKVEEILSSKQSRSRKHEQIMALFPNENKLGNFGRFMMLIVGNTSNFKPVFDLDDEYKLKLSDETYEEDLDTLLGMTDDVFLDVFMAAKNVYDAVEMSAIISTDTGNSKAVLSNQMINFYDEHKVDLAQLKQFFKTHLPDKYYECFSDPSKNGYAGYIDGKTNQEDFYKYIEKVMKTIKSDKKDYFLDKIDREVFLRKQRSFYNSVIPHQIHLQEMQAILDRQSQYYPFLAENRDKIESLVTFRIPYYVGPLTVSDQSEFAWMERQSDEPIRPWNFDEIVNKERSAEKFIERMTNMDTYLLEEKVLPKRSLLYQTFEVYNELTKVRYTNEQGKTEKLNRQQKAEIIETLFKQKNRVREKDIANYLEQYGYVDGTDIKGVEDKFNASLSTYNDLAKIDGAKAYLDDPEYADVWEDIIKILTIFEDKAMRKKQLQTYSDTLSPEILKKLERKHYTGWGRFSKKLINGLRDEGSNKTILDYLKDEGSSGPTNRNFMQLIRDNTLSFKKKIEDAQTIEDTTHIYDTVAELPGSPAIKKGIRQALKIVEEIIDIIGYEPENIVVEMARESQTTKKGKDLSKERLEKLTEAIKEFDGVKVKDLKNENLRNDRLYLYYLQNGRDMYTNEPLDINNLSKYDIDHIIPQSFTTDNSIDNKVLVSRTKNQGNKSDDVPSINIVHKMKPFWRQLHKAGLISDRKFKNLTKAEHGGLTEADRAHFLNRQLVETRQITKHVANLLDSQYNTAEEQRINIVLLKSSMTSRFRKEFKLYKVREINDYHHGHDAYLNAVVATTIMKVYPNLKPQFVYGQYKKTSMFKEEKATARKHFYSNITKFFKKEKVVNEETGEILWDTERHLSTIKRVLSWKQMNIVKKVEKQKGQLWKETIYPKGDSSKLIPVKEGMDPQKYGGLSQVSEAFAVVITHEKGKKKQLKSDLISIPIVDQKAYEQHPTAYLEEAGYNNPTVLHELFKYQLFELEDGSRRMIASAKEFQKGNQMVLPLELVELLYHANRYDKVKFPDSIEYVHDNLAKFDDLLEYVIDFSNKYINADKNVQKIQKIYKEHGTEDVELTVESFVNLMTFTAMGAPATFKFYGESITRSRYTSITEFRGSTLIFQSITGLYETRYKLED

SEQ ID NO: 196 - protein, 1329 aa, Artificial Sequence
  Synthetic polypeptide
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 197 - protein, 1280 aa, Artificial Sequence
  Synthetic polypeptide
MRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSPTGLYETRRKVVD

SEQ ID NO: 198 - protein, 1072 aa, Enterococcus durans IPLA 655
MDEEAKIQLSKESYEEELESLLEKSGEEFRDVFLQAKKVYDAILLSDILSTKKQNSKAKLSLGMIERYDSHKKDLEELKQFVKANLPEKTAIFFKDSSKNGYAGYIDGKTTQEDFYKFLKKELNGIAGSERFMEKVDQENFLLKQRTTANGVIPHQVHLTELKAIIERQKPYYPSLEEARDKMIRLLTFRIPYYVGPLAQGEETSSFAWLERKTPEKVTPWNATEVIDYSASAMKFIQRMINYDTYLPTEKVLPKHSILYQKYTIFNELTKVAYKDERGIKHQFSSKEKREIFKELFQKQRKVTVKKLQQFLSANYNIEDAEILGVDKAFNSSYATYHDFLDLAKPNELLEQPEMNAMFEDIVKILTIFEDREMIRTQLKKYQSVLGDGFFKKLVKKHYTGWGRLSERLINGIRDKKTNKTILDYLIDDDFPYNRNRNFMQLINDDSLSFKEELANELALAGNQSLLEVVEALLGSPAIKKGIWQTLKIVEELIEIIGYNPKNIVVEMARENQRTNRSKPRLKALEEALKSFDSPLLKEQPVDNQALQKDRLYLYYLQNGKDMYTGEALDIDRLSEYDIDHIIPRSFIVDNSIDNKVLVSSKENRLKMDDVPDQKVVIRMRRYWEKLLRANLISERKFAYLTKLELTPEDKARFIQRQLVETRQITKHVAAILDQYFNQPEESKNKGIRIITLKSSLVSQFRKTFGINKVREINNHHHAHDAYLNGVVAIALLKKYPKLEPEFVYGNYTKFNLATENKATAKKEFYSNILRFFEKEEYSYDENGEIFWDKARHIPQIKKVISSHQVNIVKKVEVQTGGFYKETVNPKGKPDKLIQRKAGWDVSKYGGFGSPVVAYAVAFIYEKGKARKKAKAIEGITIMKQSLFEQDPIGFLSNKGYSNVTKFIKLSKYTLYELENGRRRMVASKEAQKANSFILPEKLVTLLYHAQHYDEIAHKESFDYVNDHLSEFREILDQVIDFSNRYTIAAKNTEKIAELFEQNQESTVQSLSQSFINLMQLNAMGAPADFKFFDVIIPRKRYPSLTEIWESTIIYQSITGLRETRTRMATLWDGEQ

SEQ ID NO: 199 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKEQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKKVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKTIIYTNLMRFFTEDEPRFTKDSEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 200 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDANTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYQFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 201 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 202 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILNQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 203 - protein, 1331 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKIKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSEEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 204 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 205 - protein, 1329 aa, Enterococcus faecalis
MKKDYVIGLDIGSNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQLYNAKSKEKKVQIITLKASLTSQFRSIFGLYKVREVNDYHHGQDAYLNCVVATTLLKVYPNLAPEFVYGEYPKFQTFKENKATAKTIIYTNLMRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 206 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEKFQQFMIIYNQTFVNGEGPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSYAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 207 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKDQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKAMAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPERLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 208 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQNEKPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLMRFFTEVEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTKFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFETNQTADVKEIAASFIQLMQFNAMGAPSTFKFFQKDIERARYTSIKEIFDATIIYQSTTGLYETRRKVVD

SEQ ID NO: 209 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSEEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 210 - protein, 1328 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 211 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVPDEKKQSRHPVFATIKQEKSYHQTYPTIYHLRQALADSSEKADIRLVYLAMAHLLKYRGHFLIEGELNTENSSVTETFRQFLSTYNQQFSEAGKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEAFYKFVKKELTGIRGSEVFLTKIEQENFLRKQRTFDNGVIPHQIHLSELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNDPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 212 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMNNTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 213 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 214 - protein, 1328 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSEETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 215 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 216 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNCMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPTKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 217 - protein, 1329 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDDKVLVASKQNQKKRDDVPKKQIVNEQRIFWNQLKEAKLISTKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 218 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVIALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 219 - protein, 1329 aa, Enterococcus hirae
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKGDLRLVYLALAHLLKYRGHFLFEGDLDTENTSIEESFRVFLEQYGKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTQAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLFYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTKPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTKAIEGITIMEQAAFEKDPTTFLKDKGFPQVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGEISMIAQSFLQLLQFNAIGAPADFKFFGVTIPRKRYTSLTEIWDATIIYQSVTGLYETRIRMGDLWAGEQ

SEQ ID NO: 220 - protein, 1329 aa, Enterococcus hirae
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 221 - protein, 1329 aa, Enterococcus hirae
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYGKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTQAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTKPRLKALENGLKQIGSTLLKEQPTDNKALQKERLYLYYLQNGRDMYTGEPLEIENLHQYEVDHIIPRSFIVDNSIDNKVLVASKQNQKKRDDVPNKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKDKGFPHVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGEISMIAQSFLQLLQFNAIGAPADFKFFGVTIPRKRYTSLTEIWDATIIYQSVTGLYETRIRMGDLWAGEQ

SEQ ID NO: 222 - protein, 1324 aa, Enterococcus italicus
MKNDYTIGLDIGTNSVGYSVVTDDYKVISKKMNVFGNTEKKSIKKNFWGVRLFESGQTAQEARMKRTSRRRIARRKNRICYLQEIFQPEMNHLDNNFFYRLNESFLVADDAKYDKHPIFGTLDEEIHFHEQFPTIYHLRKYLADGDEKADLRLVYLAIAHIIKFRGNFLIEGELNTENNSVIELSKVFVQLYNQTLSELEFIDESIDFSEVLTQQLSKSERADNVLKLFPDEKGTGIFAQFIKLIVGNQGNFKKVFQLEEDQKLQLSTDDYEENIENLLAIIGDEYGDIFVAAQNLYQAILLAGILTSTEKTRAKLSASMIQRYEEHAKDLKLLKRFVKEHIPDKYAEIFNDATKNGYAGYIDGKTKEEEFYKYLKTTLVQKSGYQYFIEKIEQENFLRKQRIYDNGVIPHQVHAEELRAILRKQEKYYSFLKENHEKIEQIFKVRIPYYVGPLAKHNEQSRFAWNIRKSDEPIRPWNMNDVVDENASAVAFIERMTIKDIYLNENVLPRHSLIYEKFTVFNELTKVLYADDRGVFQRFSAEEKEDIFEKLFKSERKVTKKKLENYLRIELSISSPSVKGIEEQFNANFGTYLDLKKFDELHPYLDDEKYQDTLEEVIKVLTVFEDRSMIQNQLEQLPLNLSTKTIKALSRRKYTGWGRLSARLIDGIHDKNSGKTILDYLIDESDSYIVNRNFMQLINDDHLSFKKIIEDSQPYKEQQSAEEIVSELSGSPAIKKGILQSLKIVDELVAIMGYKPKNIVVEMARENQTTGRGKQNSKPRLKGIENGLKEFSDSVLKGSSIDNKQLQNDRLYLYYLQNGKDMYTGHELDIDHLSTYDIDHIIPQSFLTDNSIDNRVLTTSKSNRGKSDNVPSEEVVRKMDRFWRKLLNAKLISERKYTNLTKKELTESDKAGFLKRQLVETRQITKHVATILDSKFNEDSNNRDVQIITLKSALVSEFRKTFNLYKVREINDLHHAHDAYLNAVVALSLLRVYPQLKPEFVYGEYGKNSIHDQNKATIKKQFYSNITRYFASKDIINDDGEILWNKQETIAQVIKTLGMHQVNVVKKVEIQKGGFSKESIQPKGESQKLIRRKQQWNTKKYGGFDSPVVAYAILLSFDKGKRKARSFKIVGITIQDRESFEGNPILYLSKKDYHNPKVEAILPKYSLFEFENGRRRMVASSETQKGNQLIIPGHLMELLYHSKKIINGKNSDSVSYIQNNKEKFREIFEYIVDFSSKYISADANLNKIEKIFENNFHKASEQEIAKSFINLLTFTAMGAPADFEFFGEKIPRKRYVSISEIIDAVFIHQSITGLYETRVRLTEV

SEQ ID NO: 223 - protein, 1323 aa, Enterococcus mundtii
MEKEYTIGLDIGTNSVGWAVLTDDYRLVARKMSIQGDSNRKKIKKNFWGARLFEEGKTAQFRRIKRTNRRRIARRRQRVLALQDIFAEEIHKKDPNFFARLEEGDRVEADKRFAKFPVFATLSEEKNYHRQYPTIYHLRHDLANSKEQADIRLVYLAIAHCLKYRGHFLFEGELDTENTSVTENYQQFLQAYQQFFPEPIGDLDDAVPILTERLSKAKRVEKVLAYYPSEKSTGNFAQFLKLMVGNQANFKKTFDLEEEMKLNFTRDCYEEDLNELLEKTSDDYAELFLKAKGVYDAILLSQILSKSDDETKAKLSANMKLRFEEHQRDLKQLKELVRRDLPKKYDDFFKNRSKNGYAGYVKGKATQEDFYKFLRTELAGLEESQSIMEKIDLEIYLLKQRTFANGVIPHQIHLVEMREIMDRQKRFYPFLKGAQGKIEKLLTFRIPYYVGPLAQEGQSPFAWIKRKSPSQITPWNFAEVVDKENSAIEFIERMTNQDTYLPKEKVLPKQSLIYQRFMIFNELTKVSYTDERGKSHYFSSEQKRKIFNELFKQHPRVTEKQLRKFLELNEQIDSTEIKGIETSFNASYSTYHDLLKLSTLLDDPDMTTMFEEIIKILTIFEDREMIREQLKPYETVLGLPAIKKLAKKHYTGWGRLSEKMIQGMREKQSRKTILDYLIDDDFPCNRNRNFMQLINDDHLSFKETIANELIMSDSNVLLDQVKAIPGSPAVKKGIWQSIKIVEEIIGIIGKAPKNIVIEMARENQRTSRSRPRLKALEEALKNIDSPLLKDYPTDNQALQKDRLYLYYLQNGKDMYTGEPLEIHRLSEYDIDHIIPRSFIVDNSLDNKVLVSSKVNRGKLDNAPDPLVVKRMRSHWEKLHQAKLISDKKLANLTKQNLTEADKARFIQRQLVETRQITKHVANLLHQHFNLPEEVSATEKTSIITLKSTLTSQFRQMFDIYKVREINHHHHAHDAYLNGVVAMTLLKKYPKLAPEFVYGSYIKGDINQINKATAKKEFYSNIMKFFESEEIICDEQGEVIWNKKRDLSTIKKTIGAHQVNIVKKVEKQKGGFYKETINSKANPEKLIPRKASLDPLKYGGYGSPLVAYTVIFIFEKGKQKKVTKGIEGITVMEQLRFEQDPREFLKTKGYEGVKQWLILPKYILFEAQGGYRRMIASQETQKANSLILPENLVTLLYHARHYDEINHKVSFDYVNAHKEGFNDIFDFISDFGVRYILAPQHLEKIKVAYEKNKEVDLKEMIDAILSLLKFTLFGASVEFKFFDIKILKRYKSLTDIWEATIIYQSVTGLYERRVEVRKLWDGER

SEQ ID NO: 224 - protein, 1330 aa, Enterococcus phoeniculicola
MKKEYTIGLDIGTNSVGWAVLTENYDLVKKKMKVYGNTETKYLKKNLWGVRLFDEGETAADRRLKRTTRRRYSRRRNRICRLQDLFTEEMNQVDANFFHRLQESFLVPDEKEFERHAIFGKMEEEVSYYREFPTIYHLRKHLADTSEQADLRLVYLALAHIVKYRGHFLIEGELNTENSSVSETFRTFIQVYNQIFRENEPLAVPDNIEELFSEKVSRARKVEAILSVYSEEKSTGTLAQFLKLMVGNQGRFKKTFDLEEDGIIQIPKEEYEEELETLLAIIGDEYAEIFSATKSVYDAVALSGILSVTDGDTKAKLSASMVERYEAHQKDLVQFKQFIRKELPEMYAPIFRDNSVSGYAGYVENSVTQAEFYKYIKKAIEKVPGAEYFLEKIEQETFLDKQRTFNNGVIPHQIHLEELEAIIQKQATYYPFLADNKEEMKQLVTFRIPYYVGPLADGNSPFAWLERISSEPIRPGNLAEVVDIKKSATKFIERMTNFDTYLPTEKVLPKHSMIYEKYMVYNELTKVSYVDERGMNQRFSGEEKKQIVEELFKQSRKVTKKLLEKFLSNEFGLVDVAIKGIETSFNAGYGTYHDFLKIGITREQLDKEENSETLEEIVKILTVFEDRKMIREQLKKYTYLFDEEVLKKLERRHYTGWGRLSAKLLIGIKEKRTHKTILDYLIDDGGKQPINRNLMQLINDSDLSFKSEIAEAQSDMNTEDLHEVVQNLAGSPAIKKGILQSLKIVDELVDIMGSLPKNIVVEMARENQTTSRGRTNSNPRMKALEEAMRNLRSNLLKEYPTDNQALQNDRLYLYYLQNGKDMYTGLDLSLHNLSSYDIDHIVPQSFTTDNSLDNRVLVSSKENRGKKDDVPSKEVVQKNITLWETLKNSNLISQKKYDNLTKGLRGGLTEDDRAHFIKRQLVETRQITKHVARILDQRFNSQKDEEGKTIRAVRVVTLKSSLTSQFRKQFAIHKVREINDYHHGHDAYLNGVVANSLLRVYPQLQPEFVYGDYPKFNAYKANKATAKKQLYTNIMKFFAEDAVIIDENGEILWDKKNIATVKKVMSYPQMNIVKKPEIQTGSFSKETIKPKGDSDKLISRKTNWSPKLYGGFDSPQVAYSVIITYEKGKKKVRAKAIVGITIMEQSLFKKDPVSLLEEKGYANPEVLIHLPKYTLYELENGRRRLLASANEAQKGNQLVLPASLVTLLYHAKQVDEDSGKSEEYVREHRAEFAEILNYVQAFSETKILANKNLQTILKLYEENKEADIKEIAESFVNLMKFSAYGAPMDFKFFGKTIPRSRYTSVGELLSATIINQSITGLYETRRKLVD

SEQ ID NO: 225 - protein, 1327 aa, Enterococcus sp. AM1
MGKEYTIGLDIGTNSVGWAVLQEDLDLVRRKMKVYGNTEKNYLKKNFWGVDLFDEGMTAKDTRLKRTTRRRYFRRRQRISYLQTFFQEEMNRIDPNFFNRLDESFLIEEDKLSERHPIFGTIEEEVAYHKNYATIYHLRKELADAEEKADLRLVYLALAHIIKYRGHFLIEGRLSTENTSTEETFKTFLQKYNQTFNPVDETISIGSIFADKVSRAKKAEGVLALFPDEKRNGTFDQFLKMIVGNQGNFKKTFELEEDAKLQFSKEEYDESLEALLGEIGDEYADVFEAAKNVYNAVELSGILTVTDNSTKAKLSASMIKRYEDHKTDLKLFKEFIRKNLPEKYHEIFNDKNTDGYAGYIDNSTSQEKFYKYITNLIEKIDGAEYFLKKIENEDFLRKQRTFDNGIIPHQIHLEELKAILHHQAMYYPFLQEKFSNFVDLLTFRIPYYVGPLANGNSRFSWLSRKSDEPIRPWNLAEVVDLSKSAELFIERMTNFDLYLPSEKVLPKHSMLYEKYTVYNELTKVTYKDEQGKVQNFSSEEKERIFIDLFKQHRKVTKKDLSNFLRNEYNLDDVIIDGIENKFNASFNTYHDFLKLKIDPKVLDDPANEPMFEEIVKILTIFEDRKMLREQLSKFSDRLSEKTIKDLERRHYTGWGRLSAKLINGIHDKQSNKTILDYLIDDAPKKNINRNFMQLINDNRLTFKEEIEKEQLKANSEESLIEIVQNLAGSPAIKKGIFQSLKIVDELVEIMGYAPTNIVVEMARENQTTANGRRNSRPRLKNLEKAIDDLDSEILKKHPVDNKALQKDRLYLYYLQNGKDMYTNEELDIHKLSTYDIDHIIPQSFIVDNSLDNRVLVSSSKNRGKLDDVPSKEVVKKMRAFWESLYRSGLISKKKFDNLVKAESGGLSEDDKAGFIHRQLVETRQITKNVARILHQRFNSEKDEEGNLIRKVRIITLKSALTSQFRKNYGIYKIREINDYHHAHDAYLNGVVATALLKIYPQLEPEFVYGEFHRFNAFKENKATAKKQFYSNLMEFSKSDKVIIDENGEILWNQKKIVTVKKVMNYRQMNIVKKVEIQKGGFSKESILPKGDSDKLISRKKEWDTTKYGGFDSPNVAYSVVIRYEKGKTRKLVKTIVGITIMERAAFEKNEREFLKNKGYQNPQICMKLPKYSLYEFDDGRRRLLASAKEAQKGNQMVLPAHLVTFLYHAKHCNEKPDSLKYVTEHQSGFSEIMAHVKDFAEKYTLVDKNLEKILSLYAKNMDSEVKEIAQSFVDLMQLNAFGAPADFKFFGETIPRKRYTSVNELLEATIINQSITGLYETRRRLGD

SEQ ID NO: 226 - protein, 1332 aa, Enterococcus villorum
MNKAYTLGLDIGTNSVGWAVVTDDYRLMAKKMPVHSKMEKKKIKKNFWGARLFDEGQTAEERRNKRATRRRLRRRKYRILELQKIFSEEILKKDSHFFARLDESFLIPEDKQYARFPIFPTLLEEKAYYQNYPTIYHLRQKLADSTEKADIRLVYLALAHMIKYRGHFLFEGELDTENTSVEETFKEFIDIYNEQFEEGIIFYKDIPLILTDKLSKSKKVEKILQYYPKEKTTGCLAQFLKLIVGNQGNFKQAFHLDEEVKIQISKETYEEDLEKLLRKSNEEMIDVFLQVKKVYDAILLSDILSTKMKDTKAKLSAGMIERYQNHKKDLEELKQFVRAHLHEKVTVFFKDSSKDGYAGYIDGKTTQADFYKFLKKELTGVPGSEPMLAKIDQENFLLKQRTPTNGVIPHQVHLTEFKAIIDQQKQYYPFLEKSKEKMIQLLTFRIPYYVGPLAQDKETSSFAWLERKTTEKIKPWNAKDVIDYGASATKFIQRMINYDTYLPTEKVLPKYSMLYQKYTIFNELTKVAYKDDRGIKHQFSSEEKLRIFQELFKKQRRVTKKKLQHFLSANYNIEDAEILGVDKVFNSSYATYHDFLELAKPYELLEQPEMEEMFEDIVKIITIFEDREMVRTQLKKYQRILGEEIFKKLVKKKYTGWGRLSKRLINGIRDQKTNKTILDYLIDDDFPYNRNRNFMQLINDDHLSFKEEIAKELTLSDKQSLLEVVEAIPGSPAIKKGIWQTLKIVEELIAIIGYKPKNIVIEMARENQTTTGGKNRSKPRLKSLEEALKNFDSQLLKERPVDNQSLQKDRLYLYYLQNGKDMYTGESLDIDRLSEYDIDHIIPRSFIVDHSLDNKVLVSSKENRLKKDDVPDSKVVKRMKAYWEKLLRANLISERKFSYLTKLELTDDDKARFIQRQLVETRQITKHVAAILHQYFNQTQELEKEKDIRIITLKSSLVSQFRQVFGIHKVREINHHHHAHDAYLNAVVALALLKKYPRLAPEFVYGSFAKFHLVKENKATAKKEFYSNILKFFEKEEQFCDENGEIFWDKRKHIQQIKKVISSHQVNIVKKVEVQTGSFYKETVNTKEKPDKLIKRKNNWDVTKYGGFGSPVVAYAVVFTYEKGKNHKKAKAIEGITIMEQALFEKDPISFLIEKGYSNVNQFIKLPKYTLFELANGQRRMLASQELQKANSFILPEKLVTLLYHANHYDEIAYKDSYDYVNEHFSNFQDILDKVIIFAEKYTSAPQKLNQIIATYEKNQEADRKIMAHSFVNLMQFNALGAPADFKFFDTTITRKRYTSLTEIWQSTIIYQSVTGLYETRRRMADLWDGVQ

SEQ ID NO: 227 - protein, 1359 aa, Artificial Sequence
  Synthetic polypeptide
ADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 228 - protein, 1300 aa, Kandleria vitulina
NNKIYNIGLDIGDASVGWAVVDEHYNLLKRHGKHMWGSRLFTQANTAVERRSSRSTRRRYNKRRERIRLLRGIMEDMVLDVDPTFFIRLANVSFLDQEDKKDYLKSNYNLFIDKDFNDKTYYDKYPTIYHLRKHLCESKEKEDPRLIYLALHHIVKYRGNFLYEGQKFSMDVSNIEDKMIDVLRQFNEINLFEYVEDKKIDEVLNVLKEPLSKKHKADKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHKTPVDEFYKYIKKLIEKIDDPDVKTILNKIELESFMLKQNSRTNGAVPYQMQLDELNKILENQSVYYSDLKDNEDKIRSILTFRIPYYFGPLITKDRQFDWIIKKEGKENERILPWNANEIVDVDKTADEFIKRMRNFCTYFPDEPVLAKNSLTVSKYEVLNEINKLRINDHLIKRDIKDKMLHTLFMDHKSISANAMKKWLVKNQYFSNTDDIKIEGFQKENACSTSLTPWIDFTKIFGEINNSNYELIEKIIYDVTVFEDKKILRRRLKKEYDLDEEKIKKILKLKYSGWSRLSKKLLSGIKTKRTPETVLEVMETNMNLMQVINDEKLGFKKTIDDANSTSVSGKFSYAEVQELAGSPAIKRGIWQALLIVDEIKKIMKHEPAHVYIEFARNEDKERKDSFVNQMLKLYKDFEDEANKHLKGEDAKSKIRSERLKLYYTQMGKCMYTGKSLDIDRLDTYQVDHIVPQSLLKDDSIDNKVLVLSSENQRKLDDLVIPEMIRNKMFGFWNKLYENKIISPKKFYSLIKSEYSDKDKERFINRQIVETRQITKHVAQIISNHYETTKVVTVRADLSHAFRERYHIYKNRDINDFHHAHDAYIATILGTYIGHRFESLDAKYIYGEYQKIFRNKNKDKKDGFILNSMRNLYADKDTGEVVWDPEWISRIKKCFYYKDCFVTKKLEENNGSFFNTVRPNDEHSEKGAKVPVNKLRSNVHKYGGFEGLKYSIVAIKGKKKKGKKIIDVNKLVGIPLMYKNVDDETKINYIKESEGLEEVKIIKEILKNQLIEINGGLFYVTSEIVNARQLILDFNCTRIIDGIYKAMKYKNYSELSQEEIMNVYDIFVEKLKLYYPTYKNIATNFENFENISDEEKCEVIQMLVVMHAGPQNGNITFDDFKLSNRLGRLNCKTISLTTVFIADSPTGMYSKKYKL

SEQ ID NO: 229 - protein, 1301 aa, Kandleria vitulina
NNKIYNIGLDIGDASVGWAVVDEHYNLLKRHGKHMWGSRLFTQANTAVERRSSRSTRRRYNKRRERIRLLREIMEDMVLDVDPTFFIRLANVSFLDQEDKKDYLKSNYNLFIDKDFNDKTYYDKYPTIYHLRKHLCESKEKEDPRLIYLALHHIVKYRGNFLYEGQKFSMDVSNIEDKMIDVLRQFNEINLFEYVEDKKIDEVLNVLKEPLSKKHKAEKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHKTPVDEFYKYIKKLIEKIDDPDVKTILNKIELESFMLKQNSRTNGAVPYQMQLDELNKILENQSVYYSDLKDNEDKIRSILTFRIPYYFGPLITKDRQFDWIIKKEGKENERILPWNANEIVDVDKTADEFIKRMRNFCTYFPDEPVMAKNSLTVSKYEVLNEINKLRINDHLIKRDMKDKMLHTLFMDHKSISANAMKKWLVKNQYFSNTDDIKIEGFQKENACSTSLTPWIDFTKIFGKINESNYDFIEKIIYDVTVFEDKKILRRRLKKEYDLDEEKIKKILKLKYSGWSRLSKKLLSGIKTKRTPETVLEVMETNMNLMQVINDEKLGFKKTIDDANSTSVSGKFSYAEVQELAGSPAIKRGIWQALLIVDEIKKIMKHEPAHVYIEFARNEDKERKDSFVNQMLKLYKDFEDEANKHLKGEDAKSKIRSERLKLYYTQMGKCMYTGKSLDIDRLDTYQVDHIVPQSLLKDDSIDNKVLVLSSENQRKLDDLVIPSSIRNKMYGFWEKLFNNKIISPKKFYSLIKTEFNEKDQERFINRQIVETRQITKHVAQIIDNHYENTKVVTVRADLSHQFRERYHIYKNRDINDFHHAHDAYIATILGTYIGHRFESLDAKYIYGEYKRIFRQKNKGKNDGFILNSMRNIYADKDTGEIVWDPNYIDRIKKCFYYKDCFVTKKLEENNGTFFNTVLPNDTNSDKDATVPVNKYRSNVNKYGGFSGVNSFIVAIKGKKKKGKKVIEVNKLTGIPLMYKNADEEIKINYLKQAEDLEEVQIGKEILKNQLIEKDGGLYYIVAEIINAKQLILNESQTKLVCEIYKAMKYKNYDNLDSEKIIDLYRLLINKMELYYPEYRKQLVKKFEDLKVISIEEKCNIIQILATLHCNSSIGKIMYSDFKISTTIGRLNGRTISLDISFIAESPTGMYSKKYKL

SEQ ID NO: 230 - protein, 1304 aa, Lactobacillus animalis
LKKDYSIGLDIGTNSVGHAVVTDDYKVPTKKMKVFGDTSKKTIKKNMLGVLLFNEGQTAADTRLKRGARRRYTRRKNRLRYLQEIFAPALAKVDPNFFYRLEESSLVAEDKKYDVYPIFGKREEELLYHDTHKTIYHLRSELANNDRPADLRLVYLALAHIIKYRGNFLLEGEIDLRTTDINKVFAEFSETLNENSDENLGKLDVADIFKDNTFSKTKKSEELLKLSGKKNQLAHQLFKMMVGNMGSFKKVLGTDEEHKLSFGKDTYEDDLNDLLAEAGDQYLDIFVAAKKVYDAAILASILDVKDTQTKTVFSQAMIERYEEHQKDLIELKRVFKKYLPEKCHDFFSEPKISGYAGYIDGKVSEEDFYKYTKKTLKGIPETEEILQKIDANNYLRKQRTFDNGAIPHQVHLKELVAIVENQGKYYPFLRENKDKFEKILNFRIPYYVGPLARGNSKFAWLTRAGEGKITPYNFDEMIDKETSAEDFIKRMTINDLYLPTEPVLPKHSLLYERYTIFNELAGVRYVTENGEAKYFDAQTKRSIFELFKLDRKVSEKMVIKHLKVVMPAIRIQALKGLDNGKFNASYGTYKDLVDMGVAPELLNDEVNSEKWEDIIKTLTIFEGRKLIKRRLENYRDFLGEDILRKLSRKKYTGWGRLSAKLLDGIYDKKTHKTILDCLMEDYSQNFMQLINDDTYSFKETIKNAQVIEKEETLAKTVQELPGSPAIKKGILQSLEIVDEIIKVMGYKPKSIVVEMARETQTHGTRKREDRVQQIVKNLKELPKPSNAELSDERKYLYCLQNGRDMYTGAPLDYDHLQFYDVDHIIPQSFLKDDSIENKVLTIKKENVRKTNGLPSEAVIQKMGSFWKKLLDAGAMTNKKYDNLRRNLHGGLNEKLKERFIERQLVETRQITKYVAQLLDQRLNYDGNGVELDEKIAIVTLKAQLASQFRSEFKLRKVRALNNLHHAHDAYLNAVVANLIMAKYPELEPEFVYGKYRKTKFKGLGKATAKNTLYANVLYFLKENEVYPFWDKARDLPTIKRYLYRAQVNKVRKAERQTGGFSDEMLVPKSDSGKLLPRKEGLDPVKYGGYAKAVESYAVLITADEVKKGKTKKVKTLVNIPIIDSKKYEADPTAYLASRGYTNVTNSFILPKYSLLEDPEGRRRYLASKEFQKANELILPQHLVELLYWVNAKDGEQKLEDHKAEFKELFDKIMEFADKYVVAPKNSEKIRRLYEENQDATPMELGKNFVELLRYTADGAASDFKFFGENIPRKRYNSAGSLLNGTLIYQSKTGLYETRIDLGKL

SEQ ID NO: 231 - protein, 1292 aa, Lactobacillus curvatus
MSRPYNIGLDIGTSSIGWSVVDDQSKLVSVRGKYGYGVRLYDEGQTAAERRSFRTTRRRLKRRKWRLGLLREIFEPYITPVDDTFFLRKKQSNLSPKDQRKQTSLFNDRTDRAFYDDYPTIYHLRYKLMTEKRQFDIREIYLAMHHIVKYRGHFLNEAPVSSFKSSEINLVAHFDRLNTIFADLFSESGFTDKLAEVKALLLDNHQSASNRQRQALLLIYTPSKQNKAIATELLKAILGLKAKFNVLTGIEAEDVKTWTLTFNAENFDEEMVKLESSLDDNAHQIIESLQELYSGVLLAGIVPENQSLSQAMITKYDDHQKHLKMLKAVREALAPEDRQRLKQAYDQYVDGKSKEDFYGDITKALKNNPDHPIVSEIKKLIELDQFMPKQRTKDNGAIPHQLHQQELDRIIENQQQYYPWLAELNPNKLDELVAFRVPYYVGPLQQQSSDAKFAWMIRKAEGQITPWNFDDKVDRQASANEFIKRMTTTDTYLLAEDVLPKQSLIYQRFEVLNELNGLKIDDQPITTELKQAIFTDLFMQKTSVTVKNIQDYLVSEKRYASRPAITGLSDENKFNSRLSTYHDLKTIVGDAVDDVDKQADLEKCIEWSTIFEDGKIYSAKLNEIDWLTDQQRVQLAAKRYRGWGRLSAKLLTQIVNANGQRIMDLLWTTDNFMRIVHSEDFDKLITEANQMMLAENDVQDVINDLYTSPQNKKALRQILLVVNDIQKAMKGQAPERILIEFAREDEVNPRLSVQRKRQVEQVYQNISELEIRNELKDLSNSALSNTRLFLYFMQGGRDMYTGDSLNIDRLSTYDIDHILPQSFIKDNSLDNRVLVSQRMNRSKADQVPSVELGQKMQIQWEQMLRAGLITKKKYDNLTLNPDMKGFINRQLVETRQVIKLATNLLMEQYGEDNIELITVKSGLTHQMRTEFDFPKNRNLNNHHHAFDAYLTAFVGLYLLKRYPKLKPYFVYGEYQKASQQDKRNFNFLNGLKKDELVDENTEAVIWNKESGLAYLNKIYQFKKILVTREVHENSGALFNQTLYAAKDDKASGQLIPAKQDRPTALYGGYSGKTVAYMCIVRIKNKKGDLYKVCGVETSWLAQLKQKKAFLKQKISPQFTKVKKQKGTIVKVVEDFEVIAPHILINQRFFDNGQELTLGSHNEQELILDKTAVKLLNGALPLTQSEELAEQVYDEILDQVMHYFPLYDTNQFRAKLSAGKAADGNKMVQVGQQVILDRVLIGLHANAAVSDLGVLKISTPLGKMQQPSGISDTQIIYQSPTGLFERRVALRDL

SEQ ID NO: 232 - protein, 1291 aa, Lactobacillus farciminis
KEQPYNIGLDIGTGSVGWAVTNDNYDLLNIKKKNLWGVRLFEGAQTAKETRLNRSTRRRYRRRKNRINWLNEIFSEELANTDPSFLIRLQNSWVSKKDPDRKRDKYNLFIDNPYTDKEYYREFPTIFHLRKELIINKNKADIRLVYLALHNILKYRGNFTYEHQKFNISTLNSNLSKELIELNQQLIKYDISFPDNCDWNHISDILIGRGNATQKSSNILNNFTKETKKLLKEVINLILGNVAHLNTIFKTSLTKDEEKLSFSGKDIESKLDDLDSILDDDQFTVLDTANRIYSTITLNEILNGESYFSMAKVNQYENHAIDLCKLRDMWHTTKNEKAVGLSRQAYDDYINKKKELYTSLKKFLKVALPTNLAKEAEEKISKGTYLVKPRNSENGVVPYQLNKIEMEKIIDNQSQYYPFLKENKEKLLSILSFRIPYYVGPLQSSEKNPFAWMERKSNGHARPWNFDEIVDREKSSNKFIRRMTVTDSYLVGEPVLPKNSLIYQRYEVLNELNNIRITENLKTNPTGSRLTVETKQHIYNELFKNYKKITVKKLTKWLIAQGYYKNPILIGLSQKDEFNSTLTTYLDMKKIFGSSFMENNKNYNQIEELIEWLTIFEDKQILNEKLHSSNYSYTSDQIKKISNMRYKGWGRLSKKILTCITTETNTPKSLQLSNDLMWTTNNNFISIISNDKYDFKNYIENHNLNKNEDQNISNLVNDIHVSPALKRGITQSIKIVQEIVKFMGHAPKYIFIEVTRETKTTSRGKRIQRLQSKLLNKANGLVPEELKKHKNDLSSERIMLYFLQNGKSLYSEESLNINKLSDYQVDHILPRTYIPDDSLENKALVLAKENQRKADDLLLNSNVIDKNLERWTYMLNNNMMGLKKFKNLTRRVITDKDKLGFIHRQLVQTSQMVKGVANILNSMYKNQGTTCIQARANLSTAFRKALELVKNRNINDFHHAQDAYLASFLGTYRLRRFPTDEMLLMNGEYNKFYGKELYSKKSRKNGFIISPLVNGTTQDRNTGEIIWNVGFRDKILKIFNYHQCNVTRKTEIKTGQFYDQTIYSPKNPKKLIAQKKDMDPNIYGGFSGDNKSSITIVKIDNNKIKPVAIPIRLINDKKTLQNWLEENVKHKKSIQIIKNNVPIGQIIYSKKVGLLSREIANRQQLILPPEHSALLRILQIPDEDPDQILAFYDKNILVEILQELITKMKKFYPFYKNEQEFLASFNQATTSEKINSLEELITLLHANSTSAHLIFNNIEKKAFGRKTHGLTDTDFIYQSVTGLYETRIHIE

SEQ ID NO: 233 - protein, 1327 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 234 - protein, 1327 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLISRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHVANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 235 - protein, 1327 aa, Listeria innocua ATCC 33091; identical to SEQ ID NO: 234

SEQ ID NO: 236 - protein, 1101 aa, Listeria innocua FSL S4-378
LKLYPGEKSTGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGTKQADFYKYMKTTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELKNNRLYLYYLQNGKDMYTGQDLDIHNLSNYDIDHIVPQSFITDNSIDNLVLTSSAGNREKGNDVPPLEIVQKRKVFWEKLYQGNLMSKRKFDYLTKAERGGLTEADKARFIHRQLVETRQITKNVANILHQRFNYGKDDHGNTMKQVRIVTLKSALVSQFRKQFQLYKVRGVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 237 - protein, 1327 aa, Listeria ivanovii
MRKPYTIGLDIGTNSVGWAVLTDQYNLVKRKMKVAGSAEKKQIKKNFWGVRLFDEGEVAAGRRMNRTTRRRIERRRNRIAYLQEIFAAEMAEVDANFFYRLEDSFYIESEKRHSRHPFFATIEEEVAYHEEYKTIYHLREKLVNSSDKADLRLVYLALAHIIKYRGNFLIEGMLDTKNTSVDEVFKQFIQTYNQIFASDIERLEENKEVAEILSEKLTRREKLDKILKLYTGEKSTGMFARFINLIIGSKGDFKKVFDLDEKAEIECAKDTYEEDLEALLAKIGDEYAEIFVAAKSTYNAVVLSNIITVTDTETKAKLSASMIERFDKHAKDLKRLKAFFKMQLPEKFNEVFNDIEKDGYAGYIDGTTQEKFYKYMKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 238 - protein, 952 aa, Listeria ivanovii FSL F6-596
MKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 239 - protein, 1327 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHDNYRTIYHLREKLVNSSEKADLRLVYLALAHIIKYRGNFLIEGALDTKNTSVDEVYKQFIETYNQVFMSNIEKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGTKQVDFYKYLKTILENIEGSDYFIAKIEEENFLRKQRTFDNGAIPHQLHLEELEAIIHQQAKYYPFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKIRYIDDQGKTNYFSGREKQQVFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILYQRFNKETDNHGNTMEQVRIVTLKSALVSQFRKQFQLYKVREVNGYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 240 - protein, 1327 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPMKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 241 - protein, 1327 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPVKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 242 - protein, 1327 aa, Listeria monocytogenes
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMDDGLNRNLMQLINDSNLSFKSIIEKEQVSTTDKDLQSIVAELAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFGWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECKNGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 243 - protein, 1327 aa, Listeria monocytogenes
MKNPYTIGLDIGTNSVGWAVLTDQYDLVKRKMKVAGNSDKKQIKKNFWGVRLFDEGETAADRRMNRTARRRIERRRNRISYLQEIFALEMANIDANFFCRLNDSFYVDSEKRNSRHPFFATIEEEVAYHKNYRTIYHLREELVNSSEKADLRLVYLALAHIIKYRGNFLIEGALDTKNTSVDGVYKQFIQTYNQVFISNIEKMEENTTVADILAGKFTRKEKLERILQLYPGEKSTGMFAQFISLIVGSKGNFQKVFDLVEKTDIECAKDSYEEDLEALLAIIGDEYAELFVAAKNTYNAVVLSSIITVTDTETNAKLSASMIERFDAHEKDLSELKAFIKLHLPKQYEEIFSNVAIDGYAGYIDGTKQVDFYKYLKTLLENIEGADYFIAKIEEENFLRKQRTFDNGAIPHQLHLEELEAILHQQAKYYPFLKEAYDKIKSLVTFRIPYFVGPLANGQSDFAWLTRKADGEIRPWNIEEKVDFGKSAVDFIEKMTNKDTYLPKENVLPKHSLYYQKYMVYNELTKVRYIDDQGKTNYFSGQEKQQIFNDYFKQKRKVSKKDLEQFLRNMSHIESPTIEGLEDSFNSSYATYHDLLKVGIKQEVLENPLNTEMLEDIVKILTVFEDKRMIKEQLQQFSDVLDGAVLKKLERRHYTGWGRLSAKLLVGIRDKQSHLTILDYLMDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELRNNRLYLYYLQNGKDMYTGQELDIHNLSNYDIDHIVPQSFITDNSIDNLVLTSSAGNREKGDDVPPLEIVRKRKVFWEKLFQGNLMSKRKFDYLTKAERGGLTEADKATFIHRQLVETRQITKNVANILHQRFNNETDNHGNNMEQVRIVMLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKVVFEKKIIRITIMERKAFEKDEKSFLEKQGYRQPKVLTKLPKYTLYECENGRRRMLASANEAQKGNQQVLKGQLITLLHHAKNCEASDGKSLDYIESNREMFGELLAHVSEFAKRYTLADANLSKINQLFEQNKDNDIKVIAQSFVNLMAFNAMGAPASFKFFEATIERKRYTNLKELLSATIIYQSITGLYEARKRLDG

SEQ ID NO: 244 - protein, 1327 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEKVEENIEVANILAGKFTRREKFERILQLYPGEKSTGMFAQFISLIVGSKGNFQKVFDLIEKTDIECAKDSYEEDLEALLAIIGDEYAELFVAAKNTYNAVVLSSIITVTATETNAKLSASMIERFDAHEKDLGELKAFIKLHLPKQYQEIFNNAAIDGYAGYIDGTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKEFGSKILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTDADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFGQKERIIDENGEILWDKKYLETIKKVLDYRQMNIVKKTEIQKGEFSKATIKPKGNSSKLIPRKENWDPMKYGGLDSPNMAYAVIIEHAKGKKKLIFEKKIIRITIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIQAIAQSFVDLMAFNAMGAPASFKFFEATIDRKRYTNLKELLSSTIIYQSITGLYESRKRLDD

SEQ ID NO: 245 - protein, 1327 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFILTYNQVFMSNIEKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGTKQVDFYKYLKTTLENVEGADYFITKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKIRYIDDQGKTNYFSGQEKQQIFNDLFKQKRKVKKKDLELFLRNINHVESPTIEGLEDSFNASYATYHDLMKVGIKQEILDNPLNTEMLEDIVKILTVFEDKRMIKEQLQQFSDVLDGTVLKKLERRHYTGWGRLSAKLLVGIRDKQSHLTILDYLMDDGLNRNLMQLINDSNLSFKSIIEKEQVSTADKDLQSIVADLAGSPAIKKGILQSLKVVEELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGDNVPPLEIVQKRKIFWEKLYQGNLMSKRKFDYLTKAERGGLTEADKARFIHRQLVETRQITKNVANILHQRFNYKTDDNEDTMEPVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLNYRQMNIVKKTEIQKGEFSNQNPKPRGDSSKLIPKKTNLNPIKYGGFEGSNMAYAIIIEHEKRKKKVTIEKKLIQINIMERKAFEKDEKVFLEGKGYHQPKVLTKLPKYALYECENGRRRMLGSANEVHKGNQMLLPNHLMTLLYHAEKREAIDGESLAYIEAHKAVFGELLAHISEFARKYTLANDKLDEINMLYERNKDGDVKSIAESFVSLKKFNAFGVHKDFNFFGTTIKRKRDRKLKELLNSTIIYQSITGLYESRKRLDS

SEQ ID NO: 246 - protein, 1327 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVNDTETNAKLSASMIERFDAHEKDLVELKAFIKLNLPKQYEEIFSNAAIDGYAGYIDGTKQVDFYKYLKTILENIEGSDYFIAKIEEENFLRKQRTFDNGAIPHQLHLEELEAIIHQQAKYYTFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGVVLKKLERRHYTGWGRLSAKLLVGIRDKQSHLTILEYLMDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKRIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 247 - protein, 1327 aa, Listeria monocytogenes
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMDDGLNRNLMQLINDSNLSFKSIIEKEQVSTADKDLQSIVADLAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFDWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECENGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 248 - protein, 1327 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEKVEENIEVANILARKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKIRYIDDQGKTNYFSGQEKQQIFNDLFKQKRKVKKKDLELFLRNINHVESPTIEGLEDSFNASYATYHDLMKVGIKQEILDNPLNTEMLEDIVKILTVFEDKRMIKEQLQQFSDVLDGTVLKKLERRHYTGWGRLSAKLLVGIRDKQSHLTILDYLMDDGLNRNLMQLINDSNLSFKSIIEKEQVSTADKDLQSIVADLAGSPAIKKGILQSLKVVEELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGDNVPPLEIVQKRKIFWEKLYQGNLMSKRKFDYLTKAERGGLTEADKARFIHRQLVETRQITKNVANILHQRFNYKTDDNEDTMEPVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLNYRQMNIVKKTEIQKGEFSNQNPKPRGDSSKLIPKKTNLNPIKYGGFEGSNMAYAIIIEHEKRKKKVTIEKKLIQINIMERKAFEKDEKVFLEGKGYHQPKVLTKLPKYALYECENGRRRMLGSANEVHKGNQMLLPNHLMTLLYHAEKREAIDGESLAYIEAHKAVFGELLAHISEFARKYTLANDKLDEINMLYERNKDGDVKSIAESFVSLKKFNAFGVHKDFNFFGTTIKRKRDRKLKELLNSTIIYQSITGLYESRKRLDS

SEQ ID NO: 249 - protein, 1327 aa, Listeria monocytogenes; identical to SEQ ID NO: 244

SEQ ID NO: 250 - protein, 1327 aa, Listeria monocytogenes; identical to SEQ ID NO: 248

SEQ ID NO: 251 - protein, 781 aa, Listeria monocytogenes FSL F2-208
  misc_feature (721)..(721): Xaa can be any naturally occurring amino acid
IFNDLFKQKRKVKKKDLELFLRNINQIESPTIEGLEDSFNASYATYHDLLKVGMKQEILDNPLNTEMLEDIVKILTVFEDKRMIKEQLQQFSDVLDGVVLKKLERRHYTGWGRLSAKLLVGIRDKQSHLTILEYLMDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELKNNRLYLYYLQNGKDIYTGQELDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYTEAHRETFSELLAQVSEFATRYTLADANLSKINNLFEQNKEGDIKXIAQSFVDLMVFNAMGAPASFKFFEATIDRKRYTNLKELLSSTIIYQSITGLYESRKRLDD

SEQ ID NO: 252 - protein, 1327 aa, Listeria seeligeri
MKKPYTIGLDIGTNSVGWAALTDQYDLVKRKMKVAGNSEKKQIKKNLWGVRLVDEGKTAAHRRVNRTTRRRIERRRNRISYLQEIFTAEMFEVDANFFYRLEDSFYIESEKRQSRHPFFATIEEEVAYHENYRTIYHLREKLVNSSDKADLRLVYLALAHIIKYRGNFLIEGKLDTKNTSVDEVFKQFIKTYNQVFASDIERIEENNEVAKIFSEKLTKREKLDKILNLYPNEKSTDLFAQFISLIIGSKGNFKKFFNLTEKTDIECAKDSYEEDLEVLLARVGDEYAEIFVAAKNAYNAVVLSSIITVSNTETKAKLSASMIERFDKHDKDLKRMKAFFKVRLPENFNEVFNDVEKDGYAGYIEGTKQEAFYKYMKKMLEHVEGADYFINQIEEENFLRKQRTFDNGAIPHQLHLEELEAILHQQAKYYPFLKVDYEKIKSLVTFRIPYFVGPLANGQSEFSWLTRKADGEIRPWNIEEKVDFGKSAIDFIEKMTNKDTYLPKENVLPKHSMCYQKYMVYNELTKIRYTDDQGKTHYFSGQEKQQIFNDLFKQKRKVKKKDLELFLYNMNHVESPTVEGVEDAFNSSFTTYHDLQKVGVPQEILDDPLNTEMLEEIIKILTVFEDKRMINERLQEFSNVLDEAVLKKLERRHYTGWGRLSAKLLIGIRDKESHLTILDYLMDDKHNRNLMQLINDSNLSFKSIIEKEQVSTADKDIQSIVADLAGSPAIKKGILQSLKIVDELVGIMGYPPQTIVVEMARENQTTGKGKNNSKPRFTSLEKAIKELGSQILKEHPTDNQGLKNDRLYLYYLQNGKDMYTGQELDIHNLSNYDIDHVVPQSFITDNSIDNRVLASSAANREKGDNVPSLEVVRKRKVYWEKLYQAKLMSKRKFDYLTKAERGGLTEADKARFIHRQLVETRQITKNVANILHQRFNCKKDESGNVIEQVRIVTLKAALVSQFRKQFQLYKVREVNDYHHAHDAYLNCVVANTLLKVYPQLEPEFVYGDYHQFDWFKANKATAKKQFYTNIMLFFAKKDRIIDENGEILWDKKYLDTIKKVLNYRQMNIVKKTEIQKGEFSNATANPKGNSSKLIPRKADWDPIKYGGFDGSNMAYAIVIEHEKRKKKTVIKKELIQINIMERTAFEKDQKEFLEGKGYRNPKVITKIPKYTLYECENGRRRMLGSANEAQKGNQMVLPNHLMTLLYHAKNCEASDGKSLAYIESHREMFAELLDSISEFASRYTLADANLEKINTIFEQNKSGDVKVIAQSFVNLLEFNAMGAPASFKYFETNIERKRYNNLKELLNATIIYQSITGLYEARKRLDD

SEQ ID NO: 253 - protein, 1359 aa, Artificial Sequence; identical to SEQ ID NO: 227
  Synthetic polypeptide

SEQ ID NO: 254 - protein, 1290 aa, Roseburia hominis
IVDYCIGLDLGTGSVGWAVVDMNHRLMKRNGKHLWGSRLFSNAETAATRRSSRSIRRRYNKRRERIRLLRAILQDMVLEKDPTFFIRLEHTSFLDEEDKAKYLGDNYNLFIDEDFNDYTYYHKYPTIYHLRKALCESTEKADPRLIYLALHHIVKYRGNFLYEGQKFNMDASNIEDKLSDVFTQFADFNNIPYEDDKKNLEILEILKKPLSKKAKVDEVMALISPEKEFKSAYKELVTGIAGNKMNVTKMILCESIKQGDSEIKLKFSDSNYDDQFSEVENDLGEYVEFIDSLHNIYSWVELQTIMGATHTDNASISEAMVSRYNKHHEDLQLLKKCIKDNVPKKYFDMFRNDSEKVKGYYNYINRKAPVDEFYKFVKKCIEKVDTPEAKQILHDIELENFLLKQNSRTNGSVPYQMQLDEMIKIIDNQAKYYPVLKEKREQLLSILTFRIPYYFGPLETSEHAWIKRLEGKENQRILPWNYQDTVDVDATAEGFIKRMRSYCTYFPDEEVLPKNSLIVSKYEVYNELNKIRVDDKLLEVDVKNDIYNELFMKNKTVTEKKLKNWLVNNQCCRKDAEIKGFQKENQFSTSLTPWIDFTNIFGKIDQSNFDLIEKIIYDLTVFEDKKIMKRRLKKKYALPDDKIKQILKLKYKDWSRLSKKLLDGIVADSVTVLDVLESRLNLMEIINDKELGYAQMIEEASSCPKDGKFTYEEVAKLAGSPALKRGIWQSLQIVEEITKVMKCRPKYIYIEFERSEEKERTESKIKKLENVYKDEQTSVLEELKGFDNTKKISSDSLFLYFTQLGKCMYSGKKLDIDSLDKYQIDHIVPQSLVKDDSFDNRVLVLPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRNKNDQKGFVINSMNYPYEVDGKLIWNPDLINEIKKCFYYKDCYCTTKLDQKSGQMFNTVLPNDAHSAKGAVIPVNKNRKDVNKYGGFSGLQYVIAAIEGTKKKGKKLVKVRKLSGIPLYLKQADIKEQIEYVEKEEKLSDVKIIKNNIPLNQLIEIDGRQYLLTSECVNAMQLVLNEEQCKLIADIYNAIYKQDFDGLDNMLMIQLYLQLIDKLKTLYPIYMGIVEKFEKFVSISKEEKANVIQMLIIMHKGPQNGNIIYDDFNVGKRIGRLNGRTFYLNIEFISQSPTGIYTKKYKL

SEQ ID NO: 255 - protein, 1292 aa, Sharpea azabuensis
KDIRYSIGLDIGTNSVGWAVMDEHYELLKKGNHHMWGSRLFDAAEPAATRRASRSIRRRYNKRRERIRLLRDLLGDMVMEVDPTFFIRLLNVSFLDEEDKQKNLGDNYNLFIEKDFNDKTYYDKYPTIYHLRKELCENKEKADPRLIYLALHHIVKYRGNFLYEGQSFTMDNSDIEERLNSAIEKFMSINEFDNRIVSDINSMIAVLSKIYQRSKKADDLLKIMNPTKEEKAAYKEFTKALVGLKFNISKMILAQEVKKGDTDIVLEFSNANYDSTIDELQSELGEYIEFIEMLHNIYSWVELQAILGATHTDNPSISAAMVERYEEHKKDLRVLKKVIREELPDKYNEVFRKDNRKLHNYLGYIKYDTPVEEFYKYIKGLLAKVDTDEAREILERIDLEKFMLKQNSRTNGSIPYQMQKDEMIQIIDNQSVYYPQLKENRDKLISILEFRIPYYFGPLAHSEFAWIKKFEDKQKERILPWNYDQIVDIDATAEGFIERMKNTGTYFPDEPVMAKNSLTVSKFEVLNELNKIRINGKLIAVETKKELLSDLFMKNKTITDKKLKDWLVTHQYYDINEELKIEGYQKDLQFSTSLAPWIDFTKIFGEINASNYQLIEKIIYDISIFEDKKILKRRLKKVYQLDDLLVDKILKLNYTGWSRLSEKLLTGMTADKATVLFVLESNKNLMEIINDEKLGYKQIIEESNMQDIEGPFKYDEVKKLAGSPAIKRGIWQALLVVREITKFMKHEPSHIYIEFAREEQKVRKESKIAKLQKIYENLQTQVYESLKKEDAKKRMETDALYLYYLQMGKSMYSGKPLDIDKLSTYQIDHILPQSLIKDDSFDNRVLVLPEENQWKLDSETVPFEIRNKMIGFWQMLHENGLMSNKKFFSLIRTDFSDKDKERFINRQLVETRQIIKNVAVIINDHYTNTNIVTVRAELSHQFRERYKIYKNRDINDFHHAHDAYIACIVGQFMHQNFEHLDAKIIYGQYKKNYKKNYGFILNSMNHLQSDIDTGEVMWDPAKIGKIKSCFYYKDVYVTKKLEQNSGTLFNTVLPNDAHSEKGATVPLNKYRADVHKYGGFGNVQSIIVAIEGKKKKGKKLIDVRKLTSIPLHLKNAPVEEQLSYIASPEHEDLIDVRIVKEILKNQLIEIDGGLYYVTSEYVTARQLSLNEQSCKLISEIYAAMLKKRYEYLDEEEIFDLYLQLLQKMDTLYPAYKGIAKRFFDFKNIDVVEKCDVIQILIIMHAGPMNGNIMYDDFKFTNRIGRFTHKNIDLKTTFISTSVTGLFSKKYKL

SEQ ID NO: 256 - protein, 1359 aa, Artificial Sequence; identical to SEQ ID NO: 227
  Synthetic polypeptide

SEQ ID NO: 257 - protein, 1359 aa, Artificial Sequence
  Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 258 - protein, 1359 aa, Artificial Sequence; identical to SEQ ID NO: 10
  Synthetic polypeptide

SEQ ID NO: 259 - protein, 1359 aa, Artificial Sequence; identical to SEQ ID NO: 257
  Synthetic polypeptide

SEQ ID NO: 260 - protein, 1388 aa, Streptococcus thermophilus
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 261 - protein, 1056 aa, Staphylococcus aureus
GSHMKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKAYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 262 - protein, 1368 aa, Artificial Sequence; identical to SEQ ID NO: 8
  Synthetic polypeptide

SEQ ID NO: 263 - protein, 198 aa, Homo sapiens [sequence omitted]

SEQ ID NO: 264 - protein, 198 aa, Mus musculus
MDSLLMKQKKFLYHFKNVRWAKGRHETYLCYVVKRRDSATSCSLDFGHLRNKSGCHVELLFLRYISDWDLDPGRCYRVTWFTSWSPCYDCARHVAEFLRWNPNLSLRIFTARLYFCEDRKAEPEGLRRLHRAGVQIGIMTFKDYFYCWNTFVENRERTFKAWEGLHENSVRLTRQLRRILLPLYEVDDLRDAFRMLGF

SEQ ID NO: 265 - protein, 198 aa, Canis lupus
MDSLLMKQRKFLYHFKNVRWAKGRHETYLCYVVKRRDSATSFSLDFGHLRNKSGCHVELLFLRYISDWDLDPGRCYRVTWFTSWSPCYDCARHVADFLRGYPNLSLRIFAARLYFCEDRKAEPEGLRRLHRAGVQIAIMTFKDYFYCWNTFVENREKTFKAWEGLHENSVRLSRQLRRILLPLYEVDDLRDAFRTLGL

SEQ ID NO: 266 - protein, 199 aa, Bos taurus
MDSLLKKQRQFLYQFKNVRWAKGRHETYLCYVVKRRDSPTSFSLDFGHLRNKAGCHVELLFLRYISDWDLDPGRCYRVTWFTSWSPCYDCARHVADFLRGYPNLSLRIFTARLYFCDKERKAEPEGLRRLHRAGVQIAIMTFKDYFYCWNTFVENHERTFKAWEGLHENSVRLSRQLRRILLPLYEVDDLRDAFRTLGL

SEQ ID NO: 267 - protein, 429 aa, Mus musculus
MGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYIPVPSSSSSTLSNICLTKGLPETRFCVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 268 - protein, 429 aa, Rattus rattus
MGPFCLGCSHRKCYSPIRNLISQETFKFHFKNLRYAIDRKDTFLCYEVTRKDCDSPVSLHHGVFKNKDNIHAEICFLYWFHDKVLKVLSPREEFKITWYMSWSPCFECAEQVLRFLATHHNLSLDIFSSRLYNIRDPENQQNLCRLVQEGAQVAAMDLYEFKKCWKKFVDNGGRRFRPWKKLLTNFRYQDSKLQEILRPCYIPVPSSSSSTLSNICLTKGLPETRFCVERRRVHLLSEEEFYSQFYNQRVKHLCYYHGVKPYLCYQLEQFNGQAPLKGCLLSEKGKQHAEILFLDKIRSMELSQVIITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLHRIKESWGLQDLVNDFGNLQLGPPMS

SEQ ID NO: 269 - protein, 370 aa, Macaca mulatta
MVEPMDPRTFVSNFNNRPILSGLNTVWLCCEVKTKDPSGPPLDAKIFQGKVYSKAKYHPEMRFLRWFHKWRQLHHDQEYKVTWYVSWSPCTRCANSVATFLAKDPKVTLTIFVARLYYFWKPDYQQALRILCQKRGGPHATMKIMNYNEFQDCWNKFVDGRGKPFKPRNNLPKHYTLLQATLGELLRHLMDPGTFTSNFNNKPWVSGQHETYLCYKVERLHNDTWVPLNQHRGFLRNQAPNIHGFPKGRHAELCFLDLIPFWKLDGQQYRVTCFTSWSPCFSCAQEMAKFISNNEHVSLCIFAARIYDDQGRYQEGLRALHRDGAKIAMMNYSEFEYCWDTFVDRQGRPFQPWDGLDEHSQALSGRLRAI

SEQ ID NO: 270 - protein, 384 aa, Pan troglodytes
MKPHFRNPVERMYQDTFSDNFYNRPILSHRNTVWLCYEVKTKGPSRPPLDAKIFRGQVYSKLKYHPEMRFFHWFSKWRKLHRDQEYEVTWYISWSPCTKCTRDVATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTSNFNNELWVRGRHETYLCYEVERLHNDTWVLLNQRRGFLCNQAPHKHGFLEGRHAELCFLDVIPFWKLDLHQDYRVTCFTSWSPCFSCAQEMAKFISNNKHVSLCIFAARIYDDQGRCQEGLRTLAKAGAKISIMTYSEFKHCWDTFVDHQGCPFQPWDGLEEHSQALSGRLRAILQNQGN

SEQ ID NO: 271 - protein, 377 aa, Chlorocebus sabaeus
MNPQIRNMVEQMEPDIFVYYFNNRPILSGRNTVWLCYEVKTKDPSGPPLDANIFQGKLYPEAKDHPEMKFLHWFRKWRQLHRDQEYEVTWYVSWSPCTRCANSVATFLAEDPKVTLTIFVARLYYFWKPDYQQALRILCQERGGPHATMKIMNYNEFQHCWNEFVDGQGKPFKPRKNLPKHYTLLHATLGELLRHVMDPGTFTSNFNNKPWVSGQRETYLCYKVERSHNDTWVLLNQHRGFLRNQAPDRHGFPKGRHAELCFLDLIPFWKLDDQQYRVTCFTSWSPCFSCAQKMAKFISNNKHVSLCIFAARIYDDQGRCQEGLRTLHRDGAKIAVMNYSEFEYCWDTFVDRQGRPFQPWDGLDEHSQALSGRLRAI

SEQ ID NO: 272 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 273 - protein, 373 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 274 - protein, 382 aa, Homo sapiens
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 275 - protein, 190 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 276 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 277 - protein, 200 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKIPGVRAQGRYMDILCDAEV

SEQ ID NO: 278 - protein, 386 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 279 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 280 - protein, 229 aa, Mus musculus
MSSETGPVAVDPTLRRRIEPHEFEVFFDPRELRKETCLLYEINWGGRHSVWRHTSQNTSNHVEVNFLEKFTTERYFRPNTRCSITWFLSWSPCGECSRAITEFLSRHPYVTLFIYIARLYHHTDQRNRQGLRDLISSGVTIQIMTEQEYCYCWRNFVNYPPSNEAYWPRYPHLWVKLYVLELYCIILGLPPCLKILRRKQPQLTFFTITLQTCHYQRIPPHLLWATGLK

SEQ ID NO: 281 - protein, 229 aa, Rattus rattus [sequence omitted]

SEQ ID NO: 282 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 283 - protein, 36 aa, Artificial Sequence
  Synthetic polypeptide
  misc_feature (2)..(2): Xaa can be any naturally occurring amino acid
  misc_feature (4)..(23): Xaa can be any naturally occurring amino acid
  misc_feature (24)..(26): Xaa can be any naturally occurring amino acid
  misc_feature (27)..(29): Xaa can be any naturally occurring amino acid
  misc_feature (32)..(32): Xaa can be any naturally occurring amino acid
  misc_feature (33)..(35): Xaa can be any naturally occurring amino acid
HXEXXXXXXXXXXXXXXXXXXXXXXXXXXPCXXXXC

SEQ ID NO: 284 - protein, 11 aa, Artificial Sequence
  Synthetic polypeptide
SPKKKRKVEAS

SEQ ID NO: 285 - RNA, 82 nt, Artificial Sequence
  Synthetic polynucleotide
guuuuagagcuagaaauagcaaguuaaaauaaaggcuaguccguuaucaacuugaaaaaguggcaccgagucggugcuuuuu

SEQ ID NO: 286 - DNA, 20 bp, Artificial Sequence
  Synthetic polynucleotide
aagagagacagtacatgccc

SEQ ID NO: 287 - DNA, 20 bp, Artificial Sequence
  Synthetic polynucleotide
ggagcccaccgagtacctgg

SEQ ID NO: 288 - DNA, 20 bp, Artificial Sequence
  Synthetic polynucleotide
agtctcctcagcaaaacgaa

SEQ ID NO: 289 - DNA, 20 bp, Artificial Sequence
  Synthetic polynucleotide
gaccccctccaccccgcctc

SEQ ID NO: 290 - DNA, 23 bp, Artificial Sequence
  Synthetic polynucleotide
  misc_feature (21)..(23): n is a, c, g, or t
aagagagacagtacatgcccnnn

SEQ ID NO: 291 - DNA, 23 bp, Artificial Sequence
  Synthetic polynucleotide
  misc_feature (21)..(21): n is a, c, g, or t
aagagagacagtacatgcccngg

SEQ ID NO: 292 - DNA, 189 bp, Artificial Sequence
  Synthetic polynucleotide
gaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagatag

SEQ ID NO: 293 - protein, 62 aa, Artificial Sequence
  Synthetic polypeptide
EASGSGRADALDDFDLDMLGSDALDDFDLDMLGSDALDDFDLDMLGSDALDDFDLDMLINSR

SEQ ID NO: 294 - DNA, 1662 bp, Artificial Sequence
  Synthetic polynucleotide
tcgccagggatccgtcgacttgacgcgttgatatcaacaagtttgtacaaaaaagcaggctacaaagaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaagttccggatctccgaaaaagaaacgcaaagttggtagccagtacctgcccgacaccgacgaccggcaccggatcgaggaaaagcggaagcggacctacgagacattcaagagcatcatgaagaagtcccccttcagcggccccaccgaccctagacctccacctagaagaatcgccgtgcccagcagatccagcgccagcgtgccaaaacctgccccccagccttaccccttcaccagcagcctgagcaccatcaactacgacgagttccctaccatggtgttccccagcggccagatctctcaggcctctgctctggctccagcccctcctcaggtgctgcctcaggctcctgctcctgcaccagctccagccatggtgtctgcactggctcaggcaccagcacccgtgcctgtgctggctcctggacctccacaggctgtggctccaccagcccctaaacctacacaggccggcgagggcacactgtctgaagctctgctgcagctgcagttcgacgacgaggatctgggagccctgctgggaaacagcaccgatcctgccgtgttcaccgacctggccagcgtggacaacagcgagttccagcagctgctgaaccagggcatccctgtggcccctcacaccaccgagcccatgctgatggaataccccgaggccatcacccggctcgtgacaggcgctcagaggcctcctgatccagctcctgcccctctgggagcaccaggcctgcctaatggactgctgtctggcgacgaggacttcagctctatcgccgatatggatttctcagccttgctgggctctggcagcggcagccgggattccagggaagggatgtttttgccgaagcctgaggccggctccgctattagtgacgtgtttgagggccgcgaggtgtgccagccaaaacgaatccggccatttcatcctccaggaagtccatgggccaaccgcccactccccgccagcctcgcaccaacaccaaccggtccagtacatgagccagtcgggtcactgaccccggcaccagtccctcagccactggatccagcgcccgcagtgactcccgaggccagtcacctgttggaggatcccgatgaagagacgagccaggctgtcaaagcccttcgggagatggccgatactgtgattccccagaaggaagaggctgcaatctgtggccaaatggacctttcccatccgcccccaaggggccatctggatgagctgacaaccacacttgagtccatgaccgaggatctgaacctggactcacccctgaccccggaattgaacgagattctggataccttcctgaacgacgagtgcctcttgcatgccatgcatatcagcacaggactgtccatcttcgacacatctctgttttga

SEQ ID NO: 295 - protein, 553 aa, Artificial Sequence
  Synthetic polypeptide
SPGIRRLDALISTSLYKKAGYKEASGSGRADALDDFDLDMLGSDALDDFDLDMLGSDALDDFDLDMLGSDALDDFDLDMLINSRSSGSPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRIRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLF

SEQ ID NO: 296 - skipped

SEQ ID NO: 297 - protein, 1367 aa, Artificial Sequence; identical to SEQ ID NO: 2
  Synthetic polypeptide

SEQ ID NO: 298 - protein, 1368 aa, Artificial Sequence; identical to SEQ ID NO: 4
  Synthetic polypeptide

SEQ ID NO: 299 - protein, 7 aa, Artificial Sequence
  Synthetic polypeptide
PKKKRKV

SEQ ID NO: 300 - protein, 30 aa, Artificial Sequence
  Synthetic polypeptide
MDSLLMNRRKFLYQFKNVRWAKGRRETYLC

SEQ ID NO: 301 - protein, 1368 aa, Artificial Sequence; identical to SEQ ID NO: 4
  Synthetic polypeptide

SEQ ID NO: 302 - protein, 1368 aa, Artificial Sequence
  Synthetic polypeptide
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 303 - protein, 181 aa, Erwinia tasmaniensis
MASRGVNKVILVGNLGQDPEVRYMPNGGAVANITLATSESWRDKQTGETKEKTEWHRVVLFGKLAEVAGEYLRKGSQVYIEGALQTRKWTDQAGVEKYTTEVVVNVGGTMQMLGGRSQGGGASAGGQNGGSNNGWGQPQQPQGGNQFSGGAQQQARPQQQPQQNNAPANNEPPIDFDDDIP

SEQ ID NO: 304 - protein, 209 aa, Artificial Sequence
  Synthetic Polypeptide
MAGAQDFVPHTADLAELAAAAGECRGCGLYRDATQAVFGAGGRSARIMMIGEQPGDKEDLAGLPFVGPAGRLLDRALEAADIDRDALYVTNAVKHFKFTRAAGGKRRIHKTPSRTEVVACRPWLIAEMTSVEPDVVVLLGATAAKALLGNDFRVTQHRGEVLHVDDVPGDPALVATVHPSSLLRGPKEERESAFAGLVDDLRVAADVRP

SEQ ID NO: 305 - protein, 313 aa, Artificial Sequence
  Synthetic Polypeptide
MIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQEPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 306 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 307 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 308 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 309 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 310 - protein, 1367 aa, Streptococcus pyogenes
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 311 - protein, 1367 aa, Streptococcus pyogenes
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 312 - protein, 1367 aa, Streptococcus pyogenes
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 313 - protein, 1367 aa, Streptococcus pyogenes
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 314 - DNA, 20 bp, Artificial Sequence
  Synthetic Polynucleotide
ggggccactagggacaggat

SEQ ID NO: 315 - DNA, 20 bp, Artificial Sequence
  Synthetic Polynucleotide
gggtggggggagtttgctcc

SEQ ID NO: 316 - DNA, 20 bp, Artificial Sequence
  Synthetic Polynucleotide
gcagatgtagtgtttccaca

SEQ ID NO: 317 - DNA, 20 bp, Artificial Sequence
  Synthetic Polynucleotide
tcactatgctgccgcccagt

SEQ ID NO: 318-552 - skipped (235 entries)

SEQ ID NO: 553 - protein, 84 aa, Artificial Sequence
  Synthetic polypeptide
MTNLSDIIEKETGKQLVIQESILMLPEEVEEVIGNKPESDILVHTAYDESTDENVMLLTSDAPEYKPWALVIQDSNGENKIKML

SEQ ID NO: 554-673 - skipped (120 entries)

SEQ ID NO: 674 - DNA, 51 bp, Artificial Sequence
  Synthetic polynucleotide
atgttcactgttgacttctggactaytatggaaaatcacaaccacagcaag

SEQ ID NO: 675 - DNA, 51 bp, Artificial Sequence
  Synthetic polynucleotide
gctgggagctgccatgtgtgggcgcygcatgcgaggagaggctggaggggg

SEQ ID NO: 676 - DNA, 51 bp, Artificial Sequence
  Synthetic polynucleotide
cgtggcgctggccatcctcaagttcytccacaaggtgagggccgggcagcc

SEQ ID NO: 677 - DNA, 51 bp, Artificial Sequence
  Synthetic polynucleotide
catcttctgcttcattgtgcctctcbccctcatctgcttctcctacactca

SEQ ID NO: 678 - DNA, 51 bp, Artificial Sequence
  Synthetic polynucleotide
aaaaggattaaaatgttttttgcccygggtcctgtggcttccgtcgccttc

SEQ ID NO: 679 - DNA, 51 bp, Artificial Sequence
  Synthetic polynucleotide
ctgaagccgcgccctctgcagatcaytggggtggatcccgaagggtccatc

SEQ ID NO: 680 - DNA, 51 bp, Artificial Sequence
  Synthetic polynucleotide
ttcggggtggtcaccgccattgactygctgaacttcgtggccgcccaggag

SEQ ID NO: 681 - DNA, 51 bp, Artificial Sequence
  Synthetic polynucleotide
cgcccacttctcacccctggtcttcytcctcctcctatccatcatgatggc

SEQ ID NO: 682 - DNA, 51 bp, Artificial Sequence
  Synthetic polynucleotide
cttttcagcggctgcctcagttacgycaaggtgatgctgggcgtggtcctg

SEQ ID NO: 683 - DNA, 51 bp, Artificial Sequence
  Synthetic polynucleotide
ggaatataagtatggtgcacacaacyaccatcctttacctgtagccctgga

SEQ ID NO: 684 - DNA, 51 bp, Artificial Sequence
  Synthetic polynucleotide
tgtctacgacttcgagataatggacytctggccaagccaacccatggcgac

SEQ ID NO: 685 - DNA, 51 bp, Artificial Sequence
  Synthetic polynucleotide
tttagattgggatgcttggaaggtgygtctacgacttcgagataatggact

SEQ ID NO: 686 - DNA, 51 bp, Artificial Sequence
  Synthetic polynucleotide
tgttgaagatcggatgtccgtaataygggaaaaaggcgtggtgggtttcac

SEQ ID NO: 687 - DNA, 51 bp, Artificial Sequence
  Synthetic polynucleotide
tccagaattctttggggctgttataygtgccaatgtgactggaagttacgg

SEQ ID NO: 688 - DNA, 51 bp, Artificial Sequence
  Synthetic polynucleotide
gtgtgagagagagcagtgtgacggcyctgtaggctttggaggaagtcctga

SEQ ID NO: 689 - DNA, 51 bp, Artificial Sequence
  Synthetic polynucleotide
caagtttcccgctggagggaagatgyctcagtacctggagagcatgcagat

SEQ ID NO: 690 - DNA, 51 bp, Artificial Sequence
  Synthetic polynucleotide
gagttccggggccccagtgggctgcyggtctaccagggcaaaggtgattcg

SEQ ID NO: 691 - DNA, 51 bp, Artificial Sequence
  Synthetic polynucleotide
gaaggaccctgatgaccacactgtgygccacctgctctttgccaaccaggt

SEQ ID NO: 692 - DNA, 51 bp, Artificial Sequence
  Synthetic polynucleotide
ccgtcaccccagcacatcctgggccyccctgtcggtgagtcacgcccctgc

SEQ ID NO: 693 - DNA, 51 bp, Artificial Sequence
  Synthetic polynucleotide
cctggagacatccaggtggtgcccaytggagtgggccctaatgccaacgtg

SEQ ID NO: 694 - DNA, 51 bp, Artificial Sequence
  Synthetic polynucleotide
ctacatggtcaccggaaatcctgccyctgatgagatcaagaggctgcctgg

SEQ ID NO: 695 - DNA, 51 bp, Artificial Sequence
  Synthetic polynucleotide
ggaaccgccgttgcacgatttctacbgcagcaggctactggacctggtctt

SEQ ID NO: 696 - DNA, 51 bp, Artificial Sequence
  Synthetic polynucleotide
caacgatgtgcaggaccagtgctccygctgctctccgacacggacggagcc

SEQ ID NO: 697 - DNA, 51 bp, Artificial Sequence
  Synthetic polynucleotide
tgagtgtgagtggcgctataacagcygtgcacctgcctgtcaagtcacgtg

SEQ ID NO: 698 - DNA, 51 bp, Artificial Sequence
  Synthetic polynucleotide
gaagcagacgatggtggattcctccygtagaatccttaccagtgacgtctt

SEQ ID NO: 699 - DNA, 51 bp, Artificial Sequence
  Synthetic polynucleotide
tgtttggaatacatgactccatggcygtcaaatctagttcgtttttgcaag

SEQ ID NO: 700 - DNA, 51 bp, Artificial Sequence
  Synthetic polynucleotide
attcatgcagatccaaagctcttgcyttgtgtaagtatttttttatgaaat

SEQ ID NO: 701 - DNA, 51 bp, Artificial Sequence
  Synthetic polynucleotide
attttagcacgctacatgctgatgcygtccttcaacaattcccttgatgtg

SEQ ID NO: 702 - DNA, 51 bp, Artificial Sequence
  Synthetic polynucleotide
ctgttggggtttttatagaacctgcyttttaatccaagtaagccattctca

SEQ ID NO: 703 - DNA, 51 bp, Artificial Sequence
  Synthetic polynucleotide
tctcaggatgaactagctcgagttcyggttactctgtttgattctcggcat

SEQ ID NO: 704 - DNA, 51 bp, Artificial Sequence
  Synthetic polynucleotide
ctccggctccaagcacctccactacyggtctgccgccctgccttctgggcg

SEQ ID NO: 705 - DNA, 51 bp, Artificial Sequence
  Synthetic polynucleotide
atctcctacaggctttggtcttctcyccagacccactgctgctctcaaaac

SEQ ID NO: 706 - DNA, 51 bp, Artificial Sequence
  Synthetic polynucleotide
gatgtagacatggcctgcaatttcaygggggatgagtggtttgtggattcc

SEQ ID NO: 707 - DNA, 51 bp, Artificial Sequence
  Synthetic polynucleotide
gcgtacctatgggcttccttgccacygtcccttcaaagaagtaagtactta

SEQ ID NO: 708 - DNA, 51 bp, Artificial Sequence
  Synthetic polynucleotide
ccagagtttgcccaggagctgcaacygtacggacacatctacatgtaccgg

SEQ ID NO: 709 - DNA, 51 bp, Artificial Sequence
  Synthetic polynucleotide
atatggagtgatacccaaaatccagygccttccaccaagccaggttagaca

SEQ ID NO: 710 - DNA, 51 bp, Artificial Sequence
  Synthetic polynucleotide
gacttcgccgcgcgttggtcagccayggccaccgctctcgcgctacgtagc

SEQ ID NO: 711 - DNA, 51 bp, Artificial Sequence
  Synthetic polynucleotide
catgaacaccttcagcgtcatgcccycacccaaggtgtcagacacggtggt

SEQ ID NO: 712 - DNA, 51 bp, Artificial Sequence
  Synthetic polynucleotide
cccacctacggggacctcaaccaccyggtgtcggccaccatgagcggggtc

SEQ ID NO: 713 - DNA, 51 bp, Artificial Sequence
  Synthetic polynucleotide
catggtgcccttccctcgcctgcacytcttcatgcccggcttcgcgcccct

SEQ ID NO: 714 - DNA, 51 bp, Artificial Sequence
  Synthetic polynucleotide
tcgaacacaaactcatgcaactctgygttccacttcggccaagaaattaga

SEQ ID NO: 715 - DNA, 51 bp, Artificial Sequence
  Synthetic polynucleotide
catccgggaagatgatgggaagacaygtaccaggggagacaaatatcccaa

SEQ ID NO: 716 - DNA, 51 bp, Artificial Sequence
  Synthetic polynucleotide
gaaagatggtgttgactttgggaagyggcgtgctgtgctgaggattgccga

SEQ ID NO: 717 - DNA, 51 bp, Artificial Sequence
  Synthetic polynucleotide
aaccaaagctgttttctccttccagygggttgccagcgttgatgtggtgga

SEQ ID NO: 718 - DNA, 51 bp, Artificial Sequence
  Synthetic polynucleotide
gcagacacagctcacgctgcagtggygagactcgcccgcagggtacactga

SEQ ID NO: 719 - DNA, 51 bp, Artificial Sequence
  Synthetic polynucleotide
aaaatgtactaattttttaaggtttyctggaagcaagctaaagaatgaggt

SEQ ID NO: 720 - DNA, 51 bp, Artificial Sequence
  Synthetic polynucleotide
ctgcggggcctgtgacgtgcgggccrggcccccgagggccttatcggcccc

SEQ ID NO: 721 - DNA, 51 bp, Artificial Sequence
  Synthetic polynucleotide
tcacatcctcaccaccctggaccacyggagcagccgctgcgagtacttgag

SEQ ID NO: 722 - DNA, 51 bp, Artificial Sequence
  Synthetic polynucleotide
cctgtctgcagggagactaaatcctycttcaccagccagcagctgtgaccc

SEQ ID NO: 723 - DNA, 51 bp, Artificial Sequence
  Synthetic polynucleotide
tattgagtagaaaacatttctcaggytgctaagctggaataaaatccactt

SEQ ID NO: 724 - DNA, 51 bp, Artificial Sequence
  Synthetic polynucleotide
gctgtcaatgacctgggacatctgcytgggagagctggctttaatactctg

SEQ ID NO: 725 - DNA, 51 bp, Artificial Sequence
  Synthetic polynucleotide
ttacaggaaattggccttgcctctcygggtgcacctgatgaatacattgaa

SEQ ID NO: 726 - DNA, 51 bp, Artificial Sequence
  Synthetic polynucleotide
ggcctgctttcctctcgggatttctygggtggcctggccttccgagtcttc

SEQ ID NO: 727 - DNA, 51 bp, Artificial Sequence
  Synthetic polynucleotide
tcactcaaagaagaagttggtgcatyggccaaagtattgcgcttatttgag

SEQ ID NO: 728 - DNA, 51 bp, Artificial Sequence
  Synthetic polynucleotide
aaaggcatatggtgctgggctcctgbcatcctttggtgaattacaggtatg

SEQ ID NO: 729 - DNA, 51 bp, Artificial Sequence
  Synthetic polynucleotide
gctctgacaaacatcatcaagatctygaggcatgacattggtgccactgtc

SEQ ID NO: 730 - DNA, 51 bp, Artificial Sequence
  Synthetic polynucleotide
tgcactggtttccgcctccgacctghggctggcctgctttcctctcgggat

SEQ ID NO: 731 - DNA, 51 bp, Artificial Sequence
  Synthetic polynucleotide
  misc_feature (26)..(26): n is a, c, g, t or u
gagaatgatgtaaacctgacccacantgaatctagaccttctcgtttaaag

SEQ ID NO: 732 - DNA, 51 bp, Artificial Sequence
  Synthetic polynucleotide
catttggataatttctcaaaccaaaytggaaaacattataagaaagttatg

SEQ ID NO: 733 - DNA, 51 bp, Artificial Sequence
  Synthetic polynucleotide
aaggccggctacgtcagcaagattgycggcaagtggtaagtctcctggcca

SEQ ID NO: 734 - DNA, 51 bp, Artificial Sequence
  Synthetic polynucleotide
tcctttgactcagaagaagaagaacytggggagcttctccaacagtttgga

SEQ ID NO: 735 - DNA, 51 bp, Artificial Sequence
  Synthetic polynucleotide
aatgagcaagtcccaatggaagtcaytgataatgtcatcagaacggcaggt

SEQ ID NO: 736 - DNA, 51 bp, Artificial Sequence
  Synthetic polynucleotide
catttaggattctctgttgatgaccytggatgctgtaaagtgattcgtcat

SEQ ID NO: 737 - DNA, 51 bp, Artificial Sequence
  Synthetic polynucleotide
aaagatgaaaagctgctgtcgtttcyaaaagatgtgtatgttgattccaaa

SEQ ID NO: 738 - DNA, 51 bp, Artificial Sequence
  Synthetic polynucleotide
gcaggtgctggccctggagcggcgcytcaagcagcagcggtacctgtcagc

SEQ ID NO: 739 - DNA, 51 bp, Artificial Sequence
  Synthetic polynucleotide
tatctactttggaggcctgtctggcycctttctctacacaggaggtaagat

SEQ ID NO: 740 - DNA, 51 bp, Artificial Sequence
  Synthetic polynucleotide
ttgtctaaaaaggccatcggggagtycattttggtggacaaggatgtgaag

SEQ ID NO: 741 - DNA, 51 bp, Artificial Sequence
  Synthetic polynucleotide
tttacagcaccaaataatctggcccygtcagcccagctgtgttcctctgga

SEQ ID NO: 742 - DNA, 51 bp, Artificial Sequence
  Synthetic polynucleotide
tctttccagcctctgtttctctaccytgctctccagtctgtgcatgagccc

SEQ ID NO: 743 - DNA, 51 bp, Artificial Sequence
  Synthetic polynucleotide
aaggatggccagccatttcgctacayctcaggaagcattcactactcccgt

SEQ ID NO: 744 - DNA, 51 bp, Artificial Sequence
  Synthetic polynucleotide
aaggggctgtgtgtgtcttggcaggbatgtgccctggaactttcatgagcc

SEQ ID NO: 745 - DNA, 51 bp, Artificial Sequence
  Synthetic polynucleotide
cctccccttctattggaatttccacygcatgctagctagtccttccctggt

SEQ ID NO: 746 - DNA, 51 bp, Artificial Sequence
  Synthetic polynucleotide
cagaaattggcaccattccttaagabgtatggagaatatgtgaaaggattt

SEQ ID NO: 747 - DNA, 51 bp, Artificial Sequence
  Synthetic polynucleotide
ttgggccttccctaaccagggtcctycctccttatctacctgaatgagttt

SEQ ID NO: 748 - DNA, 51 bp, Artificial Sequence
  Synthetic polynucleotide
gagacgatccccagcgacagcggcaytgggacagacaacaacagcacttct

SEQ ID NO: 749 - DNA, 51 bp, Artificial Sequence
  Synthetic polynucleotide
ctcctaggcgctgtcctgggctggcygatgactccccgagtgcctatggag

SEQ ID NO: 750 - DNA, 51 bp, Artificial Sequence
  Synthetic polynucleotide
cttcagcattgtcatgaacgagctcyccggcagcgacaacgtgccctacgt

SEQ ID NO: 751 - DNA, 51 bp, Artificial Sequence
  Synthetic polynucleotide
gaccccgagctgtgcatccggctgcyccagatgccctctgtggtcaactac

SEQ ID NO: 752 - DNA, 51 bp, Artificial Sequence
  Synthetic polynucleotide
tttgaaattaagaacttcgtgaaggbaccaacctctgttattaataaaata

SEQ ID NO: 753 - DNA, 51 bp, Artificial Sequence
  Synthetic polynucleotide
ccttcatcccgaatataacttcactyctcaatatcttgttcatgttaatga

SEQ ID NO: 754 - DNA, 51 bp, Artificial Sequence
  Synthetic polynucleotide
cttcagccaggacttctgcatccggygcaagaggcagttttacttgtacaa

SEQ ID NO: 755 - DNA, 51 bp, Artificial Sequence
  Synthetic polynucleotide
gctgcccgctgggtggccaagtctcyggtgaaagcagggctctgccggaga

SEQ ID NO: 756 - DNA, 51 bp, Artificial Sequence
  Synthetic polynucleotide
aacattttgtctttcttctagttgcbagaacctgtctgtcaccagctcttt

SEQ ID NO: 757 - DNA, 51 bp, Artificial Sequence
  Synthetic polynucleotide
gggtgattctttcaatacttccttaytcaaacaaacttttcaaagagtctt

SEQ ID NO: 758 - DNA, 51 bp, Artificial Sequence
  Synthetic polynucleotide
ccatcaagtgtcctacgtaaaggagyattggaatgatgtgttcaggtgagt

SEQ ID NO: 759 - DNA, 51 bp, Artificial Sequence
  Synthetic polynucleotide
ctgcaggtgcttcagctgctgctgcygtgtgccttcggcatgagctccctg

SEQ ID NO: 760 - DNA, 51 bp, Artificial Sequence
  Synthetic polynucleotide
agtgacaggggtgcggtaccagcagycgtggctctgcatcatgtgagttgc

SEQ ID NO: 761 - DNA, 51 bp, Artificial Sequence
  Synthetic polynucleotide
gccctgatggtggtggccgtgctccygggcttcgtggccatggtcctcagc

SEQ ID NO: 762 - DNA, 51 bp, Artificial Sequence
  Synthetic polynucleotide
aacacagatggtcagacttttgagaytgcaatttctaaccagatgagacaa

SEQ ID NO: 763 - DNA, 51 bp, Artificial Sequence
  Synthetic polynucleotide
acaggtctttactggcttattttctycaaagtgagtgagtttctgaatttt

SEQ ID NO: 764 - DNA, 51 bp, Artificial Sequence
  Synthetic polynucleotide
agaacgttttgtcacttatgttggahgtgcctttgctctgaaggtaagttt

SEQ ID NO: 765 - DNA, 51 bp, Artificial Sequence
  Synthetic polynucleotide
acatcttgtcaagctcttggaaataygtgtgtgatgaacatgaattcttac

SEQ ID NO: 766 - DNA, 51 bp, Artificial Sequence
  Synthetic polynucleotide
ccccgtgcgcaacttgcgcctccggyagtcgcaccgccccagccccgaggc

SEQ ID NO: 767 - DNA, 51 bp, Artificial Sequence
  Synthetic polynucleotide
aattacatgctcatttactttaagcytgttggactaccagcaatgccagca

SEQ ID NO: 768 - DNA, 51 bp, Artificial Sequence
  Synthetic polynucleotide
atggaatggtctataactggaatgcyggagttcagtttgtttggaatacct

SEQ ID NO: 769 - DNA, 51 bp, Artificial Sequence
  Synthetic polynucleotide
caccccaaccgacgccccaagatccyggcccagacagcagcccatgtagct

SEQ ID NO: 770 - DNA, 51 bp, Artificial Sequence
  Synthetic polynucleotide
gcacgatcccgagactctgcttcgcygcatcgctgaaagggccttcctgag

SEQ ID NO: 771 - DNA, 51 bp, Artificial Sequence
  Synthetic polynucleotide
gagaaaagcctgtttaccaaggagcytgaacatgccctggagaagaatgag

SEQ ID NO: 772 - DNA, 51 bp, Artificial Sequence
  Synthetic polynucleotide
accagagggtcccctggtcgaagcaytggaatccagaaaccagttgggcat

SEQ ID NO: 773 - DNA, 51 bp, Artificial Sequence
  Synthetic polynucleotide
agactccaatgtcattgtggtggacyggctgtcacgggctcaggagcatta

SEQ ID NO: 774 - DNA, 51 bp, Artificial Sequence
  Synthetic polynucleotide
aacattggagaagctatccgcgtgaytgcagagagaggacttggaggtaaa

SEQ ID NO: 775 - DNA, 51 bp, Artificial Sequence
  Synthetic polynucleotide
gctggggccaggccccgcggccgacytctccgtgtcggtggagcgcgctct

SEQ ID NO: 776 - DNA, 51 bp, Artificial Sequence
  Synthetic polynucleotide
gcgtgtgctccgagatcttcgcatcytccggatctttgaggggacaaatga

SEQ ID NO: 777 - DNA, 51 bp, Artificial Sequence
  Synthetic polynucleotide
gaaagagaatgctgtgcccacaatayttctttgtactgagccacatgacaa

SEQ ID NO: 778 - DNA, 51 bp, Artificial Sequence
  Synthetic polynucleotide
agacaagagtcgtccttttattacgyccagtcctacaaatggggctgaaac

SEQ ID NO: 779 - DNA, 51 bp, Artificial Sequence
  Synthetic polynucleotide
aagcagtttttgacaaatagagtgcyaaaagacccaaaacaaaggcggttt

SEQ ID NO: 780 - DNA, 51 bp, Artificial Sequence
  Synthetic polynucleotide
gaaacgaaatatcgtgtcttgaagaytgatagaacagaaccaaaagatttg

SEQ ID NO: 781 - DNA, 51 bp, Artificial Sequence
  Synthetic polynucleotide
gatggggacactgcctattttgcggygagtctctcctccctgccagctctc

SEQ ID NO: 782 - DNA, 51 bp, Artificial Sequence
  Synthetic polynucleotide
tctaaaggcaactctagacatcgcgyccaacaaccgtaagggtatcgcctt

SEQ ID NO: 783 - DNA, 51 bp, Artificial Sequence
  Synthetic polynucleotide
ggcgctgcatcacaatgagaaggagyggcaccagccggatcagttcatgcc

SEQ ID NO: 784 - DNA, 51 bp, Artificial Sequence
  Synthetic polynucleotide
gagatcctggcccgccaggagctctycctcatcatggcctggctgctgcag

SEQ ID NO: 785 - DNA, 51 bp, Artificial Sequence
  Synthetic polynucleotide
ggagatggtaacctgcacctcaatgygacggcggaggccttcagcccctcg

SEQ ID NO: 786 - DNA, 51 bp, Artificial Sequence
  Synthetic polynucleotide
tcctaccatgtatacctttaggcccyggaccatccgccagtatgctggttt

SEQ ID NO: 787 - DNA, 51 bp, Artificial Sequence
  Synthetic polynucleotide
ctgtaccagaagttcatggcctatcyttctcagggagggaaggtgttgggc

SEQ ID NO: 788 - DNA, 51 bp, Artificial Sequence
  Synthetic polynucleotide
aattgccatgcaaaacaggctccccygcatctacttaggcaagtcaccaga

SEQ ID NO: 789 - DNA, 51 bp, Artificial Sequence
  Synthetic polynucleotide
cattatgaccccatgattgcgaagcyggtcgtgtgggcagcagatcgccag

SEQ ID NO: 790 - DNA, 51 bp, Artificial Sequence
  Synthetic polynucleotide
attgcaaagattgctgactacggcaytgctcagtactgctgtagaatgggg

SEQ ID NO: 791 - DNA, 51 bp, Artificial Sequence
  Synthetic polynucleotide
gaggtgcggtacagtccgcacctgcyggccaactccaaagtggagccaatc

SEQ ID NO: 792 - DNA, 51 bp, Artificial Sequence
  Synthetic polynucleotide
ctggccgcctcattcagctccctgcygacctacggcctctccctcatccgg

SEQ ID NO: 793 - DNA, 51 bp, Artificial Sequence
  Synthetic polynucleotide
ccctgcacgggtggttaatgtgtccycggtggctcaccacattggcaagat

SEQ ID NO: 794 - DNA, 51 bp, Artificial Sequence
  Synthetic polynucleotide
tgcctgctgctcaacctctgtgagayggcccacctgggcttgggcagcgcg

SEQ ID NO: 795 - DNA, 51 bp, Artificial Sequence
  Synthetic polynucleotide
cttcggctgcctgaacaacgcccggyacggcatcgcgtggggcgtgcttgg

SEQ ID NO: 796 - DNA, 51 bp, Artificial Sequence
  Synthetic polynucleotide
cggtttattgggccaagcccagaagbggtccgcaagatgggagacaaggtg

SEQ ID NO: 797 - DNA, 51 bp, Artificial Sequence
  Synthetic polynucleotide
gatcctgccatgaagcagtttctgcygtacttggatgagtccaatgccctg

SEQ ID NO: 798 - DNA, 51 bp, Artificial Sequence
  Synthetic polynucleotide
tcttcttccagacacagagattgacyggaaggcctacatggccgaggtaga

SEQ ID NO: 799 - DNA, 51 bp, Artificial Sequence
  Synthetic polynucleotide
ggctatgatgtagtaaaggaatgccytgttcatcaaagcgaaatttttgca

SEQ ID NO: 800 - DNA, 51 bp, Artificial Sequence
  Synthetic polynucleotide
ctgggccttggacccggactcgttaygaagagcgattcttcgacctctgca

SEQ ID NO: 801 - DNA, 51 bp, Artificial Sequence
  Synthetic polynucleotide
cttctggaggaggcggccgacctccyggtggtgcacctggacttccgggcg

SEQ ID NO: 802 - DNA, 51 bp, Artificial Sequence
  Synthetic polynucleotide
tggtcagatgatcatgtgcccactcbgtgatcaagtgtgtgattattggag

SEQ ID NO: 803 - DNA, 51 bp, Artificial Sequence
  Synthetic polynucleotide
ccagctggtgcaaggtttccgggtghcttggagggtagcaggccctgaggg

SEQ ID NO: 804 - DNA, 51 bp, Artificial Sequence
  Synthetic polynucleotide
ctgggtcgagccatgctgcgctaccygctgaaaacgctgctgcagatgaac

SEQ ID NO: 805 - DNA, 51 bp, Artificial Sequence
  Synthetic polynucleotide
gtatgtttttctcttcctaaggtaabtttaactagttcaaagcaaattgac

SEQ ID NO: 806 - DNA, 51 bp, Artificial Sequence
  Synthetic polynucleotide
gtctccagaggctgtggtccgcgaayggctggacaacattccagaagagcc

SEQ ID NO: 807 - DNA, 51 bp, Artificial Sequence
  Synthetic polynucleotide
gctcgagaccagctcatctatctgcyggagcaggtcagtgcttgcctgacg

SEQ ID NO: 808 - DNA, 51 bp, Artificial Sequence
  Synthetic polynucleotide
cgggattaccgcgcgctctgcgacgygggcaccgccatcagctgttcgcgc

SEQ ID NO: 809 - DNA, 51 bp, Artificial Sequence
  Synthetic polynucleotide
tggcacgggccgccgcatccacagchaccgaggtacgggcccggcgcttag

SEQ ID NO: 810 - DNA, 51 bp, Artificial Sequence
  Synthetic polynucleotide
caacttcgacggcgagccgcagcccyacccaacgctgccgcctggcacggg

SEQ ID NO: 811 - DNA, 51 bp, Artificial Sequence
  Synthetic polynucleotide
gaggccgggcggccgcggcccgtgcygcgctcggtgaactcgcgcgagccc

SEQ ID NO: 812 - DNA, 51 bp, Artificial Sequence
  Synthetic polynucleotide
gtgtatactctgaaagagcgatgccyccaggttgtccggagcctagtcaag

SEQ ID NO: 813 - DNA, 51 bp, Artificial Sequence
  Synthetic polynucleotide
cccgttaccacagaagaacaggttcbggacgtcaaaggttacctatccaaa

SEQ ID NO: 814 - DNA, 51 bp, Artificial Sequence
  Synthetic polynucleotide
aacatgtatgaagaaatggaaacatyagccagtgtacttcagtcagatatt

SEQ ID NO: 815 - DNA, 51 bp, Artificial Sequence
  Synthetic polynucleotide
tggccggtgcacctcttggagacgcygctgccgcggcacctccagatcatc

SEQ ID NO: 816 - DNA, 51 bp, Artificial Sequence
  Synthetic polynucleotide
ctttgacctgcagaacccaagagaghggacgcggatggtgatccggaacat

SEQ ID NO: 817 - DNA, 51 bp, Artificial Sequence
  Synthetic polynucleotide
catgtggagatccaagctgcctacaytggcacaactataatcattcggcag

SEQ ID NO: 818 - DNA, 51 bp, Artificial Sequence
  Synthetic polynucleotide
tggaggggtgggctctggcggcctcbgtcgagccctccgctcctatgcgct

SEQ ID NO: 819 - DNA, 51 bp, Artificial Sequence
  Synthetic polynucleotide
accgcccgcacctgccgcggggaccycgccttccattcggcggtacatggc

SEQ ID NO: 820 - DNA, 51 bp, Artificial Sequence
  Synthetic polynucleotide
gccaagtccagaaccatagggattaytggagctcctttctcaaagggacag

SEQ ID NO: 821 - DNA, 51 bp, Artificial Sequence
  Synthetic polynucleotide
gccgccatgatgctgctgcagctgcyggaaggcgtggaccatctggttcaa

SEQ ID NO: 822 - DNA, 51 bp, Artificial Sequence
  Synthetic polynucleotide
gccaggtacaacgccgccgccattcygaccatggagcccgtcctggggggc

SEQ ID NO: 823 - DNA, 51 bp, Artificial Sequence
  Synthetic polynucleotide
ccgggtcaccaaccccatcaatcccbggtaggtcctgccactcccagctct

SEQ ID NO: 824 - DNA, 51 bp, Artificial Sequence
  Synthetic polynucleotide
agtatttctgattgtcaggccaacayaatgcagatggaagaagcaaaggtt

SEQ ID NO: 825 - DNA, 51 bp, Artificial Sequence
  Synthetic polynucleotide
gtcagcccttcagacagagactttayggaaacgttaaacaccctgaaatac

SEQ ID NO: 826 - DNA, 51 bp, Artificial Sequence
  Synthetic polynucleotide
tcatggcggaaagagacagtccagcyatggccaggccccagtggctattca

SEQ ID NO: 827 - DNA, 51 bp, Artificial Sequence
  Synthetic polynucleotide
cctcagcgatgatcatggtgcctccyggcgctacggaagtggggtcagcgg

SEQ ID NO: 828 - DNA, 51 bp, Artificial Sequence
  Synthetic polynucleotide
tgatgcctacttcagtcccattcacycccagttggatcatttactggatcc

SEQ ID NO: 829 - DNA, 51 bp, Artificial Sequence
  Synthetic polynucleotide
tccaaggtagagcagcttgacaagayggtgacagaaaaggcaggatttaag

SEQ ID NO: 830 - DNA, 51 bp, Artificial Sequence
  Synthetic polynucleotide
cctgccttcaatagattgtttccccyggcttctctcgtgcttatctactgg

SEQ ID NO: 831 - DNA, 51 bp, Artificial Sequence
  Synthetic polynucleotide
ccttcctgtatcaggagtcccaggtrtattgtttccaggtgtttatcatct

SEQ ID NO: 832 - DNA, 51 bp, Artificial Sequence
  Synthetic polynucleotide
gtgggcatcttcgtggactacagaghtggaagcatctccttttacaatgtg

SEQ ID NO: 833 - DNA, 51 bp, Artificial Sequence
  Synthetic polynucleotide
ggtgaaggaatctctctccagttacygggagtcagcaaagacagccgccca

SEQ ID NO: 834 - DNA, 51 bp, Artificial Sequence
  Synthetic polynucleotide
ctcttctttctaaagcttgaaagaaytgctgattccaaggagcaagttttc

SEQ ID NO: 835 - DNA, 51 bp, Artificial Sequence
  Synthetic polynucleotide
tcagacttctctggctccactacccygctacgtttatctgattgagcatcc

SEQ ID NO: 836 - DNA, 51 bp, Artificial Sequence
  Synthetic polynucleotide
tgacttatggacgaagaaatacagtrcctgatggacataatattcaagatc

SEQ ID NO: 837 - DNA, 51 bp, Artificial Sequence
  Synthetic polynucleotide
ctgctgggctctgtcaacagcttgcygaaggagctgagatgaggccccaca

SEQ ID NO: 838 - DNA, 51 bp, Artificial Sequence
  Synthetic polynucleotide
tctctcaggtgacagtggggccgggygttggtctgtctctggaagacacca

SEQ ID NO: 839 - DNA, 51 bp, Artificial Sequence
  Synthetic polynucleotide
agtgaagaaaggtggatcctacatgygccatagggtaagtcatgtcactaa

SEQ ID NO: 840 - DNA, 51 bp, Artificial Sequence
  Synthetic polynucleotide
cttataggctgagaagtttggcgacycctttgtctttgaaggcatgttgag

SEQ ID NO: 841 - DNA, 51 bp, Artificial Sequence
  Synthetic polynucleotide
tgcagatgaagaaaatcatctgaathctaaaattgcctacaagatcgtctc

SEQ ID NO: 842 - DNA, 51 bp, Artificial Sequence
  Synthetic polynucleotide
cccccgcccctcctgcccaggcttcyacgtgacgctggtcgtgacccgctg

SEQ ID NO: 843 - DNA, 51 bp, Artificial Sequence
  Synthetic polynucleotide
tatggcgagttcttaatcttcctgcyctgctactacatcatccgctttatt

SEQ ID NO: 844 - DNA, 51 bp, Artificial Sequence
  Synthetic polynucleotide
cttggaggtcgaatccgggaccctaycctgctccagagcctgctgaacgtg

SEQ ID NO: 845 - DNA, 51 bp, Artificial Sequence
  Synthetic polynucleotide
tacgactggattagtatcccactggygtatacacaggtgaggactaggctg

SEQ ID NO: 846 - DNA, 51 bp, Artificial Sequence
  Synthetic polynucleotide
tgtttgttgttgttaaaaggatgttyttcgaaatttgagccacttgcctac

SEQ ID NO: 847 - DNA, 51 bp, Artificial Sequence
  Synthetic polynucleotide
tataaacattttacatgcaatgtacyaccaagaatcaaaggccttggtaag

SEQ ID NO: 848 - DNA, 51 bp, Artificial Sequence
  Synthetic polynucleotide
caggtgccatcttcaaacagttccaytatttatgtctggtgcacagttttg

SEQ ID NO: 849 - DNA, 51 bp, Artificial Sequence
  Synthetic polynucleotide
ctcaatgttacaccactggcaagaayagtaggtaaggccaggcgaggtggc

SEQ ID NO: 850 - DNA, 51 bp, Artificial Sequence
  Synthetic polynucleotide
ctcagttttcccattagcaagctccyggacttttttctgggccaggagatt

SEQ ID NO: 851 - DNA, 51 bp, Artificial Sequence
  Synthetic polynucleotide
gatgacaagaacaatgatggatacaytgactatgctgaatttgcaaaatca

SEQ ID NO: 852 - DNA, 51 bp, Artificial Sequence
  Synthetic polynucleotide
tgtgcccgaggaggacgggacccgcytccacagacaggtaagcacggccgt

SEQ ID NO: 853 - DNA, 51 bp, Artificial Sequence
  Synthetic polynucleotide
gacttccgggacaagctgagccccaytgtgctcagcctcaatgtgtcccta

SEQ ID NO: 854 - DNA, 51 bp, Artificial Sequence
  Synthetic polynucleotide
cccttccaggccggagagctggtgcytggggctcctggcggctattatttc

SEQ ID NO: 855 - DNA, 51 bp, Artificial Sequence
  Synthetic polynucleotide
tccaaaagaggatttggaattgcagygtccggaggcagagacaacccccac

SEQ ID NO: 856 - DNA, 51 bp, Artificial Sequence
  Synthetic polynucleotide
gcctaccatggcaacctcgagtcgcygcgtctcattgtgagccgcgggtga

SEQ ID NO: 857 - DNA, 51 bp, Artificial Sequence
  Synthetic polynucleotide
gacgctctgaagaaagcccgacttayagccagtaatgtcaccgaaaccatg

SEQ ID NO: 858 - DNA, 51 bp, Artificial Sequence
  Synthetic polynucleotide
tttgtccgggtcacaaccaatccagytgacctctggtcagcccccagcagc

SEQ ID NO: 859 - DNA, 51 bp, Artificial Sequence
  Synthetic polynucleotide
actgaacctgttttgtgagctgacaygtagccctcgacagagtcagttttt

SEQ ID NO: 860 - DNA, 51 bp, Artificial Sequence
  Synthetic polynucleotide
cgggccctgaccaccgtcacagcacytgtgaggaagttcctggggccagtg

SEQ ID NO: 861 - DNA, 51 bp, Artificial Sequence
  Synthetic polynucleotide
ctcaattctcggctggcctcttactyggataaggtgcaggctctagaggag

SEQ ID NO: 862 - DNA, 51 bp, Artificial Sequence
  Synthetic polynucleotide
  misc_feature (26)..(26): n is a, c, g, t or u
ctgactgctaatgagaagagcaccangcaggaactcaattctcggctggcc

SEQ ID NO: 863 - DNA, 51 bp, Artificial Sequence
  Synthetic polynucleotide
ccagcagaccagccaattactaaacytaagaatttagaagatgttgttgtc

SEQ ID NO: 864 - DNA, 51 bp, Artificial Sequence
  Synthetic polynucleotide
ggggtggggcctgagggggccttccygcccccccatcagggcttccatcga

SEQ ID NO: 865 - DNA, 51 bp, Artificial Sequence
  Synthetic polynucleotide
aatgatgttagagatcatcaactccygcctgacaaattcccttcaccacaa

SEQ ID NO: 866 - DNA, 51 bp, Artificial Sequence
  Synthetic polynucleotide
gaccaaactgaaatctgtaagcaggygggtaacagctgcagcatagctaac

SEQ ID NO: 867 - DNA, 51 bp, Artificial Sequence
  Synthetic polynucleotide
actcatgcgatccacttggtagtctytcatgagaggagtggcaactacctc

SEQ ID NO: 868 - DNA, 51 bp, Artificial Sequence
  Synthetic polynucleotide
ggcaggactaaggtggctggactcaygggacttttgaggccactgcaaaga

SEQ ID NO: 869 - DNA, 51 bp, Artificial Sequence
  Synthetic polynucleotide
acattggattccattttatttctacytaataacgtgcacctttctcatcct

SEQ ID NO: 870 - DNA, 51 bp, Artificial Sequence
  Synthetic polynucleotide
acgagggatgagttggagaggaggcygctgcagatgaaagaagaagcaaca

SEQ ID NO: 871 - DNA, 51 bp, Artificial Sequence
  Synthetic polynucleotide
gaatacatggaaaagagcaagcatcygcaggagcagctcaatgaactcaag

SEQ ID NO: 872 - DNA, 51 bp, Artificial Sequence
  Synthetic polynucleotide
ctggggctccgagaaacctggttctytggactgcagtacacaatcaaggac

SEQ ID NO: 873 - DNA, 51 bp, Artificial Sequence
  Synthetic polynucleotide
agacatgaacgtagttgttgttgatyggaatcgaggagctacaactttaat

SEQ ID NO: 874 - DNA, 51 bp, Artificial Sequence
  Synthetic polynucleotide
gccacgctgggggtcgccgagttctytgagtttgtgcttaagaacccccac

SEQ ID NO: 875 - DNA, 51 bp, Artificial Sequence
  Synthetic polynucleotide
accctcccgcactgtcttgcagtccygctggccctcgcggcctggctgcgg

SEQ ID NO: 876 - DNA, 51 bp, Artificial Sequence
  Synthetic polynucleotide
gtcccacctgatttccaggtatggtyttctaatcgaagggccaaatggaga

SEQ ID NO: 877 - DNA, 51 bp, Artificial Sequence
  Synthetic polynucleotide
ctctgtccatttaggtgtgaaaccaytccagtgtaaaacttgtcagcgaaa

SEQ ID NO: 878 - DNA, 51 bp, Artificial Sequence
  Synthetic polynucleotide
ccagtgtaaaacttgtcagcgaaagytctcccggtccgaccacctgaagac

SEQ ID NO: 879 - DNA, 51 bp, Artificial Sequence
  Synthetic polynucleotide
gtgccaggcctccacttctacacccycaaccgcgagatggctaccacagag

SEQ ID NO: 880 - DNA, 51 bp, Artificial Sequence
  Synthetic polynucleotide
tcacgcccaggaagtcgatcccaaaragtcctgaaggcttcccagacagct

SEQ ID NO: 881 - DNA, 51 bp, Artificial Sequence
  Synthetic polynucleotide
cccgtggacgatgcaatcaatgggcyaagcgaggagcagaggcaggtgagg

SEQ ID NO: 882 - DNA, 51 bp, Artificial Sequence
  Synthetic polynucleotide
cagttagctactgatgctgtgcagayacttggaggcaatggatttaataca

SEQ ID NO: 883 - DNA, 51 bp, Artificial Sequence
  Synthetic polynucleotide
ttaggaattaaacatgggccagcgaygttcagatactagaggaattgtctt

SEQ ID NO: 884 - DNA, 51 bp, Artificial Sequence
  Synthetic polynucleotide
ggaaatcatcccagtggctgcagaayatgataaaactggtgaagtaggtat

SEQ ID NO: 885 - DNA, 51 bp, Artificial Sequence
  Synthetic polynucleotide
ccccgccatgaccctctcaaccctcbgtgtcctggggccatccgagccaac

SEQ ID NO: 886 - DNA, 51 bp, Artificial Sequence
  Synthetic polynucleotide
ctccgtatccctatctgatagatctytgaaaacaaaggtgccatgatgggc

SEQ ID NO: 887 - DNA, 51 bp, Artificial Sequence
  Synthetic polynucleotide
cccttgacaggtatgggccagcagtytcctgccagatattgcccagcgtga

SEQ ID NO: 888 - DNA, 51 bp, Artificial Sequence
  Synthetic polynucleotide
actccggaccaggagcgctcactcaygttcatgcaatggggccagctgttg

SEQ ID NO: 889 - DNA, 51 bp, Artificial Sequence
  Synthetic polynucleotide
ctcagccaggagattcggaacgaggyttgtctgtgccagcagacaggtggg

SEQ ID NO: 890 - DNA, 51 bp, Artificial Sequence
  Synthetic polynucleotide
gactgtgcgcgccgccccctatgacyggcggctggagcccggtgagtgtct

SEQ ID NO: 891 - DNA, 51 bp, Artificial Sequence
  Synthetic polynucleotide
cgctttattgatggcttcatctctcytggggctccctggggtggctccatc

SEQ ID NO: 892 - DNA, 51 bp, Artificial Sequence
  Synthetic polynucleotide
caggtgccccagaccccagctgcccygaccccttccacccgctgcaggcca

SEQ ID NO: 893 - DNA, 51 bp, Artificial Sequence
  Synthetic polynucleotide
ccacagacttggaacgcagtgctgcygcgctatttcaaccccacaggtgcc

SEQ ID NO: 894 - DNA, 51 bp, Artificial Sequence
  Synthetic polynucleotide
acaaatctgacgaggaaaactgcggyatgggcggggccagggtgggggcgg

SEQ ID NO: 895 - DNA, 51 bp, Artificial Sequence
  Synthetic polynucleotide
cagagcagtggaagcagcagagttaygtttggagcaaaacaataaaactga

SEQ ID NO: 896 - DNA, 51 bp, Artificial Sequence
  Synthetic polynucleotide
gctaacatgctctttcttggccttaycagtgacaggggtcttcagaaagaa

SEQ ID NO: 897 - DNA, 51 bp, Artificial Sequence
  Synthetic polynucleotide
gccttccgtcttttataataggaccygccagtgctctggcaacttcatggg

SEQ ID NO: 898 - DNA, 51 bp, Artificial Sequence
  Synthetic polynucleotide
caccgcccgggccgagggcgactcabgggttctgaatggaaccaaagcctg

SEQ ID NO: 899 - DNA, 51 bp, Artificial Sequence
  Synthetic polynucleotide
gcgcctcagccactcacggtttccartcagcacagagaaggtctgggggac

SEQ ID NO: 900 - DNA, 51 bp, Artificial Sequence
  Synthetic polynucleotide
gccttcactgtccttgtctttcagcycctcggtgggtggtacttctacgtt

SEQ ID NO: 901 - DNA, 51 bp, Artificial Sequence
  Synthetic polynucleotide
agcaggggctgttgccgaaaggctgyggagcaacaagttgacatctgacct

SEQ ID NO: 902 - DNA, 51 bp, Artificial Sequence
  Synthetic polynucleotide
tggcatctggtagatgatccttcctycccatatgagagcttcacttttcca

SEQ ID NO: 903 - DNA, 51 bp, Artificial Sequence
  Synthetic polynucleotide
cttgctgttggatacatctcgccatyacctgccactctctagcatcctgga

SEQ ID NO: 904 - DNA, 51 bp, Artificial Sequence
  Synthetic polynucleotide
ctgggccaggtatgcgccccgcaccrgcttggccccaaaacaccagccctc

SEQ ID NO: 905 - DNA, 51 bp, Artificial Sequence
  Synthetic polynucleotide
gtgttcctgctaaacagcaatgccaygggtaagctgcccgccgcccagcgc

SEQ ID NO: 906 - DNA, 51 bp, Artificial Sequence
  Synthetic polynucleotide
gcggccggcgccctggagcgggccayggacgagctgctgcgccgcgcggtg

SEQ ID NO: 907 - DNA, 51 bp, Artificial Sequence
  Synthetic polynucleotide
aagaactgtgataaatttgggattgytgttcatgaattgggtcatgtgata

SEQ ID NO: 908 - DNA, 51 bp, Artificial Sequence
  Synthetic polynucleotide
cctgcagcggcccggacccgagaggygagaagagggaagcggaccagggaa

SEQ ID NO: 909 - DNA, 51 bp, Artificial Sequence
  Synthetic polynucleotide
ccctgcagatgtacctcgaggacctygctgggaaacaatggtgggacaggt

SEQ ID NO: 910 - DNA, 51 bp, Artificial Sequence
  Synthetic polynucleotide
gttgtcctacaaggagaggagcccaytgaaatacgctcaggtgtttccatt

SEQ ID NO: 911 - DNA, 51 bp, Artificial Sequence
  Synthetic polynucleotide
tgcagatgaccctgatgatctgcaaygtaagcggggagaacatgttgcgct

SEQ ID NO: 912 - DNA, 51 bp, Artificial Sequence
  Synthetic polynucleotide
atccctacggttgttgaatctagtcyatgatgtgactcccccagagcttgt

SEQ ID NO: 913 - DNA, 51 bp, Artificial Sequence
  Synthetic polynucleotide
accgccgagtacaaggcatggctgcytgggctgctgcgccagcacggctgc

SEQ ID NO: 914 - DNA, 51 bp, Artificial Sequence
  Synthetic polynucleotide
ctgcgtctccaagatcctgtgcaggyaccaggagactggctccatacgtcc

SEQ ID NO: 915 - DNA, 51 bp, Artificial Sequence
  Synthetic polynucleotide
gagaccacgcgctgcttcggaaccgyggtgggcgacacgcccgcctacctc

SEQ ID NO: 916 - DNA, 51 bp, Artificial Sequence
  Synthetic polynucleotide
ttcgcagtacaagctgcgcaagtccycccacctcaagaagctcaaccggta

SEQ ID NO: 917 - DNA, 51 bp, Artificial Sequence
  Synthetic polynucleotide
tgtactaggccatgaactggggcacyggaagttgggacatacagtcaaaaa

SEQ ID NO: 918 - DNA, 51 bp, Artificial Sequence
  Synthetic polynucleotide
gccccatgaggagtaccaggaggctyacgatgagtgcctggaggaggtgca

SEQ ID NO: 919 - DNA, 51 bp, Artificial Sequence
  Synthetic polynucleotide
gggatgcatcagtgccactgcgtccvggtcgttcttctgactggcaaccag

SEQ ID NO: 920 - DNA, 51 bp, Artificial Sequence
  Synthetic polynucleotide
catctaccaccagacctgggccagayactttgtgaagtaagggatcagcaa

SEQ ID NO: 921 - DNA, 51 bp, Artificial Sequence
  Synthetic polynucleotide
aaattcgaaaaggggtatttgatttytgttgtacgtttcctctttggcctg

SEQ ID NO: 922 - DNA, 51 bp, Artificial Sequence
  Synthetic polynucleotide
ggcttcgatgagctgcaaggtgcctytgacgagcacataggaccgctctgc

SEQ ID NO: 923 - DNA, 51 bp, Artificial Sequence
  Synthetic polynucleotide
ctcatcaccacgagacctgtggcccyggagaaactgcagcacttgctggac

SEQ ID NO: 924 - DNA, 51 bp, Artificial Sequence
  Synthetic polynucleotide
gagaagaccttccggatcggcttcaytgtgctggggcttttcctgctggcc

SEQ ID NO: 925 - DNA, 51 bp, Artificial Sequence
  Synthetic polynucleotide
tctgttgcaggctcctgtggctgtcytgtcatgatattgtttgcctctgaa

SEQ ID NO: 926 - DNA, 51 bp, Artificial Sequence
  Synthetic polynucleotide
gctgtggccagggaacaccttgaacyccttaagcatatgcacactgtgggg

SEQ ID NO: 927 - DNA, 51 bp, Artificial Sequence
  Synthetic polynucleotide
ccaccagtccattcgtcagcccagaytgtcagcaaacacctggtaagtgct

SEQ ID NO: 928 - DNA, 51 bp, Artificial Sequence
  Synthetic polynucleotide
atccaggtggccacagaccatgcaayacagctcaagatcgaagccctcagc

SEQ ID NO: 929 - DNA, 51 bp, Artificial Sequence
  Synthetic polynucleotide
agtgcacacaactccacagagtttcycatctacgaaagaggagtcgaggtt

SEQ ID NO: 930 - DNA, 51 bp, Artificial Sequence
  Synthetic polynucleotide
agcctcatcgagttcagcaccatccyggagggccgcctgggcagcaagtgg

SEQ ID NO: 931 - DNA, 51 bp, Artificial Sequence
  Synthetic polynucleotide
gatcaaaggaattttatacattgacycagtcggattcaatggacggtcaca

SEQ ID NO: 932 - DNA, 51 bp, Artificial Sequence
  Synthetic polynucleotide
accacttttgaagaagctcttgaaayggcatctcgtggagatagcaccaaa

SEQ ID NO: 933 - DNA, 51 bp, Artificial Sequence
  Synthetic polynucleotide
tgtgcagctgctgctcgtggcagccyggagcatgggctgtggtgagtgggc

SEQ ID NO: 934 - DNA, 51 bp, Artificial Sequence
  Synthetic polynucleotide
ggtgacccgctcctgctccagctccygtgtggccaccgaccccgacagcat

SEQ ID NO: 935 - DNA, 51 bp, Artificial Sequence
  Synthetic polynucleotide
cttcgggaggaggtgctaggagaacbgtcaaatgtggagcaagcagctggc

SEQ ID NO: 936 - DNA, 51 bp, Artificial Sequence
  Synthetic polynucleotide
ccggactctgggatcggcggcgctaygagttctttcgaggggcagatggcc

SEQ ID NO: 937 - DNA, 51 bp, Artificial Sequence
  Synthetic polynucleotide
cagatacaggaggcccgagccgactyagcccgcagggggctgcgcttctga

SEQ ID NO: 938 - DNA, 51 bp, Artificial Sequence
  Synthetic polynucleotide
gccttccaagtgctggtctcacagcyaaagattgtcctcaatgtttcaacc

SEQ ID NO: 939 - DNA, 51 bp, Artificial Sequence
  Synthetic polynucleotide
tggaagcatccctagcacagatatcyacaaaagtaccaagaattacaaaaa

SEQ ID NO: 940 - DNA, 51 bp, Artificial Sequence
  Synthetic polynucleotide
ctttcccttcgaccaaggtgtctgtygctccgtaaataaaacgtcccactg

SEQ ID NO: 941 - DNA, 51 bp, Artificial Sequence
  Synthetic polynucleotide
atttttcacttaaaaactcactagghttttgcctcctgaacttccacctgt

SEQ ID NO: 942 - DNA, 51 bp, Artificial Sequence
  Synthetic polynucleotide
aacaaagatttttttaatatgtttcyatcctgtgtcacagtttgaaattgt

SEQ ID NO: 943 - DNA, 51 bp, Artificial Sequence
  Synthetic polynucleotide
aaagctgagcaacatgacagcacaayagaggaggaacaaagatttttttaa

SEQ ID NO: 944 - DNA, 51 bp, Artificial Sequence
  Synthetic polynucleotide
gcgaccaccgggagatcacgaaaggyaccgcgggcctcgcgcgggcgccct

SEQ ID NO: 945 - DNA, 51 bp, Artificial Sequence
  Synthetic polynucleotide
agtggctgcaatgcacgcctcacctycaacatcactgcgggcaaccgcgag

SEQ ID NO: 946 - DNA, 51 bp, Artificial Sequence
  Synthetic polynucleotide
gtggacgtacttgctgagcctcatcytcaaggccgccgtggatgctggctt

SEQ ID NO: 947 - DNA, 51 bp, Artificial Sequence
  Synthetic polynucleotide
ttttggccgaggtccgctgtatccayggctctcctgaccaatctactgccc

SEQ ID NO: 948 - DNA, 51 bp, Artificial Sequence
  Synthetic polynucleotide
cgcgaccgcaacaagtatgggttgcyggcgcgcctcgcagtggaagccggc

SEQ ID NO: 949 - DNA, 51 bp, Artificial Sequence
  Synthetic polynucleotide
gtgatgagcagaagatacctctgcayggatttcagaggcaacatttttgga

SEQ ID NO: 950 - DNA, 51 bp, Artificial Sequence
  Synthetic polynucleotide
tgctatgcagctatgaaaaagaaaayctacgccatgggtggaggctcctac

SEQ ID NO: 951 - DNA, 51 bp, Artificial Sequence
  Synthetic polynucleotide
cagtggggggcggctgctctcagctycacccgtggatgctgctatccgggt

SEQ ID NO: 952 - DNA, 51 bp, Artificial Sequence
  Synthetic polynucleotide
taccgcctggtgcgcttcgaggaccyggcgcgggagccgctggcagaaatc

SEQ ID NO: 953 - DNA, 51 bp, Artificial Sequence
  Synthetic polynucleotide
gtggcggaagtctatctcgtccatcyccatgccagtgtgtacgcactcttt

SEQ ID NO: 954 - DNA, 51 bp, Artificial Sequence
  Synthetic polynucleotide
ccctggccgctgctaccgcgtcaccyggttcacctcctggagcccctgcta

SEQ ID NO: 955 - DNA, 51 bp, Artificial Sequence
  Synthetic polynucleotide
ctgcgagggaaccccaacctcagtcygaggatcttcaccgcgcgcctctac

SEQ ID NO: 956 - DNA, 51 bp, Artificial Sequence
  Synthetic polynucleotide
gattatttttactgctggaatacttytgtagaaaaccacgaaagaactttc

SEQ ID NO: 957 - DNA, 51 bp, Artificial Sequence
  Synthetic polynucleotide
atcattctgcaatttatccctgagaygatttttatcctgtgtctgtttgga

SEQ ID NO: 958 - DNA, 51 bp, Artificial Sequence
  Synthetic polynucleotide
gctgtcaaggaggatgcagtcgagaygctggccagctacgggctggcgtac

SEQ ID NO: 959 - DNA, 51 bp, Artificial Sequence
  Synthetic polynucleotide
tgtttgatgtctttctccccagctcygtttcgtgatgttttggacacccaa

SEQ ID NO: 960 - DNA, 51 bp, Artificial Sequence
  Synthetic polynucleotide
gtgagggcgcatctcaccgggtggcygatgacactgaagaaaaccttcgtc

SEQ ID NO: 961 - DNA, 51 bp, Artificial Sequence
  Synthetic polynucleotide
acaaaaaacgactattgggcgatgcyggcttataacaggtccaagctctgc

SEQ ID NO: 962 - DNA, 51 bp, Artificial Sequence
  Synthetic polynucleotide
cagcggattcctctgtcccaagtggyaggttcttaaagagacccgcgatgg

SEQ ID NO: 963 - DNA, 51 bp, Artificial Sequence
  Synthetic polynucleotide
gacgggcgcactagcagcagggcgcyggtgcctggcggttcccctaggggc

SEQ ID NO: 964 - DNA, 51 bp, Artificial Sequence
  Synthetic polynucleotide
gaaaaggaactgggacttaccaagcygctggatcccgaaggtggggccaga

SEQ ID NO: 965 - DNA, 51 bp, Artificial Sequence
  Synthetic polynucleotide
gcaccctaagcaatgtgcatacttcygtgagaacaagctcaggagcccagt

SEQ ID NO: 966 - DNA, 51 bp, Artificial Sequence
  Synthetic polynucleotide
gaaaatgcagtcttggaccagctgcytaacctaggaaggcagctaatcagt

SEQ ID NO: 967 - DNA, 51 bp, Artificial Sequence
  Synthetic polynucleotide
aatggcgtgtcatccacccaggaccrgtccccttccatccctgctttagtc

SEQ ID NO: 968 - DNA, 51 bp, Artificial Sequence
  Synthetic polynucleotide
tgtggaaaagaaggagagagaatacyctgaacagctaatcgataatgtgcg

SEQ ID NO: 969 - DNA, 51 bp, Artificial Sequence
  Synthetic polynucleotide
aaattttgcccaccgctctgtaccayggagaagtttgcttcctactgcctc

SEQ ID NO: 970 - DNA, 51 bp, Artificial Sequence
  Synthetic polynucleotide
cgagaaggccataatgacctatgtgyccagcttctaccatgccttttcagg

SEQ ID NO: 971 - DNA, 51 bp, Artificial Sequence
  Synthetic polynucleotide
agcgaagccaaaatgccctgccgtgygtacttgtaccaaagataatgcttt

SEQ ID NO: 972 - DNA, 51 bp, Artificial Sequence
  Synthetic polynucleotide
gcagaatttgcaaagtctcaagaccygccttatcaatcattgtccatagac

SEQ ID NO: 973 - DNA, 51 bp, Artificial Sequence
  Synthetic polynucleotide
gcaaacctgcgtcaacacctacggcyctttcatctgccgctgtgacccagg

SEQ ID NO: 974 - DNA, 51 bp, Artificial Sequence
  Synthetic polynucleotide
ttgcttgcatttctgtttccagacaytgatgaatgtcgctatggttactgc

SEQ ID NO: 975 - DNA, 51 bp, Artificial Sequence
  Synthetic polynucleotide
gttttctgtattggtgtgttttgtaycttgcttgaacttcctgttcttctt

SEQ ID NO: 976 - DNA, 51 bp, Artificial Sequence
  Synthetic polynucleotide
gagctagcctcctatgatatgcggcygaggtaggtggtctgggtggggtga

SEQ ID NO: 977 - DNA, 51 bp, Artificial Sequence
  Synthetic polynucleotide
aatggattatacttactatgcagtayggcccgatcctgatttagttcatga

SEQ ID NO: 978 - DNA, 51 bp, Artificial Sequence
  Synthetic polynucleotide
aagtgagtcttggcttaagaatgcayggcattttattagtgaatctgtaag

SEQ ID NO: 979 - DNA, 51 bp, Artificial Sequence
  Synthetic polynucleotide
cagatggtatcagctggtgaactctytgaccctgatatagaagtactaaag

SEQ ID NO: 980 - DNA, 51 bp, Artificial Sequence
  Synthetic polynucleotide
gagccgcttgggccggggcaagcgcycgctagtgctggacctgaagcagcc

SEQ ID NO: 981 - DNA, 51 bp, Artificial Sequence
  Synthetic polynucleotide
aatccaaggcttatttatgccaggcygagtggatttggccagtcaggaagc

SEQ ID NO: 982 - DNA, 51 bp, Artificial Sequence
  Synthetic polynucleotide
gacagaggaacaaaggagactcttayggtcagtaccaccatgagaatgtga

SEQ ID NO: 983 - DNA, 51 bp, Artificial Sequence
  Synthetic polynucleotide
tactctgatcctcaactactgccagygcctgctgaagaaggaggagtacta

SEQ ID NO: 984 - DNA, 51 bp, Artificial Sequence
  Synthetic polynucleotide
ctctcatttgctttagccagtcgtcygggattgtattccaaaacttcccag

SEQ ID NO: 985 - DNA, 51 bp, Artificial Sequence
  Synthetic polynucleotide
gaagtgggtcctaaaaactcttacaytgcatacatagaagatcacagtggc

SEQ ID NO: 986 - DNA, 51 bp, Artificial Sequence
  Synthetic polynucleotide
acctatgtcggcggcatcctgctgcyctccaagcagcactaccggctggtg

SEQ ID NO: 987 - DNA, 51 bp, Artificial Sequence
  Synthetic polynucleotide
atctacaggcatcgacatcctgtacycgggctcccagaaggccctgaacgc

SEQ ID NO: 988 - DNA, 51 bp, Artificial Sequence
  Synthetic polynucleotide
aagcccttctccttctacctggacaycaagtggctggccaacttctggggc

SEQ ID NO: 989 - DNA, 51 bp, Artificial Sequence
  Synthetic polynucleotide
acatggcacgaagtgaccctttccaygacagacccactgtcccagacctcc

SEQ ID NO: 990 - DNA, 51 bp, Artificial Sequence
  Synthetic polynucleotide
acactgtgaactcaacatcgatgaaygcttttcaaacccctgtatccatgg

SEQ ID NO: 991 - DNA, 51 bp, Artificial Sequence
  Synthetic polynucleotide
agataaactgttctacatctacacayccggcaccacagggctgcccaaggc

SEQ ID NO: 992 - DNA, 51 bp, Artificial Sequence
  Synthetic polynucleotide
cgctggtacgtgacggtgttcccgtygcgcgccctgcaccgccgcacgccc

SEQ ID NO: 993 - DNA, 51 bp, Artificial Sequence
  Synthetic polynucleotide
tgctgcgtccccttcacggccctgcygtacccgctgcccggctgggtgctg

SEQ ID NO: 994 - DNA, 51 bp, Artificial Sequence
  Synthetic polynucleotide
atctccatcatcgtgggcaccatcaytggctctgggatcttcgtttccccc

SEQ ID NO: 995 - DNA, 51 bp, Artificial Sequence
  Synthetic polynucleotide
tggtgtccagcagcatccggcttcayggggggacttgaaccctgcagcagg

SEQ ID NO: 996 - DNA, 51 bp, Artificial Sequence
  Synthetic polynucleotide
caggagggcaaggtgcagtttgtgaytgatgcggtgtacgccattgcccac

SEQ ID NO: 997 - DNA, 51 bp, Artificial Sequence
  Synthetic polynucleotide
gttttccaaaggaggctaccagataygcaggcgtcacaaagactgtgaggg

SEQ ID NO: 998 - DNA, 51 bp, Artificial Sequence
  Synthetic polynucleotide
cccaaccaagatgcgagtggaacgaygggccttcaacttcagcgaattgat

SEQ ID NO: 999 - DNA, 51 bp, Artificial Sequence
  Synthetic polynucleotide
ctccagacgatcaccatctgcttccyggtcatgcactacagaggacagact

SEQ ID NO: 1000 - DNA, 51 bp, Artificial Sequence
  Synthetic polynucleotide
actggcggaagctagctttgcaatayggcggccgaggcggacggaccgctt

SEQ ID NO: 1001 - DNA, 51 bp, Artificial Sequence
  Synthetic polynucleotide
ctgggagccaagagtgctgaagggtygagtctccagtctgtaatgctggag

SEQ ID NO: 1002 - DNA, 51 bp, Artificial Sequence
  Synthetic polynucleotide
acgctgaacatgctcatcaagatcaytggcaattcagtgggggcgctgggt

SEQ ID NO: 1003 - DNA, 51 bp, Artificial Sequence
  Synthetic polynucleotide
gctgggtttggatttctcaccctgcyccttggtcttgactgcgtgaaattc

SEQ ID NO: 1004 - DNA, 51 bp, Artificial Sequence
  Synthetic polynucleotide
atatgccctggtcttccagtgaagcyggtggtaactcgagcgttgatgatt

SEQ ID NO: 1005 - DNA, 51 bp, Artificial Sequence
  Synthetic polynucleotide
ctttcttccatagctgctaaaggccyggagccctgtttttaggaactacat

SEQ ID NO: 1006 - DNA, 51 bp, Artificial Sequence
  Synthetic polynucleotide
tattgtgaaaacccagatatagtgcygtgtggaaacaagagtgatctggag

SEQ ID NO: 1007 - DNA, 51 bp, Artificial Sequence
  Synthetic polynucleotide
cccgccctgctgggtgctgccagcayggttctggactacacaacacgcagg

SEQ ID NO: 1008 - DNA, 51 bp, Artificial Sequence
  Synthetic polynucleotide
cgctgcggccccctcaacgtgacgcyggccgcagaggcctgccgccgcaag

SEQ ID NO: 1009 - DNA, 51 bp, Artificial Sequence
  Synthetic polynucleotide
ctggtgcgcgacccccgggccgtgcyggcctcgcgcatggtggccttcgcc

SEQ ID NO: 1010 - DNA, 51 bp, Artificial Sequence
  Synthetic polynucleotide
cggcagctggagttcctgcagccgcyggccgaggacccccgcctggacctg

SEQ ID NO: 1011 - DNA, 51 bp, Artificial Sequence
  Synthetic polynucleotide
ttctactatgtcatcctgtacctcayggtgatgattggaatgttctctttc

SEQ ID NO: 1012 - DNA, 51 bp, Artificial Sequence
  Synthetic polynucleotide
gtcatcctgtacctcatggtgatgaytggaatgttctctttcatcatcgtg

SEQ ID NO: 1013 - DNA, 51 bp, Artificial Sequence
  Synthetic polynucleotide
gtacctcatggtgatgattggaatghtctctttcatcatcgtggccatcct

SEQ ID NO: 1014 - DNA, 51 bp, Artificial Sequence
  Synthetic polynucleotide
tcatcctccttgctctccccacagcycctcatcccccatacccgatacacc

SEQ ID NO: 1015 - DNA, 51 bp, Artificial Sequence
  Synthetic polynucleotide
attcggaagtggttggacaagtaagygccattgtactgtttgcgactagtt

SEQ ID NO: 1016 - DNA, 51 bp, Artificial Sequence
  Synthetic polynucleotide
gccaccggcctcactcccacacaagyaggcaactggtttaagaaccggcgg

SEQ ID NO: 1017 - DNA, 51 bp, Artificial Sequence
  Synthetic polynucleotide
tttattagtgagctaagagatgattytttaaaatttgatgacaagtttgca

SEQ ID NO: 1018 - DNA, 51 bp, Artificial Sequence
  Synthetic polynucleotide
ctgtgtcccacctgggaccagatgcyggtgttcgacaacctggagctctat

SEQ ID NO: 1019 - DNA, 51 bp, Artificial Sequence
  Synthetic polynucleotide
gacgtggccatcggcacccacttcaytgacctgcgcaagatttctaatgac

SEQ ID NO: 1020 - DNA, 51 bp, Artificial Sequence
  Synthetic polynucleotide
gatgctggaggccatctgcaagcacygggaggggcccatcagcctggccct

SEQ ID NO: 1021 - DNA, 51 bp, Artificial Sequence
  Synthetic polynucleotide
gaggcctccatgcacagatattaagrgcttggggagttccagctgccaatc

SEQ ID NO: 1022 - DNA, 51 bp, Artificial Sequence
  Synthetic polynucleotide
acctgtttgtgtctccagattacatygacaaccatcggctatggtgacaag

SEQ ID NO: 1023 - DNA, 51 bp, Artificial Sequence
  Synthetic polynucleotide
actgaaccaccttttcccccacagcygtaccttccttggaaagagagtaga

SEQ ID NO: 1024 - DNA, 51 bp, Artificial Sequence
  Synthetic polynucleotide
cgctcgtgcctgcgttcgctgcgccycctcgtcttcgccgtcttctcagcc

SEQ ID NO: 1025 - DNA, 51 bp, Artificial Sequence
  Synthetic polynucleotide
catcccggtcactcccaagaacccgyggagcatggatgagaacctcatgca

SEQ ID NO: 1026 - DNA, 51 bp, Artificial Sequence
  Synthetic polynucleotide
acattgaacatgctgattaagatcaytggtaactcagtaggggctctaggt

SEQ ID NO: 1027 - DNA, 51 bp, Artificial Sequence
  Synthetic polynucleotide
tttctttaccttggaggtcaagacayctttatgacagaagaacagaagaaa

SEQ ID NO: 1028 - DNA, 51 bp, Artificial Sequence
  Synthetic polynucleotide
ggcaatgtttcagctcttcgaacttycagagtattgagagctttgaaaact

SEQ ID NO: 1029 - DNA, 51 bp, Artificial Sequence
  Synthetic polynucleotide
agatggctgtggatgctgtaaaatcygtgccaagcaaccaggggaaatctg

SEQ ID NO: 1030 - DNA, 51 bp, Artificial Sequence
  Synthetic polynucleotide
taaatggaagatgctgtggattacaycttgtgtgtgtcagagaaactgcag

SEQ ID NO: 1031 - DNA, 51 bp, Artificial Sequence
  Synthetic polynucleotide
cgagcactcagttatgacttacctgycccagttccccaaagccaagctcaa

SEQ ID NO: 1032 - DNA, 51 bp, Artificial Sequence
  Synthetic polynucleotide
  misc_feature (26)..(26): n is a, c, g, t or u
gatttgttactgacaaggcctagggnaagttttcacagcctaaaacacagt

SEQ ID NO: 1033 - DNA, 51 bp, Artificial Sequence
  Synthetic polynucleotide
tacaagacctaagttccaagaagcarcagtcccacaacattctggatctgc

SEQ ID NO: 1034 - DNA, 51 bp, Artificial Sequence
  Synthetic polynucleotide
ggtcaccatcatgtccataatgctgyggtatgtaaaagagacctgcctgag

SEQ ID NO: 1035 - DNA, 51 bp, Artificial Sequence
  Synthetic polynucleotide
atgcctcagacaaaattcaaagcctrtgtcatcagagagtgaaaaggatat

SEQ ID NO: 1036 - DNA, 51 bp, Artificial Sequence
  Synthetic polynucleotide
ggctgttgtgggaaatatggactctygtggggaatctctccagatcttaag

SEQ ID NO: 1037 - DNA, 51 bp, Artificial Sequence
  Synthetic polynucleotide
tgccaagaggatggctgtgttgatcytcaccgacttcatatgcatggcccc

SEQ ID NO: 1038 - DNA, 51 bp, Artificial Sequence
  Synthetic polynucleotide
aaactgaacgtcccccgctttctcaygtgcaacctggcctttgcggatttc

SEQ ID NO: 1039 - DNA, 51 bp, Artificial Sequence
  Synthetic polynucleotide
actgtctttgcaagcgagttatcggygtatacgctgacggtcatcaccctg

SEQ ID NO: 1040 - DNA, 51 bp, Artificial Sequence
  Synthetic polynucleotide
agttgccttcgtcatcgtctgctgcygttatgtgaagatctacatcacagt

SEQ ID NO: 1041 - DNA, 51 bp, Artificial Sequence
  Synthetic polynucleotide
gcggatttctgcatggggatgtaccygctcctcatcgcctctgtagacctc

SEQ ID NO: 1042 - DNA, 51 bp, Artificial Sequence
  Synthetic polynucleotide
cagaaatgtttgcaacacaaggacaytcctgtccccaagggctttctgact

SEQ ID NO: 1043 - DNA, 51 bp, Artificial Sequence
  Synthetic polynucleotide
tccgtggtgttcgtcttccgggtgcyggtatacgtggtggctgcagagcgc

SEQ ID NO: 1044 - DNA, 51 bp, Artificial Sequence
  Synthetic polynucleotide
gatttgctcagagtagctgatacaaytgtagccaaagctgccgaccttaaa

SEQ ID NO: 1045 - DNA, 51 bp, Artificial Sequence
  Synthetic polynucleotide
ctggctctatgagagacttgcacctyaactctgggacctgctggcccagag

SEQ ID NO: 1046 - DNA, 51 bp, Artificial Sequence
  Synthetic polynucleotide
ccgacgctgctttgaggcccggatcygtgcttgcccaggaagagacaggaa

SEQ ID NO: 1047 - DNA, 51 bp, Artificial Sequence
  Synthetic polynucleotide
cctccgtatcccacagattgcagcaytgtcaggtgagtccacagcatgtgc

SEQ ID NO: 1048 - DNA, 51 bp, Artificial Sequence
  Synthetic polynucleotide
caccatctatcagattgagcattacbccatggatgtaagtaactgttagac

SEQ ID NO: 1049 - DNA, 51 bp, Artificial Sequence
  Synthetic polynucleotide
catccagtctcaaatgctttctagayggtctgcttctttcacagtaactag

SEQ ID NO: 1050 - DNA, 51 bp, Artificial Sequence
  Synthetic polynucleotide
gcacctctggatgacctgaaagatayggcttctaaaccgaaggagtctcat

SEQ ID NO: 1051 - DNA, 51 bp, Artificial Sequence
  Synthetic polynucleotide
acaggaacagtcacagtgcaggtgcyggaagccatccccaccagcggcctc

SEQ ID NO: 1052 - DNA, 51 bp, Artificial Sequence
  Synthetic polynucleotide
aatcagctaagtgtagccacattacygtttgagggggatcgtgagaaggtt

SEQ ID NO: 1053 - DNA, 51 bp, Artificial Sequence
  Synthetic polynucleotide
gggagagtttggggtgtacctggtgyctgatggcagcagccgcccttatcg

SEQ ID NO: 1054 - DNA, 51 bp, Artificial Sequence
  Synthetic polynucleotide
ccagtggtttggcgatggcaagttcyccgaggtgagtccggggaagggcaa

SEQ ID NO: 1055 - DNA, 51 bp, Artificial Sequence
  Synthetic polynucleotide
caaatatatgccctctgcaaccaatyttatacacctgcagctactggactc

SEQ ID NO: 1056 - DNA, 51 bp, Artificial Sequence
  Synthetic polynucleotide
aatgatgaggccacagtgtctgttcytggggagcttgcagcagaaatgaat

SEQ ID NO: 1057 - DNA, 51 bp, Artificial Sequence
  Synthetic polynucleotide
acagaatcttgctgctgagaaaacayacaataacctagatatcacggtgac

SEQ ID NO: 1058 - DNA, 51 bp, Artificial Sequence
  Synthetic polynucleotide
tagtattgtgggtattatttccctgycggacattctgcaagccctgatcct

SEQ ID NO: 1059 - DNA, 51 bp, Artificial Sequence
  Synthetic polynucleotide
ttcaagctgttccgggccctgggccygcggcacctggtggtggtggacaac

SEQ ID NO: 1060 - DNA, 51 bp, Artificial Sequence
  Synthetic polynucleotide
ggcaggacagagcttggagctgccgygcgtggcccgagggggtaatccctt

SEQ ID NO: 1061 - DNA, 51 bp, Artificial Sequence
  Synthetic polynucleotide
ctttcagctttaacctttgctgggcyttgctatttcaactatcacgatgtg

SEQ ID NO: 1062 - DNA, 51 bp, Artificial Sequence
  Synthetic polynucleotide
taatggcctggcccaggggctgggcyggcccccatgtgggaaggtcctgcg

SEQ ID NO: 1063 - DNA, 51 bp, Artificial Sequence
  Synthetic polynucleotide
ggaagggcgctaccttgagatagagytctgcttgaaacataggagctgccc

SEQ ID NO: 1064 - DNA, 51 bp, Artificial Sequence
  Synthetic polynucleotide
gggcgtgaggatcaatgacagacagbgcaccggcatcgagggggaagattt

SEQ ID NO: 1065 - DNA, 51 bp, Artificial Sequence
  Synthetic polynucleotide
cctgggaccagcttcgagtttgcgcytgcaattgttgaagccctgaatggc

SEQ ID NO: 1066 - DNA, 51 bp, Artificial Sequence
  Synthetic polynucleotide
gctcgcctggaccacaagtttgaccygatgtatgccaaacgtgcctttgtt

SEQ ID NO: 1067 - DNA, 51 bp, Artificial Sequence
  Synthetic polynucleotide
ctcaagatccccggcgtgggctcgcygagccaaagcaccatctgcaggttc

SEQ ID NO: 1068 - DNA, 51 bp, Artificial Sequence
  Synthetic polynucleotide
tggtgaagatgaaaatattctcttcyctccattgagtattgctcttgcaat

SEQ ID NO: 1069 - DNA, 51 bp, Artificial Sequence
  Synthetic polynucleotide
ttcgtgcgcggccgcgagcagctacyggagcgcgtgcggcgcaaggtgggg

SEQ ID NO: 1070 - DNA, 51 bp, Artificial Sequence
  Synthetic polynucleotide
aatagcaacagtggcccaaatgagaytggaaattttggccgtggaggtaag

SEQ ID NO: 1071 - DNA, 51 bp, Artificial Sequence
  Synthetic polynucleotide
actttgcaacagtggaggaaagcctytggagtgataccacaggtgagcaaa

SEQ ID NO: 1072 - DNA, 51 bp, Artificial Sequence
  Synthetic polynucleotide
tggatcagggaagagtactttgttaycagcttttttgagactactgaacac

SEQ ID NO: 1073 - DNA, 51 bp, Artificial Sequence
  Synthetic polynucleotide
acaagcttaaaaggactatggacacbtcgtgccttcggacggcagccttac

SEQ ID NO: 1074 - DNA, 51 bp, Artificial Sequence
  Synthetic polynucleotide
tgtctgccattcttaaaaacaaaaaygttgttatttttatttcagatgcga

SEQ ID NO: 1075 - DNA, 51 bp, Artificial Sequence
  Synthetic polynucleotide
ttttggagaaacacaagttttccttyggatgctgataaaattttgttacgt

SEQ ID NO: 1076 - DNA, 51 bp, Artificial Sequence
  Synthetic polynucleotide
gaggagattgaaaaagacttaattgygagttttagccttaataactttttc

SEQ ID NO: 1077 - DNA, 51 bp, Artificial Sequence
  Synthetic polynucleotide
accctatgcctttgctacaaggaaaytgaagaaaaagaatttacagaatgg

SEQ ID NO: 1078 - DNA, 51 bp, Artificial Sequence
  Synthetic polynucleotide
cgcagcacggagtctcggcgtcccayggcgcaacctacggcctcggcccag

SEQ ID NO: 1079 - DNA, 51 bp, Artificial Sequence
  Synthetic polynucleotide
ggtcacccaggcctcagtcaagaacytccagattgtccacgctgatgaccg

SEQ ID NO: 1080 - DNA, 51 bp, Artificial Sequence
  Synthetic polynucleotide
ctcctggggaaccgcttcacggtctytgacaacgggcagaacccacagcgt

SEQ ID NO: 1081 - DNA, 51 bp, Artificial Sequence
  Synthetic polynucleotide
tcttacggcaaggtgaaggaggtgcyggactcggagacgctgtgcaggagg

SEQ ID NO: 1082 - DNA, 51 bp, Artificial Sequence
  Synthetic polynucleotide
tggcttccgctacatcagtgaggaaygtccactggccattgtgcttcttat

SEQ ID NO: 1083 - DNA, 51 bp, Artificial Sequence
  Synthetic polynucleotide
tctgtaggccgactgctcgagctgcytaccaagctgggccgcgacgacgtg

SEQ ID NO: 1084 - DNA, 51 bp, Artificial Sequence
  Synthetic polynucleotide
ccatctgttgtcctgctggatgaccytgacctcattgctggactgcctgct

SEQ ID NO: 1085 - DNA, 51 bp, Artificial Sequence
  Synthetic polynucleotide
ggagcggccccagactcgtaaattayggccgcatctccgcacactctctcc

SEQ ID NO: 1086 - DNA, 51 bp, Artificial Sequence
  Synthetic polynucleotide
tgtcagcagcgaatcctctgacagcyccgaggaactttctcccacggccaa

SEQ ID NO: 1087 - DNA, 51 bp, Artificial Sequence
  Synthetic polynucleotide
caaatttgacagccaggaagatctgyggaccaaaatcattctggctcggga

SEQ ID NO: 1088 - DNA, 51 bp, Artificial Sequence
  Synthetic polynucleotide
ctgtggggttgcgtgcccggggagcygccctcgccagggaaggtgcgcagc

SEQ ID NO: 1089 - DNA, 51 bp, Artificial Sequence
  Synthetic polynucleotide
cgggtacttcatgcccatctttgtcyatggtgagtctggggtcctgaggtt

SEQ ID NO: 1090 - DNA, 51 bp, Artificial Sequence
  Synthetic polynucleotide
tgtggggcctcgggtcagttcgagtyggagatcctgtccatgcagaacgtg

SEQ ID NO: 1091 - DNA, 51 bp, Artificial Sequence
  Synthetic polynucleotide
acttgctccttttcaattgagagaaycttaggactggaccagaagaaagac

SEQ ID NO: 1092 - DNA, 51 bp, Artificial Sequence
  Synthetic polynucleotide
tcattattgggtgaaaaaacttcccdcctggttttgagtaaaagcagttct

SEQ ID NO: 1093 - DNA, 51 bp, Artificial Sequence
  Synthetic polynucleotide
cttgatggccaaacaacaggacttayacctgcgaattatgtcaaaattctt

SEQ ID NO: 1094 - DNA, 51 bp, Artificial Sequence
  Synthetic polynucleotide
aatgggatgttaaacgtgtcccctaytggaagaagctgcagccaagaagaa

SEQ ID NO: 1095 - DNA, 51 bp, Artificial Sequence
  Synthetic polynucleotide
aggcagaagatcaaaatcggagtggyaggcggatcggactttgagaaagtg

SEQ ID NO: 1096 - DNA, 51 bp, Artificial Sequence
  Synthetic polynucleotide
cgccttctcctctctgtccccagcaygggcaccagcctcagcccgaacgac

SEQ ID NO: 1097 - DNA, 51 bp, Artificial Sequence
  Synthetic polynucleotide
aaagactcgcttcccaaaactgaaayggtgagtgggtcatacagaatgggt

SEQ ID NO: 1098 - DNA, 51 bp, Artificial Sequence
  Synthetic polynucleotide
ggttcagaatgttgcaaatacaaaaytgacaacccggaagaaaaggcattg

SEQ ID NO: 1099 - DNA, 51 bp, Artificial Sequence
  Synthetic polynucleotide
tgacaatcatgttgcagcaattcacbgtaaagctggaaagggacgaactgg

SEQ ID NO: 1100 - DNA, 51 bp, Artificial Sequence
  Synthetic polynucleotide
aaaaaccattacaagatatacaatcygtaagtatgttttcttatttgtatg

SEQ ID NO: 1101 - DNA, 51 bp, Artificial Sequence
  Synthetic polynucleotide
ttttgtgaagatcttgaccaatggcyaagtgaagatgacaatcatgttgca

SEQ ID NO: 1102 - DNA, 51 bp, Artificial Sequence
  Synthetic polynucleotide
cgacgggaagacaagttcatgtactytgagttccctcagccgttacctgtg

SEQ ID NO: 1103 - DNA, 51 bp, Artificial Sequence
  Synthetic polynucleotide
ttggcccacgccgtcctggccaagchgaacgccttcaaggcagacactccc

SEQ ID NO: 1104 - DNA, 51 bp, Artificial Sequence
  Synthetic polynucleotide
aaccgggaaggagtctacacagtctytgctcccacaaatgaagccttccga

SEQ ID NO: 1105 - DNA, 51 bp, Artificial Sequence
  Synthetic polynucleotide
cagctcacccaacgtgccctctctcyactggaggaaaacatgttctgggcc

SEQ ID NO: 1106 - DNA, 51 bp, Artificial Sequence
  Synthetic polynucleotide
ggaaataaaactgacatcttaaggcyacatgaactaaccaaggtaagggaa

SEQ ID NO: 1107 - DNA, 51 bp, Artificial Sequence
  Synthetic polynucleotide
ctttgttaacacagccatccttgaaycaattgaaaaagaagaaaacatggg

SEQ ID NO: 1108 - DNA, 51 bp, Artificial Sequence
  Synthetic polynucleotide
ctttctggatcagaaaaagaaactaygcaaaatcttaatgatagattagct

SEQ ID NO: 1109 - DNA, 51 bp, Artificial Sequence
  Synthetic polynucleotide
gttgacactggccctgaaagcactcycgctcattcactcccggtgaggctc

SEQ ID NO: 1110 - DNA, 51 bp, Artificial Sequence
  Synthetic polynucleotide
tgccttcatcatctgtggcaccttgyacaccgtcagcagctacacctcagc

SEQ ID NO: 1111 - DNA, 51 bp, Artificial Sequence
  Synthetic polynucleotide
gtcagtcgccaatgccttcatcatcygtggcaccttgtacaccgtcagcag

SEQ ID NO: 1112 - DNA, 51 bp, Artificial Sequence
  Synthetic polynucleotide
gattattcccctttaatccgtgttaytggaagagttttttctagtgctgag

SEQ ID NO: 1113 - DNA, 51 bp, Artificial Sequence
  Synthetic polynucleotide
tcgctgaacgaggcgttcgccgcgcygcggaagatcatccccacgctgccc

SEQ ID NO: 1114 - DNA, 51 bp, Artificial Sequence
  Synthetic polynucleotide
tccttcttgcagggcatggagggaaycaaagtgtttctccatgaaagagaa

SEQ ID NO: 1115 - DNA, 51 bp, Artificial Sequence
  Synthetic polynucleotide
gactgctcgacacccccgaacccgcbacagcccaggttgggatgccaagct

SEQ ID NO: 1116 - DNA, 51 bp, Artificial Sequence
  Synthetic polynucleotide
gtcactgagacagtgcgcagggcacytgtgatcaacatgcgaggtgagaca

SEQ ID NO: 1117 - DNA, 51 bp, Artificial Sequence
  Synthetic polynucleotide
atggaccccgtggcccggcgcctgcyttgggacaccgtggcacgagcccga

SEQ ID NO: 1118 - DNA, 51 bp, Artificial Sequence
  Synthetic polynucleotide
atcgccgcctccttcatgaccctgcycttctgtgtcaaggtgagcatggcg

SEQ ID NO: 1119 - DNA, 51 bp, Artificial Sequence
  Synthetic polynucleotide
ctgcctctccccagagtcctgcctcygccccctggagatgaatgtggccca

SEQ ID NO: 1120 - DNA, 51 bp, Artificial Sequence
  Synthetic polynucleotide
accaagcagcagatcgagaaggggcyccagctgtaccagtccaaccagaca

SEQ ID NO: 1121 - DNA, 51 bp, Artificial Sequence
  Synthetic polynucleotide
atcatgaccgagatcggaaaccgccyggggcaggtgcaggcgctgctgggt

SEQ ID NO: 1122 - DNA, 51 bp, Artificial Sequence
  Synthetic polynucleotide
aatgccttcctgggcctcagcgtctyccagaaggccctggagagcttcgag

SEQ ID NO: 1123 - DNA, 51 bp, Artificial Sequence
  Synthetic polynucleotide
ctcctccgcgttccagaatccaagayggcgggatccaggcaaaggggtctc

SEQ ID NO: 1124 - DNA, 51 bp, Artificial Sequence
  Synthetic polynucleotide
cagcggcaagcttctggcttcctgtyctgcagatatgaccattaaactatg

SEQ ID NO: 1125 - DNA, 51 bp, Artificial Sequence
  Synthetic polynucleotide
ggctatgaagaggcatattcagtttytaaaaaggaagctgaattagatgtg

SEQ ID NO: 1126 - DNA, 51 bp, Artificial Sequence
  Synthetic polynucleotide
cagttggaacagctggagtcagcctytgggaggaaccagtaccccgacatc

SEQ ID NO: 1127 - DNA, 51 bp, Artificial Sequence
  Synthetic polynucleotide
gaactttttacccctgaatgcaagtytaaagaatctgtttttgaaaattat

SEQ ID NO: 1128 - DNA, 51 bp, Artificial Sequence
  Synthetic polynucleotide
gtggctggagggtaacccctgggacygtggctgccctctcaaggcgctgcg

SEQ ID NO: 1129 - DNA, 51 bp, Artificial Sequence
  Synthetic polynucleotide
cccttgcctgttccgtccctagactycttctcggattctcctcctgaccaa

SEQ ID NO: 1130 - DNA, 51 bp, Artificial Sequence
  Synthetic polynucleotide
gcactgggccccagagctaggagtcyttgcagactttgggaaccacacaaa

SEQ ID NO: 1131 - DNA, 51 bp, Artificial Sequence
  Synthetic polynucleotide
tacgtgcccaccaacggctcagcctyggtgctccaggtggactctggtgcc

SEQ ID NO: 1132 - DNA, 51 bp, Artificial Sequence
  Synthetic polynucleotide
agcccagctacgccggacaatagaaygttgtcggaccaatttatgtaacca

SEQ ID NO: 1133 - DNA, 51 bp, Artificial Sequence
  Synthetic polynucleotide
ccgagtgatccgtcatacgaagataygcgtgaggttgtgtgtgtcaaacgt

SEQ ID NO: 1134 - DNA, 51 bp, Artificial Sequence
  Synthetic polynucleotide
gtggcgggttactccctggggtttcytctggctagaattgctggtctaccc

SEQ ID NO: 1135 - DNA, 51 bp, Artificial Sequence
  Synthetic polynucleotide
caactcgccgtacatcgtgggcttcyacggggccttctacagtgacgggga

SEQ ID NO: 1136 - DNA, 51 bp, Artificial Sequence
  Synthetic polynucleotide
ctgctgggcgtcccactggccctgchctggggcttcctgttcgcctgcatc

SEQ ID NO: 1137 - DNA, 51 bp, Artificial Sequence
  Synthetic polynucleotide
ccggagaacttcaatgaagccaagthcatcaccttcagcatgctcatcttc

SEQ ID NO: 1138 - DNA, 51 bp, Artificial Sequence
  Synthetic polynucleotide
aattgattctttgaaccttgatgagytctgcaactgctcagagcacattcc

SEQ ID NO: 1139 - DNA, 51 bp, Artificial Sequence
  Synthetic polynucleotide
gagtttctgtcgtggacggagccctytgggatcgcactcaccctctttgcc

SEQ ID NO: 1140 - DNA, 51 bp, Artificial Sequence
  Synthetic polynucleotide
gcgttgcagcaccgcagctcacgctytcaaggtggctgcccgggccacgct

SEQ ID NO: 1141 - DNA, 51 bp, Artificial Sequence
  Synthetic polynucleotide
caaaacaaaattgattctttgaaccytgatgagttctgcaactgctcagag

SEQ ID NO: 1142 - DNA, 51 bp, Artificial Sequence
  Synthetic polynucleotide
cacctgcctgctggctgccatctgcytcttctttgccttcaagtcccggaa

SEQ ID NO: 1143 - DNA, 51 bp, Artificial Sequence
  Synthetic polynucleotide
agctgctgctgggtcctcttggcacycacctggcacacctctgcctacggg

SEQ ID NO: 1144 - DNA, 51 bp, Artificial Sequence
  Synthetic polynucleotide
ctggcatattccaggtgcatccaggygcgggcgtcatgctgggcttgggtc

SEQ ID NO: 1145 - DNA, 51 bp, Artificial Sequence
  Synthetic polynucleotide
ttcaccagatcccagcgcaagaaccygttcgcagagatgcgcgagcagctg

SEQ ID NO: 1146 - DNA, 51 bp, Artificial Sequence
  Synthetic polynucleotide
tgcgagttcccattgcgctcccaccyggagcccacgaatcatgcagtcatc

SEQ ID NO: 1147 - DNA, 51 bp, Artificial Sequence
  Synthetic polynucleotide
tgattcggaagccacagtccgagagygagttgccttctttccatcctaatg

SEQ ID NO: 1148 - DNA, 51 bp, Artificial Sequence
  Synthetic polynucleotide
aactggggaaacaaaggatatatccycatggctcgaaataagaacaacgcc

SEQ ID NO: 1149 - DNA, 51 bp, Artificial Sequence
  Synthetic polynucleotide
atcatcgtcctccacgtcgcggtgcyggtgctgctgttcgtctccacgatc

SEQ ID NO: 1150 - DNA, 51 bp, Artificial Sequence
  Synthetic polynucleotide
atatctatctgattctctctagcaayggatcgtgggcaatggacacgcaac

SEQ ID NO: 1151 - DNA, 51 bp, Artificial Sequence
  Synthetic polynucleotide
atctaccagttcatcatggaccgcthccccttctaccgggacaacaagcag

SEQ ID NO: 1152 - DNA, 51 bp, Artificial Sequence
  Synthetic polynucleotide
ccaagacatcaagccttgcgtgatgygaggctgccgccgcaggccctcctg

SEQ ID NO: 1153 - DNA, 51 bp, Artificial Sequence
  Synthetic polynucleotide
ctctttttttctcttagatattcagyctaaaagcagcaaggccgtggtgca

SEQ ID NO: 1154 - DNA, 51 bp, Artificial Sequence
  Synthetic polynucleotide
ctgaatgtgttcttggccatcgctgyggacaatctggccaacgcccaggag

SEQ ID NO: 1155 - DNA, 51 bp, Artificial Sequence
  Synthetic polynucleotide
gggtaccgcatggagatgtccatttyctacgtcgtctactttgtggtgttc

SEQ ID NO: 1156 - DNA, 51 bp, Artificial Sequence
  Synthetic polynucleotide
atgctcttcttcatctatgccatcaytgggatgcaggtgagtgtcgtgtcc

SEQ ID NO: 1157 - DNA, 51 bp, Artificial Sequence
  Synthetic polynucleotide
cagagctggcagaggttctaccaacygaccaagctgctggactccatgcat

SEQ ID NO: 1158 - DNA, 51 bp, Artificial Sequence
  Synthetic polynucleotide
gtggagtcggggaacgccaagccgcyctacttccaccggaagtgactgccc

SEQ ID NO: 1159 - DNA, 51 bp, Artificial Sequence
  Synthetic polynucleotide
ctcaccctcctcattccctatctccytggccgcaagaggaggtggagcaaa

SEQ ID NO: 1160 - DNA, 51 bp, Artificial Sequence
  Synthetic polynucleotide
ctggggtgcctgcgaggggctggccygcagctatggctggaacttcaccga

SEQ ID NO: 1161 - DNA, 51 bp, Artificial Sequence
  Synthetic polynucleotide
tcggtacaggctggctcctacaaccyggccctcagctactcggtgggcctc

SEQ ID NO: 1162 - DNA, 51 bp, Artificial Sequence
  Synthetic polynucleotide
tctgctggggaaaacagctgttactytaattcatcgtttacctccatctgg

SEQ ID NO: 1163 - DNA, 51 bp, Artificial Sequence
  Synthetic polynucleotide
agtttaactgggattcatgcagatayccaagtgagatgggaagcaccacgc

SEQ ID NO: 1164 - DNA, 51 bp, Artificial Sequence
  Synthetic polynucleotide
actgaggagtgcccactggccatccygatcctcatcgtgcagaacatcgtg

SEQ ID NO: 1165 - DNA, 51 bp, Artificial Sequence
  Synthetic polynucleotide
ccgctttgtgtccaagaaaggcaacygcaacgtggcccacaagaacatccg

SEQ ID NO: 1166 - DNA, 51 bp, Artificial Sequence
  Synthetic polynucleotide
accgtggtcgtgctgggcggaggcaycagcggcttggccgccagttaccac

SEQ ID NO: 1167 - DNA, 51 bp, Artificial Sequence
  Synthetic polynucleotide
aaagaatcaaaggccttgatgggacyctaccatggtcaggtcctgtgcaag

SEQ ID NO: 1168 - DNA, 51 bp, Artificial Sequence
  Synthetic polynucleotide
ctggcagtggcctgcaggaaggctcytgacagcacgacagtcgcggctcat

SEQ ID NO: 1169 - DNA, 51 bp, Artificial Sequence
  Synthetic polynucleotide
tttctgctgttgtagcacagatttahgtaatgtcaactttactgagaattt

SEQ ID NO: 1170 - DNA, 51 bp, Artificial Sequence
  Synthetic polynucleotide
catcccaggcaccccgccccccaacyatgactccctgcgtctgcagccgct

SEQ ID NO: 1171 - DNA, 51 bp, Artificial Sequence
  Synthetic polynucleotide
tcaaaggcccacgtgcattgctccgycaagtccggtgagccgccgccgggg

SEQ ID NO: 1172 - DNA, 51 bp, Artificial Sequence
  Synthetic polynucleotide
tttggccatctcggtgatgaaccagbggccaggagtgaaactgcgggtgac

SEQ ID NO: 1173 - DNA, 51 bp, Artificial Sequence
  Synthetic polynucleotide
gaccgccggctcctgcccgccgctgygcacagcgtgaccctaagcgaggag

SEQ ID NO: 1174 - DNA, 51 bp, Artificial Sequence
  Synthetic polynucleotide
aaaattatagggatcatggaagaagbtgctgatggttttaagtctaaaatc

SEQ ID NO: 1175 - DNA, 51 bp, Artificial Sequence
  Synthetic polynucleotide
aaccctcactattgactgcgtccagyttcagagaggaggcaaagaattcct

SEQ ID NO: 1176 - DNA, 51 bp, Artificial Sequence
  Synthetic polynucleotide
ggaactggatatatcaagactgagtygatttctgtgtctgaagtgtaagtg

SEQ ID NO: 1177 - DNA, 51 bp, Artificial Sequence
  Synthetic polynucleotide
aaggaccagcagccggggaccttccygctgcggttcagtgagagctcccgg

SEQ ID NO: 1178 - DNA, 51 bp, Artificial Sequence
  Synthetic polynucleotide
agggacagcaacatttactgtatctyctatgaaggtgggagaaaagaaaga

SEQ ID NO: 1179 - DNA, 51 bp, Artificial Sequence
  Synthetic polynucleotide
ctatcacaacatcgagacttccaacbtccccaagctgctaattggtaggtg

SEQ ID NO: 1180 - DNA, 51 bp, Artificial Sequence
  Synthetic polynucleotide
gctgggcagggagctcgcttccctgytccgggctggccgggagccccaggg

SEQ ID NO: 1181 - DNA, 51 bp, Artificial Sequence
  Synthetic polynucleotide
aacatctttctcattataaaggcacrtggcacagtgaggggtctccacttc

SEQ ID NO: 1182 - DNA, 51 bp, Artificial Sequence
  Synthetic polynucleotide
aacccaccctgtcatccaggacaacygcccgctggtgcggaacccagacca

SEQ ID NO: 1183 - DNA, 51 bp, Artificial Sequence
  Synthetic polynucleotide
ggacgaggacaagtggggcgatgcgygcgacaactgccggtcccagaagaa

SEQ ID NO: 1184 - DNA, 51 bp, Artificial Sequence
  Synthetic polynucleotide
atcctggagatcgattgcaccatgcycacccctgagccagttttaaagtga

SEQ ID NO: 1185 - DNA, 51 bp, Artificial Sequence
  Synthetic polynucleotide
cctcgaccgcataggccagttcaccygtatctgtatggcaggtgggtggtg

SEQ ID NO: 1186 - DNA, 51 bp, Artificial Sequence
  Synthetic polynucleotide
ctgctacggtggtactgcctccctcytcaatgctgccaactggatggagtc

SEQ ID NO: 1187 - DNA, 51 bp, Artificial Sequence
  Synthetic polynucleotide
ccagctctctgctggttactcacgayggccctcggtgacatcccaggtaga

SEQ ID NO: 1188 - DNA, 51 bp, Artificial Sequence
  Synthetic polynucleotide
atggtaatgcgaggtgtacagaaaaygaacagcaaaactgtgaccagcaca

SEQ ID NO: 1189 - DNA, 51 bp, Artificial Sequence
  Synthetic polynucleotide
cgcgtctttccacagccaggcagtcygtatcttgcaaaaacatccactctg

SEQ ID NO: 1190 - DNA, 51 bp, Artificial Sequence
  Synthetic polynucleotide
ggagacagggtttggctgaagaaatycccaggggatcagcacatagctatc

SEQ ID NO: 1191 - DNA, 51 bp, Artificial Sequence
  Synthetic polynucleotide
aatgggcagcgacacgcggcagagaycgccaacatgtcactggacatcctc

SEQ ID NO: 1192 - DNA, 51 bp, Artificial Sequence
  Synthetic polynucleotide
ctgtcacgatttgagggcatgagggyaagagaggtggctgccttcccacca

SEQ ID NO: 1193 - DNA, 51 bp, Artificial Sequence
  Synthetic polynucleotide
gagtgaggacgacttcgatatgttcyatgagatctgggagaaatttgaccc

SEQ ID NO: 1194 - DNA, 51 bp, Artificial Sequence
  Synthetic polynucleotide
cccggagagcttcagctgctcaacgycacctctgccttggaccgtgggggc

SEQ ID NO: 1195 - DNA, 51 bp, Artificial Sequence
  Synthetic polynucleotide
aggctccgagaaatgcagtctttctycggcttagaggtgactggcaaactt

SEQ ID NO: 1196 - DNA, 51 bp, Artificial Sequence
  Synthetic polynucleotide
gagaggctccgagaaatgcagtcttycttcggcttagaggtgactggcaaa

SEQ ID NO: 1197 - DNA, 51 bp, Artificial Sequence
  Synthetic polynucleotide
cttgacgataacaccttagatgtcaygaaaaagccaagatgcggggttcct

SEQ ID NO: 1198 - DNA, 51 bp, Artificial Sequence
  Synthetic polynucleotide
ctccttttgtatgactaggtacctgyactgggctgactgggatacacatgc

SEQ ID NO: 1199 - DNA, 51 bp, Artificial Sequence
  Synthetic polynucleotide
gatgacctcaggaatgtcaagaagcyaggtggcgacctgctccgggccctc

SEQ ID NO: 1200 - DNA, 51 bp, Artificial Sequence
  Synthetic polynucleotide
gtactatctgatggacctctcctacyccatgcttgatgacctcaggaatgt

SEQ ID NO: 1201 - DNA, 51 bp, Artificial Sequence
  Synthetic polynucleotide
caaaatcaagaagatgctgcctgtgygtcccccaggggcaggggggctgcc

SEQ ID NO: 1202 - DNA, 51 bp, Artificial Sequence
  Synthetic polynucleotide
ttgactgggagagaacacgtggagtyctttgcccttttgagaggagtccca

SEQ ID NO: 1203 - DNA, 51 bp, Artificial Sequence
  Synthetic polynucleotide
aacaaagccaaagcacacatcaaggygagaatttttactttcagatttgca

SEQ ID NO: 1204 - DNA, 51 bp, Artificial Sequence
  Synthetic polynucleotide
gtctttagatttacagtccaatgctycactcagccattttacctcaccccc

SEQ ID NO: 1205 - DNA, 51 bp, Artificial Sequence
  Synthetic polynucleotide
ccaaccccatggcctccatgactttytcaaaaaggtattagaaaaaccatt

SEQ ID NO: 1206 - DNA, 51 bp, Artificial Sequence
  Synthetic polynucleotide
agccaaccccatggcctccatgactytttcaaaaaggtattagaaaaacca

SEQ ID NO: 1207 - DNA, 51 bp, Artificial Sequence
  Synthetic polynucleotide
gccaaccccatggcctccatgacttyttcaaaaaggtattagaaaaaccat

SEQ ID NO: 1208 - DNA, 51 bp, Artificial Sequence
  Synthetic polynucleotide
cctcctcaaagcaatacactgaaaabgtttagacgggctcacatcacccca

SEQ ID NO: 1209 - DNA, 51 bp, Artificial Sequence
  Synthetic polynucleotide
tatcacaccccatcctaaagtaaggycagctaaataagctatcgggcccat

SEQ ID NO: 1210 - DNA, 51 bp, Artificial Sequence
  Synthetic polynucleotide
aaagattaagagaaccaacacctctytacagtgaaatgccccaactaaata

SEQ ID NO: 1211 - DNA, 51 bp, Artificial Sequence
  Synthetic polynucleotide
aaaggataacagctatccattggtcytaggccccaaaaattttggtgcaac

SEQ ID NO: 1212 - DNA, 51 bp, Artificial Sequence
  Synthetic polynucleotide
ccggtaatcgcataaaacttaaaacyttacagtcagaggttcaattcctct

SEQ ID NO: 1213 - DNA, 51 bp, Artificial Sequence
  Synthetic polynucleotide
ggtttgttaagatggcagagcccggyaatcgcataaaacttaaaactttac

SEQ ID NO: 1214 - DNA, 51 bp, Artificial Sequence
  Synthetic polynucleotide
taaaactttacagtcagaggttcaaytcctcttcttaacaacatacccatg

SEQ ID NO: 1215 - DNA, 51 bp, Artificial Sequence
  Synthetic polynucleotide
aaatatgtctgataaaagagttactytgatagagtaaataataggagctta

SEQ ID NO: 1216 - DNA, 51 bp, Artificial Sequence
  Synthetic polynucleotide
aatatgtctgataaaagagttacttygatagagtaaataataggagcttaa

SEQ ID NO: 1217 - DNA, 51 bp, Artificial Sequence
  Synthetic polynucleotide
atctattgatgagggtcttactcttytagtataaatagtaccgttaacttc

SEQ ID NO: 1218 - DNA, 51 bp, Artificial Sequence
  Synthetic polynucleotide
ggtcttactcttttagtataaatagyaccgttaacttccaattaactagtt

SEQ ID NO: 1219 - DNA, 51 bp, Artificial Sequence
  Synthetic polynucleotide
gcttaaacccccttatttctaggacyatgagaatcgaacccatccctgaga

SEQ ID NO: 1220 - DNA, 51 bp, Artificial Sequence
  Synthetic polynucleotide
cggactacaaccacgaccaatgataygaaaaaccatcgttgtatttcaact

SEQ ID NO: 1221 - DNA, 51 bp, Artificial Sequence
  Synthetic polynucleotide
tcaacagaaacaaagcatacatcatbattctcgcacggactacaaccacga

SEQ ID NO: 1222 - DNA, 51 bp, Artificial Sequence
  Synthetic polynucleotide
gggacttaaacccacaaacacttagytaacagctaagcaccctaatcaact

SEQ ID NO: 1223 - DNA, 51 bp, Artificial Sequence
  Synthetic polynucleotide
gcaccctaatcaactggcttcaatcyacttctcccgccgccgggaaaaaag

SEQ ID NO: 1224 - DNA, 51 bp, Artificial Sequence
  Synthetic polynucleotide
tcaacaatagggtttacgacctcgaygttggatcaggacatcccgatggtg

SEQ ID NO: 1225 - DNA, 51 bp, Artificial Sequence
  Synthetic polynucleotide
atcttcagcaaaccctgatgaaggcyacaaagtaagcgcaagtacccacgt

SEQ ID NO: 1226 - DNA, 51 bp, Artificial Sequence
  Synthetic polynucleotide
ctgggattagataccccactatgctyagccctaaacctcaacagttaaatc

SEQ ID NO: 1227 - DNA, 51 bp, Artificial Sequence
  Synthetic polynucleotide
ttataacaaaccctgagaaccaaaaygaacgaaaatctgttcgcttcattc

SEQ ID NO: 1228 - DNA, 51 bp, Artificial Sequence
  Synthetic polynucleotide
agcctactcattcaaccaatagcccbggccgtacgcctaaccgctaacatt

SEQ ID NO: 1229 - DNA, 51 bp, Artificial Sequence
  Synthetic polynucleotide
attaaccttccctctacacttatcaycttcacaattctaattctactgact

SEQ ID NO: 1230 - DNA, 51 bp, Artificial Sequence
  Synthetic polynucleotide
atccaagcctacgttttcacacttcbagtaagcctctacctgcacgacaac

SEQ ID NO: 1231 - DNA, 51 bp, Artificial Sequence
  Synthetic polynucleotide
aaacctagccatggccatccccttaygagcgggcacagtgattataggctt

SEQ ID NO: 1232 - DNA, 51 bp, Artificial Sequence
  Synthetic polynucleotide
tacgttttcacacttctagtaagccyctacctgcacgacaacacataatga

SEQ ID NO: 1233 - DNA, 51 bp, Artificial Sequence
  Synthetic polynucleotide
ataggctaaatcctatatatcttaayggcacatgcagcgcaagtaggtcta

SEQ ID NO: 1234 - DNA, 51 bp, Artificial Sequence
  Synthetic polynucleotide
ggtatggtctgagctatgatatcaaytggcttcctagggtttatcgtgtga

SEQ ID NO: 1235 - DNA, 51 bp, Artificial Sequence
  Synthetic polynucleotide
aaagaaccatttggatacataggtayggtctgagctatgatatcaattggc

SEQ ID NO: 1236 - DNA, 51 bp, Artificial Sequence
  Synthetic polynucleotide
catgaaacatcctatcatctgtaggytcattcatttctctaacagcagtaa

SEQ ID NO: 1237 - DNA, 51 bp, Artificial Sequence
  Synthetic polynucleotide
catcaagcccgaatgatatttcctaytcgcctacacaattctccgatccgt

SEQ ID NO: 1238 - DNA, 51 bp, Artificial Sequence
  Synthetic polynucleotide
ggccacagtaattacaaacttactayccgccatcccatacattgggacaga

SEQ ID NO: 1239 - DNA, 51 bp, Artificial Sequence
  Synthetic polynucleotide
catctccgcatgatgaaacttcggcycactccttggcgcctgcctgatcct

SEQ ID NO: 1240 - DNA, 51 bp, Artificial Sequence
  Synthetic polynucleotide
gctgtagtatatccaaagacaaccaycattccccctaaataaattaaaaaa

SEQ ID NO: 1241 - DNA, 51 bp, Artificial Sequence
  Synthetic polynucleotide
gtagtatatccaaagacaaccatcaytccccctaaataaattaaaaaaact

SEQ ID NO: 1242 - DNA, 51 bp, Artificial Sequence
  Synthetic polynucleotide
atcagttcttcaaatatctactcatyttcctaattaccatactaatcttag

SEQ ID NO: 1243 - DNA, 51 bp, Artificial Sequence
  Synthetic polynucleotide
ctcacacctcatatcctccctactaygcctagaaggaataatactatcgct

SEQ ID NO: 1244 - DNA, 51 bp, Artificial Sequence
  Synthetic polynucleotide
  misc_feature (50)..(50): n is a, c, g, t or u
atattgtgcctattgccatactagtytttgccgcctgcgaagcagcggtng

SEQ ID NO: 1245 - DNA, 51 bp, Artificial Sequence
  Synthetic polynucleotide
ttacgagtgcggcttcgaccctataycccccgcccgcgtccctttctccat

SEQ ID NO: 1246 - DNA, 51 bp, Artificial Sequence
  Synthetic polynucleotide
acaactcaacggctacatagaaaaayccaccccttacgagtgcggcttcga

SEQ ID NO: 1247 - DNA, 51 bp, Artificial Sequence
  Synthetic polynucleotide
caagcaaccgcatccataatccttcyaatagctatcctcttcaacaatata

SEQ ID NO: 1248 - DNA, 51 bp, Artificial Sequence
  Synthetic polynucleotide
tacccccgattccgctacgaccaacycatacacctcctatgaaaaaacttc

SEQ ID NO: 1249 - DNA, 51 bp, Artificial Sequence
  Synthetic polynucleotide
gcttaccgaacgaaaaattctaggcyatatacaactacgcaaaggccccaa

SEQ ID NO: 1250 - DNA, 51 bp, Artificial Sequence
  Synthetic polynucleotide
ggttcaattcctcttcttaacaacabacccatggccaacctcctactcctc

SEQ ID NO: 1251 - DNA, 51 bp, Artificial Sequence
  Synthetic polynucleotide
actagtctcaggcttcaacatcgaayacgccgcaggccccttcgccctatt

SEQ ID NO: 1252 - DNA, 51 bp, Artificial Sequence
  Synthetic polynucleotide
cttactgaagccgaaaaatggccatycttccaggaggcacagaaattacag

SEQ ID NO: 1253 - DNA, 51 bp, Artificial Sequence
  Synthetic polynucleotide
gtgaagcgacccatgaacgcattcaycgtgtggtctcgcgatcagaggcgc

SEQ ID NO: 1254 - DNA, 51 bp, Artificial Sequence
  Synthetic polynucleotide
  misc_feature (26)..(26): n is a, c, g, t or u
actctatactggtatcaacatgttcngctggtctgctgtacagctgaaaat

SEQ ID NO: 1255 - DNA, 51 bp, Artificial Sequence
  Synthetic polynucleotide
caccagatggaacaatactatcaccyagtggatatggaattgaactgcaca

SEQ ID NO: 1256 - DNA, 51 bp, Artificial Sequence
  Synthetic polynucleotide
tgtcagcccatctttctgaatgtccyggaagccattgagccaggtgtagtg

SEQ ID NO: 1257 - DNA, 51 bp, Artificial Sequence
  Synthetic polynucleotide
atcaccccccaggaattcctgtgcaygaaagcactgctactcttcagcatt

SEQ ID NO: 1258 - DNA, 51 bp, Artificial Sequence
  Synthetic polynucleotide
ctaccagctcaccaagctcctggacyccgtgcagcctgtaagcaaacgatg

SEQ ID NO: 1259 - DNA, 51 bp, Artificial Sequence
  Synthetic polynucleotide
gaagcacgcggaggccctggggctcygacccgccgcgcagccccccgcgcg

SEQ ID NO: 1260 - DNA, 51 bp, Artificial Sequence
  Synthetic polynucleotide
ttgagccgggccttgtttgcagtccrcgaagaataccagcccacatactgc

SEQ ID NO: 1261 - DNA, 51 bp, Artificial Sequence
  Synthetic polynucleotide
atagaaggctttttgttattacttcyctttggctatgaaggtatgtgctat

SEQ ID NO: 1262 - DNA, 51 bp, Artificial Sequence
  Synthetic polynucleotide
ccgagctgaggcaggcatcaggcacrcttgctgacgcactccagcagctcc

SEQ ID NO: 1263 - DNA, 51 bp, Artificial Sequence
  Synthetic polynucleotide
atctcagccaagcttgttgcaaataygctatctgtagcaggtgcagatcat

SEQ ID NO: 1264 - DNA, 51 bp, Artificial Sequence
  Synthetic polynucleotide
aatttgtatgcagagccggctgtccyaaagtggataagggagaatatctct

SEQ ID NO: 1265 - DNA, 51 bp, Artificial Sequence
  Synthetic polynucleotide
tttcctttcttgcctttctaggtgaytgacatctctatgatccttgcagaa

SEQ ID NO: 1266 - DNA, 51 bp, Artificial Sequence
  Synthetic polynucleotide
ccagttgctgtagaactcaaatctcygctgggcaagtaagtgccaggctct

SEQ ID NO: 1267 - DNA, 51 bp, Artificial Sequence
  Synthetic polynucleotide
cacctctacccctcagggcttggacygtggtcctgaaagcagcaagaagta

SEQ ID NO: 1268 - DNA, 51 bp, Artificial Sequence
  Synthetic polynucleotide
catcattttggctcccctgtgtagaytggcacttctctgtttgatgaagag

SEQ ID NO: 1269 - DNA, 51 bp, Artificial Sequence
  Synthetic polynucleotide
cattgcaaataacaatctcagctacygggatgcccccctgggaagttctta

SEQ ID NO: 1270 - DNA, 51 bp, Artificial Sequence
  Synthetic polynucleotide
attctctgaagaaatcacttctggcygtcagttgcaaaaaaaggagatcca

SEQ ID NO: 1271 - DNA, 51 bp, Artificial Sequence
  Synthetic polynucleotide
acacagatgctaaaactgcagaatcygggtaatttggaaagaaagggtcaa

SEQ ID NO: 1272 - DNA, 51 bp, Artificial Sequence
  Synthetic polynucleotide
gaaagggtgtttattcctcatggacyaattatggacaggtaagtaagatct

SEQ ID NO: 1273 - DNA, 51 bp, Artificial Sequence
  Synthetic polynucleotide
cttgctcgagatgtgatgaaggagaygggaggccatcacattgtagccctc

SEQ ID NO: 1274 - DNA, 51 bp, Artificial Sequence
  Synthetic polynucleotide
attcgcagcactcttcgcatggagtygatgggctgtgatttaaatagtaag

SEQ ID NO: 1275 - DNA, 51 bp, Artificial Sequence
  Synthetic polynucleotide
ggaccttggacagtttctactgtttygtcatatctcttcccaccaacatgg

SEQ ID NO: 1276 - DNA, 51 bp, Artificial Sequence
  Synthetic polynucleotide
agagcagaagttgaagataatatcayggtgagttaaggacagtggaattac

SEQ ID NO: 1277 - DNA, 51 bp, Artificial Sequence
  Synthetic polynucleotide
cctttcaatatatgtaattaacagayaatgtcagacaagaggaatgtcatc

SEQ ID NO: 1278 - DNA, 51 bp, Artificial Sequence
  Synthetic polynucleotide
tccttggaaatctcgccaataacttyccttactgctcaaacactcttgatg

SEQ ID NO: 1279 - DNA, 51 bp, Artificial Sequence
  Synthetic polynucleotide
ttgatggaccttggacagtttctacygttttgtcatatctcttcccaccaa

SEQ ID NO: 1280 - DNA, 51 bp, Artificial Sequence
  Synthetic polynucleotide
ctctccttcctttatccaaattcgcycagttgccaagaagcatcctaaaac

SEQ ID NO: 1281 - DNA, 51 bp, Artificial Sequence
  Synthetic polynucleotide
atcaggaatcttgggacctttacttyatggggaagttggagacacactgtt

SEQ ID NO: 1282 - DNA, 51 bp, Artificial Sequence
  Synthetic polynucleotide
aatcaagcaagcagaccatataacayctaccctcacggaatcactgatgtc

SEQ ID NO: 1283 - DNA, 51 bp, Artificial Sequence
  Synthetic polynucleotide
ccctctcctcatctgctacaaagaayctgtagatcaaagaggaaaccaggt

SEQ ID NO: 1284 - DNA, 51 bp, Artificial Sequence
  Synthetic polynucleotide
cagttgtcagtttgtttgcatgaggyggcatactggtacattctaagcatt

SEQ ID NO: 1285 - DNA, 51 bp, Artificial Sequence
  Synthetic polynucleotide
ttctgtcttcttctctggatataccytcaaacacaaaatggtctatgaaga

SEQ ID NO: 1286 - DNA, 51 bp, Artificial Sequence
  Synthetic polynucleotide
gtttctttacttgggcaaaggacagygggccccaaagctggccagacttca

SEQ ID NO: 1287 - DNA, 51 bp, Artificial Sequence
  Synthetic polynucleotide
gtgtacgagaaaatgtggtcttacaygaaatcagcggagccatctgtgttt

SEQ ID NO: 1288 - DNA, 51 bp, Artificial Sequence
  Synthetic polynucleotide
gagggcgaggccaccaaagggtaccyggacgaccccacggtgccccgcggg

SEQ ID NO: 1289 - DNA, 51 bp, Artificial Sequence
  Synthetic polynucleotide
tggagagggcgaggccaccaaagggyacctggacgaccccacggtgccccg

SEQ ID NO: 1290 - DNA, 51 bp, Artificial Sequence
  Synthetic polynucleotide
ggtccacatctcagggacactgtggyggacctatgtcatcagcgtggtgtt

SEQ ID NO: 1291 - DNA, 51 bp, Artificial Sequence
  Synthetic polynucleotide
tcagggacactgtggtggacctatgycatcagcgtggtgttccggctgttg

SEQ ID NO: 1292 - DNA, 51 bp, Artificial Sequence
  Synthetic polynucleotide
tgtgtccgtctggtgtagtaatgatyacctgggcatgagccgacaccctca

SEQ ID NO: 1293 - DNA, 51 bp, Artificial Sequence
  Synthetic polynucleotide
ctggccccacggcctgaagacttcaygcggcccagacgtgttcagcggcag

SEQ ID NO: 1294 - DNA, 51 bp, Artificial Sequence; identical to SEQ ID NO: 1293
  Synthetic polynucleotide

SEQ ID NO: 1295 - DNA, 51 bp, Artificial Sequence
  Synthetic polynucleotide
ggccatcgtgggcattgccttctccyggatctgggctgctgtgtggacagc

SEQ ID NO: 1296 - DNA, 51 bp, Artificial Sequence
  Synthetic polynucleotide
gctgttgtacagtgcctgcttctgghggctgttttgctatgcagtggatgc

SEQ ID NO: 1297 - DNA, 51 bp, Artificial Sequence
  Synthetic polynucleotide
agaatcaccaggcctcatcaccatcygccttttaggatatctactcagtgc

SEQ ID NO: 1298 - DNA, 51 bp, Artificial Sequence
  Synthetic polynucleotide
ttcctcaaatttggatctggctatgyaagtggctggggaagagtcttccac

SEQ ID NO: 1299 - DNA, 51 bp, Artificial Sequence
  Synthetic polynucleotide
agttccacttgttgaccgagccacahgtcttcgatctacaaagttcaccat

SEQ ID NO: 1300 - DNA, 51 bp, Artificial Sequence
  Synthetic polynucleotide
tgtgcaatgaaaggcaaatatggaayatataccaaggtatcccggtatgtc

SEQ ID NO: 1301 - DNA, 51 bp, Artificial Sequence
  Synthetic polynucleotide
taccaaggtatcccggtatgtcaacyggattaaggaaaaaacaaagctcac

SEQ ID NO: 1302 - DNA, 51 bp, Artificial Sequence
  Synthetic polynucleotide
tttaggatatctactcagtgctgaaygtacaggtttgtttccttttttaaa

SEQ ID NO: 1303 - DNA, 51 bp, Artificial Sequence
  Synthetic polynucleotide
ctgaattttggaagcagtatgttggyaagcaattcattttatcctctagct

SEQ ID NO: 1304 - DNA, 51 bp, Artificial Sequence
  Synthetic polynucleotide
attgctgacaaggaatacacgaacaycttcctcaaatttggatctggctat

SEQ ID NO: 1305 - DNA, 51 bp, Artificial Sequence
  Synthetic polynucleotide
cattgatgcccagacctttgctgacyggggagtagatctgctaaaatttga

SEQ ID NO: 1306 - DNA, 51 bp, Artificial Sequence
  Synthetic polynucleotide
ttatttcattctttttctcagttagygattggcaactttggcctcagctgg

SEQ ID NO: 1307 - DNA, 51 bp, Artificial Sequence
  Synthetic polynucleotide
ccaacaaatgccaatctgactctctytgagtgctggagcagttcctctaat

SEQ ID NO: 1308 - DNA, 51 bp, Artificial Sequence
  Synthetic polynucleotide
tatgatgctttgaactccatccaccyctacaccttcgacgtcgcatttgcg

SEQ ID NO: 1309 - DNA, 51 bp, Artificial Sequence
  Synthetic polynucleotide
ttcaaggtgatgaggcttcgcaaacyggctcagcagattgcaaactgcaaa

SEQ ID NO: 1310 - DNA, 51 bp, Artificial Sequence
  Synthetic polynucleotide
cagtatcgggatgccctttacaagtycatggtggatactgccgtgctttta

SEQ ID NO: 1311 - DNA, 51 bp, Artificial Sequence
  Synthetic polynucleotide
ctcataggatttccagcaggagagcyccagaagcctttcttttggggaaca

SEQ ID NO: 1312 - DNA, 51 bp, Artificial Sequence
  Synthetic polynucleotide
agaaagtgaaattcgttattctacayggaagaaagctgtgatgaagtcaat

SEQ ID NO: 1313 - DNA, 51 bp, Artificial Sequence
  Synthetic polynucleotide
aactgctgggcgtccctgctcatgcytgagctggcccaggaccgcttgcag

SEQ ID NO: 1314 - DNA, 51 bp, Artificial Sequence
  Synthetic polynucleotide
cttctgggaggacatccttgttttcytaccacacaagatattcatttgggt

SEQ ID NO: 1315 - DNA, 51 bp, Artificial Sequence
  Synthetic polynucleotide
ctgaagggccgtgaccttctcactcyaaaaaactttaccggagaagaaatt

SEQ ID NO: 1316 - DNA, 51 bp, Artificial Sequence
  Synthetic polynucleotide
ttggcagagcagtatgccaaagaggyatgctctttacatgtaaagctatta

SEQ ID NO: 1317 - DNA, 51 bp, Artificial Sequence
  Synthetic polynucleotide
cctccacctgctgacgttgtgctgcyacctagagttgcgctcggagttgcg

SEQ ID NO: 1318 - DNA, 51 bp, Artificial Sequence
  Synthetic polynucleotide
cattctaaaggcaatttaaaaatcaygtcaagctcagttgaacagaaaaaa

SEQ ID NO: 1319 - DNA, 51 bp, Artificial Sequence
  Synthetic polynucleotide
catcacctatgccctgaccgttgtgyggctcctggtgtttgcctgctctgc

SEQ ID NO: 1320 - DNA, 51 bp, Artificial Sequence
  Synthetic polynucleotide
cctggcaaggtttgtggctccaaccytctgtccatctgcaaaacagctgag

SEQ ID NO: 1321 - DNA, 51 bp, Artificial Sequence
  Synthetic polynucleotide
aacacctggaccacctgccagtctaytgccttccccagcaagacctctgcc

SEQ ID NO: 1322 - DNA, 51 bp, Artificial Sequence
  Synthetic polynucleotide
attttcctgcagttccaaatgacctyccacctgtttattgctgcatttgtg

SEQ ID NO: 1323 - DNA, 51 bp, Artificial Sequence
  Synthetic polynucleotide
ctcccacttcttcagcttgggcaagygtgtgcctgtgtgccgaggtgagct

SEQ ID NO: 1324 - DNA, 51 bp, Artificial Sequence
  Synthetic polynucleotide
cttcgtgaaggataacccccagaagycctacttcatccgcctttacggcct

SEQ ID NO: 1325 - DNA, 51 bp, Artificial Sequence
  Synthetic polynucleotide
aacctcgacccagatctgcggagtcygttctccagggcaggaatcagcgag

SEQ ID NO: 1326 - DNA, 51 bp, Artificial Sequence
  Synthetic polynucleotide
cttacatttcagaaccatcaagaaayggggacctggattttatttgcctgc

SEQ ID NO: 1327 - DNA, 51 bp, Artificial Sequence
  Synthetic polynucleotide
accatgagcaacaacttggtaacccyggaaaatgggaaacagctgaccgtt

SEQ ID NO: 1328 - DNA, 51 bp, Artificial Sequence
  Synthetic polynucleotide
tcctcctactgcatcgacagcatccygggccggaggagcccgtgcaaaatg

SEQ ID NO: 1329 - DNA, 51 bp, Artificial Sequence
  Synthetic polynucleotide
tgatcatttctcctccagatcattcygcaatccatgcataagtacaaaccc

SEQ ID NO: 1330 - DNA, 51 bp, Artificial Sequence
  Synthetic polynucleotide
ggtgaactccagaaagaagaagctayggccgcagtgattctggagagcatc

SEQ ID NO: 1331 - DNA, 51 bp, Artificial Sequence
  Synthetic polynucleotide
aaggacctgaccttcttgaaggagcyggggactggacaatttggggtagtg

SEQ ID NO: 1332 - DNA, 51 bp, Artificial Sequence
  Synthetic polynucleotide
gctgctagagatgtgcaaggatgtcygtgaagccatggaatacctggagtc

SEQ ID NO: 1333 - DNA, 51 bp, Artificial Sequence
  Synthetic polynucleotide
gttgttaaagtatctgatttcggccygtccaggtgagtgtggctttttcat

SEQ ID NO: 1334 - DNA, 51 bp, Artificial Sequence
  Synthetic polynucleotide
caagttcagcagcaaatctgacattygggcttttggtaagtggataagatt

SEQ ID NO: 1335 - DNA, 51 bp, Artificial Sequence
  Synthetic polynucleotide
ttcaaaattcttctgagcaatattcyagatgtcatggatgaagaatcctga

SEQ ID NO: 1336 - DNA, 51 bp, Artificial Sequence
  Synthetic polynucleotide
gatggacaatggattctaaactcttycttggatgccacccttacctcagtg

SEQ ID NO: 1337 - DNA, 51 bp, Artificial Sequence
  Synthetic polynucleotide
gattcatccccaccctctgacagagytcctccacaacatggactacttcaa

SEQ ID NO: 1338 - DNA, 51 bp, Artificial Sequence
  Synthetic polynucleotide
gacactcaatgagatctaccactggytcacacgcatgtttgccttcttcag

SEQ ID NO: 1339 - DNA, 51 bp, Artificial Sequence
  Synthetic polynucleotide
ctgcgccacaacaacctgtccttcaycacgcccggcgccttcaagggcctg

SEQ ID NO: 1340 - DNA, 51 bp, Artificial Sequence
  Synthetic polynucleotide
caccctgcagatacatgtcatggagygcattgagtagggccggccagtgca

SEQ ID NO: 1341 - DNA, 51 bp, Artificial Sequence
  Synthetic polynucleotide
ccatactggcctcagcacctaagacyggacaactttgtacctaatgaccgc

SEQ ID NO: 1342 - DNA, 51 bp, Artificial Sequence
  Synthetic polynucleotide
cttcggactctcaagcaggaaaacahtgtggagttgaaggaagcatttcgt

SEQ ID NO: 1343 - DNA, 51 bp, Artificial Sequence
  Synthetic polynucleotide
gccttaattatttcacatatgaggtytattatgcttcatgacataagacaa

SEQ ID NO: 1344 - DNA, 51 bp, Artificial Sequence
  Synthetic polynucleotide
agttacctttactaagaaggtaaggrtatgccccgcagtgacaaatgccga

SEQ ID NO: 1345 - DNA, 51 bp, Artificial Sequence
  Synthetic polynucleotide
ggatccagctgaaaggatcactgttyatgaagcactgaatcacccatggct

SEQ ID NO: 1346 - DNA, 51 bp, Artificial Sequence
  Synthetic polynucleotide
tgagctcgtgtgcacagccccacagygggtccctgtctcctgggtctatta

SEQ ID NO: 1347 - DNA, 51 bp, Artificial Sequence
  Synthetic polynucleotide
aggggaggacttctactgcgtgactygccatgagaccaagtttgccaagca

SEQ ID NO: 1348 - DNA, 51 bp, Artificial Sequence
  Synthetic polynucleotide
ggaggactcccccaagtgcaaggggygcttcaaggccattgtggcaggtac

SEQ ID NO: 1349 - DNA, 51 bp, Artificial Sequence
  Synthetic polynucleotide
caccgctgtggaggaccagtattacygcgtggattgctacaagaactttgt

SEQ ID NO: 1350 - DNA, 51 bp, Artificial Sequence
  Synthetic polynucleotide
  misc_feature (26)..(26): n is a, c, g, t or u
atacaacacgctgaagaatttcttancaaacctgaatccaaagttgctaag

SEQ ID NO: 1351 - DNA, 51 bp, Artificial Sequence
  Synthetic polynucleotide
cttatttcttgccttaggggaaagcyatgtctgttcctcagacaacttctt

SEQ ID NO: 1352 - DNA, 51 bp, Artificial Sequence
  Synthetic polynucleotide
atcctgttgaacgtgtttcttgccaytgctgtggacaacctggccagtgga

SEQ ID NO: 1353 - DNA, 51 bp, Artificial Sequence
  Synthetic polynucleotide
acagggcagctggtaaagatgctacygtatacagaggtgactcgctacctg

SEQ ID NO: 1354 - DNA, 51 bp, Artificial Sequence
  Synthetic polynucleotide
atcatggcccccattgcatttgagcyggtgggcccaatgcaggcctcacag

SEQ ID NO: 1355 - DNA, 51 bp, Artificial Sequence
  Synthetic polynucleotide
ctccaggtcctttccttcctgctccygggcctgatgtccatgatgattccc

SEQ ID NO: 1356 - DNA, 51 bp, Artificial Sequence
  Synthetic polynucleotide
ccccccatcatcggggctgtaatccycttcttcgtccctctgatgcatcaa

SEQ ID NO: 1357 - DNA, 51 bp, Artificial Sequence
  Synthetic polynucleotide
gaaatgcttactggtacactcccttyccaaggaaaagatcgaaaagaaaca

SEQ ID NO: 1358 - DNA, 51 bp, Artificial Sequence
  Synthetic polynucleotide
aagttttcttcatacagttcttttgygtgacaaactggatttcagcacggc

SEQ ID NO: 1359 - DNA, 51 bp, Artificial Sequence
  Synthetic polynucleotide
gaagtggcttcgaaacattgactatyaccgtttagatggttccactactgc

SEQ ID NO: 1360 - DNA, 51 bp, Artificial Sequence
  Synthetic polynucleotide
gatattaagaaggctcatcttgcatyggaagaagacttaaattccgagttt

SEQ ID NO: 1361 - DNA, 51 bp, Artificial Sequence
  Synthetic polynucleotide
cagtccctcatatctctggacttgaytgaagattttcttgaattagctagt

SEQ ID NO: 1362 - DNA, 51 bp, Artificial Sequence
  Synthetic polynucleotide
aggtggggtgactcggatgactgttyctcttgttgtcataatgtttgaact

SEQ ID NO: 1363 - DNA, 51 bp, Artificial Sequence
  Synthetic polynucleotide
gacacatccctggaccctaatgattbtgacttcacggtaactgggagaggg

SEQ ID NO: 1364 - DNA, 51 bp, Artificial Sequence
  Synthetic polynucleotide
tgcctcggggtgcgtctagggctgcytgaggtcaagttgacactgctccac

SEQ ID NO: 1365 - DNA, 51 bp, Artificial Sequence
  Synthetic polynucleotide
ttttttattcctcccaggtactatcytggtcgtcggatgtttattgttatt

SEQ ID NO: 1366 - DNA, 51 bp, Artificial Sequence
  Synthetic polynucleotide
ttcttcattttaccatgacactgatytcttgggagaagaactggatattgt

SEQ ID NO: 1367 - DNA, 51 bp, Artificial Sequence
  Synthetic polynucleotide
ggtagtctgcacttaccacccaagaygtttactcttcactttcacggcgga

SEQ ID NO: 1368 - DNA, 51 bp, Artificial Sequence
  Synthetic polynucleotide
agccccgacggcgagtggcggcgccygggccggcccgtcttccccacggca

SEQ ID NO: 1369 - DNA, 51 bp, Artificial Sequence
  Synthetic polynucleotide
atcgtggcccccctcctgacctcaayagatgccatctccctggagtgtgag

SEQ ID NO: 1370 - DNA, 51 bp, Artificial Sequence
  Synthetic polynucleotide
ttatgcttatagggaagaacagcttygcattggtcctgcaacaatggatac

SEQ ID NO: 1371 - DNA, 51 bp, Artificial Sequence
  Synthetic polynucleotide
gactacaattgtgtgccatcagtgayttacacacaccctgaagttgcttgg

SEQ ID NO: 1372 - DNA, 51 bp, Artificial Sequence
  Synthetic polynucleotide
gggcaggggacggtggccgcggccaygcagtcctgtgccagggcgtggggg

SEQ ID NO: 1373 - DNA, 51 bp, Artificial Sequence
  Synthetic polynucleotide
agactggctcaacctcgtctttaagyggtaagaaccatatagagaggagat

SEQ ID NO: 1374 - DNA, 51 bp, Artificial Sequence
  Synthetic polynucleotide
ccgagagtcctggtgactttgaacaygctggtgccgctagccaagctgtcc

SEQ ID NO: 1375 - DNA, 51 bp, Artificial Sequence
  Synthetic polynucleotide
ctggcccgagagctccttaaagagcygcgaactcaagtctagaaggcacgc

SEQ ID NO: 1376 - DNA, 51 bp, Artificial Sequence
  Synthetic polynucleotide
gccctcaggctcctctgccttctgcytgggcttcagggctgcctggctgca

SEQ ID NO: 1377 - DNA, 51 bp, Artificial Sequence
  Synthetic polynucleotide
cccctctgcctgcccgaacggacgtyctctgagaggacgctggccttcgtg

SEQ ID NO: 1378 - DNA, 51 bp, Artificial Sequence
  Synthetic polynucleotide
acaacccgtcctgtcctggggctgcyggtctgcttcctgtacaacgaggcg

SEQ ID NO: 1379 - DNA, 51 bp, Artificial Sequence
  Synthetic polynucleotide
tgcgcggacgagctgggctgcttcgygggcacggctgaggcgctgcgctgc

SEQ ID NO: 1380 - DNA, 51 bp, Artificial Sequence
  Synthetic polynucleotide
cctactggccttctcctccgcgtgcyacttccagaactgcccgaggggcgg

SEQ ID NO: 1381 - DNA, 51 bp, Artificial Sequence
  Synthetic polynucleotide
gggactcagaggagcgggcaggtgcytgaggtggctggcaccaaggcgatt

SEQ ID NO: 1382 - DNA, 51 bp, Artificial Sequence
  Synthetic polynucleotide
gggcggtgcgcgcatggccgagaccbgcgtgccagtcctgcgctgcaacac

SEQ ID NO: 1383 - DNA, 51 bp, Artificial Sequence
  Synthetic polynucleotide
tagccactgccacgccctggccacaygtgtcaatgtggtgggcagctactt

SEQ ID NO: 1384 - DNA, 51 bp, Artificial Sequence
  Synthetic polynucleotide
caaatcgaataatggcagatggcacygccagtgcaaacaggacttcaacat

SEQ ID NO: 1385 - DNA, 51 bp, Artificial Sequence
  Synthetic polynucleotide
aatcagaactcgaatggccttgtttycttgctctggggctcttatgctcag

SEQ ID NO: 1386 - DNA, 51 bp, Artificial Sequence
  Synthetic polynucleotide
caggtgtaccgccagcgcaggaagcygattgctgagatcgccttccagtac

SEQ ID NO: 1387 - DNA, 51 bp, Artificial Sequence
  Synthetic polynucleotide
ccaccctcaaaataattcgatttgcygtaccaagtgccacaaaggtagggg

SEQ ID NO: 1388 - DNA, 51 bp, Artificial Sequence
  Synthetic polynucleotide
aatgggtcaggtggagatctcttctygcacagtggaccgggacaccgtgtg

SEQ ID NO: 1389 - DNA, 51 bp, Artificial Sequence
  Synthetic polynucleotide
ggcggcatgaaccggaggcccatccycaccatcatcacactggaagactcc

SEQ ID NO: 1390 - DNA, 51 bp, Artificial Sequence
  Synthetic polynucleotide
cagtactcccctgccctcaacaagaygttttgccaactggccaagacctgc

SEQ ID NO: 1391 - DNA, 51 bp, Artificial Sequence
  Synthetic polynucleotide
gagcgcttcgagatgttccgagagcygaatgaggccttggaactcaaggat

SEQ ID NO: 1392 - DNA, 51 bp, Artificial Sequence
  Synthetic polynucleotide
tctctgaacagacgcatccagctggytgaggaagagttggatcgtgcccag

SEQ ID NO: 1393 - DNA, 51 bp, Artificial Sequence
  Synthetic polynucleotide
gggtggtgcttccctcaagcccgaaytcgtggacatcatcaatgccaaaca

SEQ ID NO: 1394 - DNA, 51 bp, Artificial Sequence
  Synthetic polynucleotide
aagcatgagaacatactccagttccygacggctgaggagcggaagacggag

SEQ ID NO: 1395 - DNA, 51 bp, Artificial Sequence
  Synthetic polynucleotide
ctttcgccttagcgcccactgctccygtgacagcagggataacacactgca

SEQ ID NO: 1396 - DNA, 51 bp, Artificial Sequence
  Synthetic polynucleotide
gctgcccgaggccgtgctcgccctgyacaacagcacccgcgaccgggtggc

SEQ ID NO: 1397 - DNA, 51 bp, Artificial Sequence
  Synthetic polynucleotide
  misc_feature (26)..(26): n is a, c, g, t or u
tgagggctttcgccttagcgcccacngctcctgtgacagcagggataacac

SEQ ID NO: 1398 - DNA, 51 bp, Artificial Sequence
  Synthetic polynucleotide
atcatcctcctcaaaggctgctgcayggagatcatgtcccttcgcgctgct

SEQ ID NO: 1399 - DNA, 51 bp, Artificial Sequence
  Synthetic polynucleotide
ccgcttcctgcacatgaaggtggaaygccccacagaactcttccccccttt

SEQ ID NO: 1400 - DNA, 51 bp, Artificial Sequence
  Synthetic polynucleotide
ctcttcccccctttgttcttggaagygttcgaggattagactgactggatt

SEQ ID NO: 1401 - DNA, 51 bp, Artificial Sequence
  Synthetic polynucleotide
gaagcacaagctgggcgggggccagyacggggaggtgtacgagggcgtgtg

SEQ ID NO: 1402 - DNA, 51 bp, Artificial Sequence
  Synthetic polynucleotide
aggggtctgcacccgggagcccccgytctatatcatcactgagttcatgac

SEQ ID NO: 1403 - DNA, 51 bp, Artificial Sequence
  Synthetic polynucleotide
atggccactcagatctcgtcagccayggagtacctggagaagaaaaacttc

SEQ ID NO: 1404 - DNA, 51 bp, Artificial Sequence
  Synthetic polynucleotide
tgaacacggagcacaacatcatattyacaggcttgtaaaggactgaacatg

SEQ ID NO: 1405 - DNA, 51 bp, Artificial Sequence
  Synthetic polynucleotide
tggatacccatccccgacagtgacahggtacagggaagactaccaaatcga

SEQ ID NO: 1406 - DNA, 51 bp, Artificial Sequence
  Synthetic polynucleotide
gaaaacacagatgacctgacaacccygatcatcatggacgtacagaaacaa

SEQ ID NO: 1407 - DNA, 51 bp, Artificial Sequence
  Synthetic polynucleotide
ccccacaggctctgccatgcagcagygccaattgctgtgccgccagggctc

SEQ ID NO: 1408 - DNA, 51 bp, Artificial Sequence
  Synthetic polynucleotide
tctctctcccacaggcccgacaaccygcgagaaatctcgaaccagtgggct

SEQ ID NO: 1409 - DNA, 51 bp, Artificial Sequence
  Synthetic polynucleotide
cgggtgctggcggcaggcaaaggggyaaggctgtggagtccagtcagagga

SEQ ID NO: 1410 - DNA, 51 bp, Artificial Sequence
  Synthetic polynucleotide
gccttatttgaagaagaaggatgaayctcaggaaggcaagcagcagtatct

SEQ ID NO: 1411 - DNA, 51 bp, Artificial Sequence
  Synthetic polynucleotide
ccgttcatcgacgaggctaagcggcygcgagcgctgcacatgaaggagcac

SEQ ID NO: 1412 - DNA, 51 bp, Artificial Sequence
  Synthetic polynucleotide
taatgtcaccaactttacctccagcyggaaggatggcttggcctttaatgc

SEQ ID NO: 1413 - DNA, 51 bp, Artificial Sequence
  Synthetic polynucleotide
ggtgtgccagttctcgagggatgccyctgtggctgaggcgtggctgattgc

SEQ ID NO: 1414 - DNA, 51 bp, Artificial Sequence
  Synthetic polynucleotide
ttggctctccagagacagaaagctcbgtccaatgctgcaaacttacaacga

SEQ ID NO: 1415 - DNA, 51 bp, Artificial Sequence
  Synthetic polynucleotide
ggctctccagagacagaaagctctgyccaatgctgcaaacttacaacgatt

SEQ ID NO: 1416 - DNA, 51 bp, Artificial Sequence
  Synthetic polynucleotide
aaatttgaagacttccaagtggagcyggtagctaaagaagggagagttgtt

SEQ ID NO: 1417 - DNA, 51 bp, Artificial Sequence
  Synthetic polynucleotide
cgagattcagaagaatattgatggtygggagggaaaagacattggacagtg

SEQ ID NO: 1418 - DNA, 51 bp, Artificial Sequence
  Synthetic polynucleotide
tgtggaagaaggcagaggaaaacaayggtggaacctgagaaggacgtgttt

SEQ ID NO: 1419 - DNA, 51 bp, Artificial Sequence
  Synthetic polynucleotide
tttgggtatctctctttgcttcaagytgtaagtgaacactattttctctga

SEQ ID NO: 1420 - DNA, 51 bp, Artificial Sequence
  Synthetic polynucleotide
actattttgacaaactgtgtgtttahgacaatgagtaaccctcctgattgg

SEQ ID NO: 1421 - DNA, 51 bp, Artificial Sequence
  Synthetic polynucleotide
tctatactttggaggtcaagacatcyttatgacagaagaacagaagaaata

SEQ ID NO: 1422 - DNA, 51 bp, Artificial Sequence
  Synthetic polynucleotide
gggctggaggtgggcaagacgcccahcgccatcgagattgagcacttcatc

SEQ ID NO: 1423 - DNA, 51 bp, Artificial Sequence
  Synthetic polynucleotide
cagcaatatcccggagatcacgcccytcctgctgttcatcatggccaacat

SEQ ID NO: 1424 - DNA, 51 bp, Artificial Sequence
  Synthetic polynucleotide
cctcagaatctccccacaggccgccygatctttgacaacttgaagaaatcc

SEQ ID NO: 1425 - DNA, 51 bp, Artificial Sequence
  Synthetic polynucleotide
acggctactgggaatccgcctcgacygggatgaccggaccatgaatgatct

SEQ ID NO: 1426 - DNA, 51 bp, Artificial Sequence
  Synthetic polynucleotide
aagaaggctgacattggcattgccaygggcatctctggctctgacgtctct

SEQ ID NO: 1427 - DNA, 51 bp, Artificial Sequence
  Synthetic polynucleotide
gggcggacacccatagcaatggagaytgaacacttcatccagctgatcaca

SEQ ID NO: 1428 - DNA, 51 bp, Artificial Sequence
  Synthetic polynucleotide
atgtttatggtttattttaggggccytgatgctctcagcaagaaagcgaag

SEQ ID NO: 1429 - DNA, 51 bp, Artificial Sequence
  Synthetic polynucleotide
gtgggtgtccgggctggcggaggcaytggggacgagatcgaggaccccgcg

SEQ ID NO: 1430 - DNA, 51 bp, Artificial Sequence
  Synthetic polynucleotide
gttctccatgctggccgcctacatgyttctgctgatcgtgctgggcttccc

SEQ ID NO: 1431 - DNA, 51 bp, Artificial Sequence
  Synthetic polynucleotide
ctctttcactgttttataaaaaaggytagtagatgattattttcaagagca

SEQ ID NO: 1432 - DNA, 51 bp, Artificial Sequence
  Synthetic polynucleotide
tatgatgtgttccatgtatggcataygcaaagtgaagaatatagaccttaa

SEQ ID NO: 1433 - DNA, 51 bp, Artificial Sequence
  Synthetic polynucleotide
agatttgagtttgtttataattactyatatttagccaatttacgtgagaac

SEQ ID NO: 1434 - DNA, 51 bp, Artificial Sequence
  Synthetic polynucleotide
attcagtggatcagcaatcgctaccyggacttttcctccaaagaagtcaaa

SEQ ID NO: 1435 - DNA, 51 bp, Artificial Sequence
  Synthetic polynucleotide
caacccggactacacttggcaagcayggcgctactgaaagtcaagtttgac

SEQ ID NO: 1436 - DNA, 51 bp, Artificial Sequence
  Synthetic polynucleotide
actgagggtcccagccctggagactyccgctactcagatgggacccctgta

SEQ ID NO: 1437 - DNA, 51 bp, Artificial Sequence
  Synthetic polynucleotide
tttccccaggttctggagatgagcahtggggcgccggaagcccagcaacgc

SEQ ID NO: 1438 - DNA, 51 bp, Artificial Sequence
  Synthetic polynucleotide
agcaccctgtgtggcgaggtgccgcyctactacatctaggacgcctccggt

SEQ ID NO: 1439 - DNA, 51 bp, Artificial Sequence
  Synthetic polynucleotide
ctcactgacatgccagacatattacytgaacttggacaatttaaaaaaacc

SEQ ID NO: 1440 - DNA, 51 bp, Artificial Sequence
  Synthetic polynucleotide
ccccaccttctgcgaccactgtggcyccctcctctacgggcttgtgcacca

SEQ ID NO: 1441 - DNA, 51 bp, Artificial Sequence
  Synthetic polynucleotide
acagtgtggccgcagcggcgagaacyttgacaagttcttcacgcgggcggc

SEQ ID NO: 1442 - DNA, 51 bp, Artificial Sequence
  Synthetic polynucleotide
tgtaacttttgaggacgctggggaayatacgtgcttggcgggtaattctat

SEQ ID NO: 1443 - DNA, 51 bp, Artificial Sequence
  Synthetic polynucleotide
ttttgaggacgctggggaatatacghgcttggcgggtaattctattgggat

SEQ ID NO: 1444 - DNA, 51 bp, Artificial Sequence
  Synthetic polynucleotide
cagtgatgcccagccccacatccagbggatcaagcacgtggaaaagaacgg

SEQ ID NO: 1445 - DNA, 51 bp, Artificial Sequence
  Synthetic polynucleotide
ccaagccggactgccggcaaatgccyccacagtggtcggaggagacgtaga

SEQ ID NO: 1446 - DNA, 51 bp, Artificial Sequence
  Synthetic polynucleotide
cctgctgcccctcccaggcaggtgaygcttttccggaagagtccccaggag

SEQ ID NO: 1447 - DNA, 51 bp, Artificial Sequence
  Synthetic polynucleotide
ttcattattttaaatagataatgtabccagtgctgagggttggcatgtaaa

SEQ ID NO: 1448 - DNA, 51 bp, Artificial Sequence
  Synthetic polynucleotide
  misc_feature (26)..(26): n is a, c, g, t or u
tgaccgtggtctctttttcttctagntgatcataccagggttgtcctacac

SEQ ID NO: 1449 - DNA, 51 bp, Artificial Sequence
  Synthetic polynucleotide
cagcagcgaaagcgccttgaggcctytcttacccagaagcagaaggtggga

SEQ ID NO: 1450 - DNA, 51 bp, Artificial Sequence
  Synthetic polynucleotide
gcttttgacaaaatgtgctcgaagcygccgaagtccctgtcggaagagtgc

SEQ ID NO: 1451 - DNA, 51 bp, Artificial Sequence
  Synthetic polynucleotide
tacctagtgtgcggggaacgaggctbcttctacacacccaagacccgccgg

SEQ ID NO: 1452 - DNA, 51 bp, Artificial Sequence
  Synthetic polynucleotide
accacaaccaccaagggggagaactycaccgagaccgacgttaagatgatg

SEQ ID NO: 1453 - DNA, 51 bp, Artificial Sequence
  Synthetic polynucleotide
ggcagtcctgccatcaatgtggccgbgcatgtgttcagaaaggctgctgat

SEQ ID NO: 1454 - DNA, 51 bp, Artificial Sequence
  Synthetic polynucleotide
aggaaaaccagtgagtctggagagcygcatgggctcacaactgaggaggaa

SEQ ID NO: 1455 - DNA, 51 bp, Artificial Sequence
  Synthetic polynucleotide
cacccagggcaccggtgaatccaagygtcctctgatggtcaaagttctaga

SEQ ID NO: 1456 - DNA, 51 bp, Artificial Sequence
  Synthetic polynucleotide
gaatttgtagaagggatatacaaagyggaaatagacaccaaatcttactgg

SEQ ID NO: 1457 - DNA, 51 bp, Artificial Sequence
  Synthetic polynucleotide
caccattgccgccctgctgagccccyactcctattccaccacggctgtcgt

SEQ ID NO: 1458 - DNA, 51 bp, Artificial Sequence
  Synthetic polynucleotide
gcatgggctcacaactgaggaggaayttgtagaagggatatacaaagtgga

SEQ ID NO: 1459 - DNA, 51 bp, Artificial Sequence
  Synthetic polynucleotide
tgccatcaatgtggccgtgcatgtghtcagaaaggctgctgatgacacctg

SEQ ID NO: 1460 - DNA, 51 bp, Artificial Sequence
  Synthetic polynucleotide
ggcaccggtgaatccaagtgtcctcygatggtcaaagttctagatgctgtc

SEQ ID NO: 1461 - DNA, 51 bp, Artificial Sequence
  Synthetic polynucleotide
gctgctgatgacacctgggagccatytgcctctgggtaagttgccaaagaa

SEQ ID NO: 1462 - DNA, 51 bp, Artificial Sequence
  Synthetic polynucleotide
tgaggaggaatttgtagaagggatayacaaagtggaaatagacaccaaatc

SEQ ID NO: 1463 - DNA, 51 bp, Artificial Sequence
  Synthetic polynucleotide
attgccctgcccgtacctgtcattgygtccaatttcaactatttctaccac

SEQ ID NO: 1464 - DNA, 51 bp, Artificial Sequence
  Synthetic polynucleotide
cttcagtccgtgcccccgggagcctbtgaccacctgccccagctgcagacc

SEQ ID NO: 1465 - DNA, 51 bp, Artificial Sequence
  Synthetic polynucleotide
gccctgccggcccgcacccgccaccytctgctggccaacaacagccttcag

SEQ ID NO: 1466 - DNA, 51 bp, Artificial Sequence
  Synthetic polynucleotide
ggccaccaaggactgccccagcccaygtacctgccgcgccctggaaaccat

SEQ ID NO: 1467 - DNA, 51 bp, Artificial Sequence
  Synthetic polynucleotide
tgtcccatgcctgcctggggagcccygttcctgctctgggccacagcagag

SEQ ID NO: 1468 - DNA, 51 bp, Artificial Sequence
  Synthetic polynucleotide
cgatttttaaacagatgcagcctcabttccaccttttgttgagaaaagcca

SEQ ID NO: 1469 - DNA, 51 bp, Artificial Sequence
  Synthetic polynucleotide
caacccactgtataaagaggccacgyctaccttcaccaatatcacgtaccg

SEQ ID NO: 1470 - DNA, 51 bp, Artificial Sequence
  Synthetic polynucleotide
gctcctgtcttacaggccctgcctcygggctcacctcgctgtgacctgaag

SEQ ID NO: 1471 - DNA, 51 bp, Artificial Sequence
  Synthetic polynucleotide
aggggggtgtgtggcccacccacatycctggccctggcaagtcagtcttag

SEQ ID NO: 1472 - DNA, 51 bp, Artificial Sequence
  Synthetic polynucleotide
caaactgaaagcaatattatccaaayggctggaggaagctgagcaagtagg

SEQ ID NO: 1473 - DNA, 51 bp, Artificial Sequence
  Synthetic polynucleotide
accaaccctgtcagatatgaccatghatgagatgaatttctctctccttgt

SEQ ID NO: 1474 - DNA, 51 bp, Artificial Sequence
  Synthetic polynucleotide
ctccctcctaggacacggcgagccaygggcggggcagtgcctttcaaagct

SEQ ID NO: 1475 - DNA, 51 bp, Artificial Sequence
  Synthetic polynucleotide
ctgggaaagcagctggctaagaaaabagagcctgagcttgatggcagtgct

SEQ ID NO: 1476 - DNA, 51 bp, Artificial Sequence
  Synthetic polynucleotide
tttgggtgtgagacacacgccatgcygccctatgaccagtacctgcaccgc

SEQ ID NO: 1477 - DNA, 51 bp, Artificial Sequence
  Synthetic polynucleotide
acgagagaatgtctccatggtggacyatggtgagacctccaggacccaggg

SEQ ID NO: 1478 - DNA, 51 bp, Artificial Sequence
  Synthetic polynucleotide
gatcctgcggaagaaccccaaaggcytcttcttgctggtggaaggtaggga

SEQ ID NO: 1479 - DNA, 51 bp, Artificial Sequence
  Synthetic polynucleotide
ggagttcaatgatgttcacttttctyacccttctcgagctaacgtcaaggt

SEQ ID NO: 1480 - DNA, 51 bp, Artificial Sequence
  Synthetic polynucleotide
caagatttacggcgacgattcttccytcaccatctgatcgcagaaatccac

SEQ ID NO: 1481 - DNA, 51 bp, Artificial Sequence
  Synthetic polynucleotide
agagctgtgtctgaacatcagctccyccatgacaaggggaagtccatccaa

SEQ ID NO: 1482 - DNA, 51 bp, Artificial Sequence
  Synthetic polynucleotide
agttatgattgtcatgttggcaattygttttcttacaaaatcggatgggaa

SEQ ID NO: 1483 - DNA, 51 bp, Artificial Sequence
  Synthetic polynucleotide
gttggcaatttgttttcttacaaaaycggatgggaaatctgttaagtaagt

SEQ ID NO: 1484 - DNA, 51 bp, Artificial Sequence
  Synthetic polynucleotide
acctctggacgcagaacttcagccaygaaggtaacaggcatctttcttctc

SEQ ID NO: 1485 - DNA, 51 bp, Artificial Sequence
  Synthetic polynucleotide
atctttcttctcagtgccttggcccbgttgagtctatctggtaagtgttgc

SEQ ID NO: 1486 - DNA, 51 bp, Artificial Sequence
  Synthetic polynucleotide
ggagtgttcgtgaacgggaggccgcygcccaacgccatccggcttcgcatc

SEQ ID NO: 1487 - DNA, 51 bp, Artificial Sequence
  Synthetic polynucleotide
ttaatcaaaggaacaatatgaattahactgtgagatgggctccacattcca

SEQ ID NO: 1488 - DNA, 51 bp, Artificial Sequence
  Synthetic polynucleotide
cagcgccgagagactgtggtacgtgyctgtgaacggcaagggccggccccg

SEQ ID NO: 1489 - DNA, 51 bp, Artificial Sequence
  Synthetic polynucleotide
gatgccacgatgggcctaatctggcygctactgctcagcctgctggagccc

SEQ ID NO: 1490 - DNA, 51 bp, Artificial Sequence
  Synthetic polynucleotide
  misc_feature (26)..(26): n is a, c, g, t or u
cccatgtatgaagtacagtggaaggntgttgaggagataaatggaaacaat

SEQ ID NO: 1491 - DNA, 51 bp, Artificial Sequence
  Synthetic polynucleotide
catctacgagttcatcatgaagaacytcccttactaccgcgagaacaagca

SEQ ID NO: 1492 - DNA, 51 bp, Artificial Sequence
  Synthetic polynucleotide
caatttctgaccgagggaatcatcaygaaagattttagtcatcccaatgtc

SEQ ID NO: 1493 - DNA, 51 bp, Artificial Sequence
  Synthetic polynucleotide
  misc_feature (26)..(26): n is a, c, g, t or u
cttccctgaggaggagaagtgcttcngcgagcccgaagacatccagggtga

SEQ ID NO: 1494 - DNA, 51 bp, Artificial Sequence
  Synthetic polynucleotide
  misc_feature (26)..(26): n is a, c, g, t or u
cacagatccactgtgcgacgagctgngccgcacggtgatcgcagccgctgt

SEQ ID NO: 1495 - DNA, 51 bp, Artificial Sequence
  Synthetic polynucleotide
tagggtcggattccagttaaatggayggcaattgaatccctttttgatcat

SEQ ID NO: 1496 - DNA, 51 bp, Artificial Sequence
  Synthetic polynucleotide
  misc_feature (26)..(26): n is a, c, g, t or u
caactgcttccctgaggaggagaagngcttctgcgagcccgaagacatcca

SEQ ID NO: 1497 - DNA, 51 bp, Artificial Sequence
  Synthetic polynucleotide
  misc_feature (26)..(26): n is a, c, g, t or u
ggggattaaagctggctatggcaccngcaactgcttccctgaggaggagaa

SEQ ID NO: 1498 - DNA, 51 bp, Artificial Sequence
  Synthetic polynucleotide
atgcatgacttctttgtgggacttaygggcaagaggagcgtccagccaggt

SEQ ID NO: 1499 - DNA, 51 bp, Artificial Sequence
  Synthetic polynucleotide
atccgcacgcaggagaaggcgcagcyccaggacctcaatgaccgcttcgcc

SEQ ID NO: 1500 - DNA, 51 bp, Artificial Sequence
  Synthetic polynucleotide
tgcgggcgcgacgaggcgctgcggcygaagcagaggcgccgcacgctgaag

SEQ ID NO: 1501 - DNA, 51 bp, Artificial Sequence
  Synthetic polynucleotide
agccgggggcgccaactccaacgtgytctccatgttcgaacagacccaaat

SEQ ID NO: 1502 - DNA, 51 bp, Artificial Sequence
  Synthetic polynucleotide
ttcacttcagaggagaaaaactccaygtataagctgacaggcgccatcatg

SEQ ID NO: 1503 - DNA, 51 bp, Artificial Sequence
  Synthetic polynucleotide
gcttcctcagcccatgggcatcatgyccatcctggaagaggagtgcatgtt

SEQ ID NO: 1504 - DNA, 51 bp, Artificial Sequence
  Synthetic polynucleotide
aacatggaacagaccattaaggaccygcagcaccggctggacgaagccgag

SEQ ID NO: 1505 - DNA, 51 bp, Artificial Sequence
  Synthetic polynucleotide
gaggtggaacataagaagaagaagcyggaggcgcaggtgcaggagctgcag

SEQ ID NO: 1506 - DNA, 51 bp, Artificial Sequence
  Synthetic polynucleotide
tgtgacgtcaaaaaccctccagacayagtgggcaagacctctcaggtcacg

SEQ ID NO: 1507 - DNA, 51 bp, Artificial Sequence
  Synthetic polynucleotide
cgctggaaggatggctccattgtcayacacaacctagactacagtgacaat

SEQ ID NO: 1508 - DNA, 51 bp, Artificial Sequence
  Synthetic polynucleotide
agtccaagtgtggctcaaaggataayatcaaacacgtcccgggaggcggca

SEQ ID NO: 1509 - DNA, 51 bp, Artificial Sequence
  Synthetic polynucleotide
gaacaagggaaccatcttaaaagcayccgtggactatatccgaaagttgca

SEQ ID NO: 1510 - DNA, 51 bp, Artificial Sequence
  Synthetic polynucleotide
aatgcaggctcgagctcatggacttycccttattccatccacgggtctctg

SEQ ID NO: 1511 - DNA, 51 bp, Artificial Sequence
  Synthetic polynucleotide
accaagaatgagtccggcatcattcytttgggaagtggagggacaccagca

SEQ ID NO: 1512 - DNA, 51 bp, Artificial Sequence
  Synthetic polynucleotide
acaaccctctgtacctggaggatcaygtcagccatgccaatgcaatgacaa

SEQ ID NO: 1513 - DNA, 51 bp, Artificial Sequence
  Synthetic polynucleotide
cccgatgccaaccacaagccagagayggccattgccctcacccccttccag

SEQ ID NO: 1514 - DNA, 51 bp, Artificial Sequence
  Synthetic polynucleotide
ggagacagaagcactgattatgggayatttcagatcaatagccgctactgg

SEQ ID NO: 1515 - DNA, 51 bp, Artificial Sequence
  Synthetic polynucleotide
gatatttcagatcaatagccgctachggtgtaatgatggcaaaaccccagg

SEQ ID NO: 1516 - DNA, 51 bp, Artificial Sequence
  Synthetic polynucleotide
caatgtggtggccttcttcataattygtgcttgctacattaaaatttattt

SEQ ID NO: 1517 - DNA, 51 bp, Artificial Sequence
  Synthetic polynucleotide
aaacttacagtgcctcgttttctcaygtgcaatctctcctttgcagacttt

SEQ ID NO: 1518 - DNA, 51 bp, Artificial Sequence
  Synthetic polynucleotide
tcctgtccctaatcacaggagcatcygtaacacaggcatcagaaagtttcc

SEQ ID NO: 1519 - DNA, 51 bp, Artificial Sequence
  Synthetic polynucleotide
gacttccttagggtcctgatttggcygattaatattctagccatcatggga

SEQ ID NO: 1520 - DNA, 51 bp, Artificial Sequence
  Synthetic polynucleotide
tcttctctaattgctatgttgccccytgtcggtgtcagcaattacatgaag

SEQ ID NO: 1521 - DNA, 51 bp, Artificial Sequence
  Synthetic polynucleotide
tgcgggaacagcctgcgtacggctcycatcaactccactggggaagtaagt

SEQ ID NO: 1522 - DNA, 51 bp, Artificial Sequence
  Synthetic polynucleotide
gagatccacgcctaccgcaagctctyggagggcgaggaggagaggtgggct

SEQ ID NO: 1523 - DNA, 51 bp, Artificial Sequence
  Synthetic polynucleotide
caaacacaacacacgtggcctcaacygcgagcagtgtcaggatttctatcg

SEQ ID NO: 1524 - DNA, 51 bp, Artificial Sequence
  Synthetic polynucleotide
aaatccataaggttaagttggacctrcagagggaagggaaagagaagcgct

SEQ ID NO: 1525 - DNA, 51 bp, Artificial Sequence
  Synthetic polynucleotide
ctgaatgaccgcctggcttcctactyggacaaagttcgggctctggaagaa

SEQ ID NO: 1526 - DNA, 51 bp, Artificial Sequence
  Synthetic polynucleotide
ctctctggaaatgaaaaagtaaccabgcagaatctgaatgaccgcctggct

SEQ ID NO: 1527 - DNA, 51 bp, Artificial Sequence
  Synthetic polynucleotide
ctggctggaggtgagaaggccaccahgcagaacctcaatgaccgcctggcc

SEQ ID NO: 1528 - DNA, 51 bp, Artificial Sequence
  Synthetic polynucleotide
accatgcagaacctcaatgaccgcchggcctcctacctggacaaggtgcgt

SEQ ID NO: 1529 - DNA, 51 bp, Artificial Sequence
  Synthetic polynucleotide
ctcaatgaccgcctggcctcctaccyggacaaggtgcgtgccctggaggag

SEQ ID NO: 1530 - DNA, 51 bp, Artificial Sequence
  Synthetic polynucleotide
ctcaatgaccgcctggcctcctaccyggacaaggtgcgtgctctggaggag

SEQ ID NO: 1531 - DNA, 51 bp, Artificial Sequence
  Synthetic polynucleotide
ctggtgggcagtgagaaggtgaccahgcagaacctcaatgaccgcctggcc

SEQ ID NO: 1532 - DNA, 51 bp, Artificial Sequence
  Synthetic polynucleotide
atgattggcagcgtggaggagcagcyggcccagctccgctgcgagatggag

SEQ ID NO: 1533 - DNA, 51 bp, Artificial Sequence
  Synthetic polynucleotide
ctggtgggcagtgagaaggtgaccaygcagaacctcaatgaccgcctggcc

SEQ ID NO: 1534 - DNA, 51 bp, Artificial Sequence
  Synthetic polynucleotide
gcggctggagcaggagatcgccaccyaccgccgcctgctggagggcgagga

SEQ ID NO: 1535 - DNA, 51 bp, Artificial Sequence
  Synthetic polynucleotide
ctcaacgaccgcctggcttcctaccyggagaaggtgcgcgccctggaggag

SEQ ID NO: 1536 - DNA, 51 bp, Artificial Sequence
  Synthetic polynucleotide
ctttcgcggtggcctgggcggcggchatggtggggccagcggcatgggagg

SEQ ID NO: 1537 - DNA, 51 bp, Artificial Sequence
  Synthetic polynucleotide
gagctcatgaacaccaagctggcccyggacgtggagatcgccacttaccgc

SEQ ID NO: 1538 - DNA, 51 bp, Artificial Sequence
  Synthetic polynucleotide
tctgacacctcagtggtcctctccahggacaacaaccgcaacctggacctg

SEQ ID NO: 1539 - DNA, 51 bp, Artificial Sequence
  Synthetic polynucleotide
gccaccatgtctcgccagtcaagtgygtccttccggagcgggggcagtcgt

SEQ ID NO: 1540 - DNA, 51 bp, Artificial Sequence
  Synthetic polynucleotide
caagaccctcaacaataagtttgccyccttcatcgacaaggtgagctacga

SEQ ID NO: 1541 - DNA, 51 bp, Artificial Sequence
  Synthetic polynucleotide
tgcgtggcctgccgcaacttctaccyggacggcaggtgtgtggagacctgc

SEQ ID NO: 1542 - DNA, 51 bp, Artificial Sequence
  Synthetic polynucleotide
ttgcatgagctggagaattgctctgycatcgaaggacacttgcagatactc

SEQ ID NO: 1543 - DNA, 51 bp, Artificial Sequence
  Synthetic polynucleotide
catcactcggatgcgcatgagacccyggctagagatgcagattaattccaa

SEQ ID NO: 1544 - DNA, 51 bp, Artificial Sequence
  Synthetic polynucleotide
aacctcaagaagatggggcagaaccygggtacggcagggccagagtggagg

SEQ ID NO: 1545 - DNA, 51 bp, Artificial Sequence
  Synthetic polynucleotide
ccgaggacgctgctccatgggccagygtgtgtgtgagcctggttggacagg

SEQ ID NO: 1546 - DNA, 51 bp, Artificial Sequence
  Synthetic polynucleotide
ctgcaagaaggccccagtgaagagcygcacggagtgtgtccgtgtggataa

SEQ ID NO: 1547 - DNA, 51 bp, Artificial Sequence
  Synthetic polynucleotide
atctcactctcaggagaccattgcaycattggccgcacactggtggtaagt

SEQ ID NO: 1548 - DNA, 51 bp, Artificial Sequence
  Synthetic polynucleotide
aagacaggaaacgctggaagtcgttyggcttgtggtgtaattgggatcgcc

SEQ ID NO: 1549 - DNA, 51 bp, Artificial Sequence
  Synthetic polynucleotide
cgtttggcttgtggtgtaattgggaycgcccaataaacattcccttggatg

SEQ ID NO: 1550 - DNA, 51 bp, Artificial Sequence
  Synthetic polynucleotide
accagactttctttttgtaggtttcyctacagtgagttaatgaaatacaac

SEQ ID NO: 1551 - DNA, 51 bp, Artificial Sequence
  Synthetic polynucleotide
tccaaaaagaacatttttcttctatytaagaagctctgctccttccgttac

SEQ ID NO: 1552 - DNA, 51 bp, Artificial Sequence
  Synthetic polynucleotide
ccatatttcaaattccagattggtgrtgttgacatctgggtcctcaaaagc

SEQ ID NO: 1553 - DNA, 51 bp, Artificial Sequence
  Synthetic polynucleotide
actgcaacagagaatggtgacttctyggccctggatcttggaggaaccaat

SEQ ID NO: 1554 - DNA, 51 bp, Artificial Sequence
  Synthetic polynucleotide
cttccccacactatctcaatgcaaayatctgtctgaaacggtccctggcta

SEQ ID NO: 1555 - DNA, 51 bp, Artificial Sequence
  Synthetic polynucleotide
gttgtctacccatggacccagaggtyctttgacagctttggcaacctgtcc

SEQ ID NO: 1556 - DNA, 51 bp, Artificial Sequence
  Synthetic polynucleotide
tagcagtatcctcttgggggcccctyccccacactatctcaatgcaaatat

SEQ ID NO: 1557 - DNA, 51 bp, Artificial Sequence
  Synthetic polynucleotide
tctcacaaactaatgaaaccctgctyatcttaaaccaacctgctcactgga

SEQ ID NO: 1558 - DNA, 51 bp, Artificial Sequence
  Synthetic polynucleotide
cacctggacaacctcaagggcacctytgccacactgagtgagctgcactgt

SEQ ID NO: 1559 - DNA, 51 bp, Artificial Sequence
  Synthetic polynucleotide
gtctacccttggacccagaggttctbtgagtcctttggggatctgtccact

SEQ ID NO: 1560 - DNA, 51 bp, Artificial Sequence
  Synthetic polynucleotide
acagctcctgggcaacgtgctggtcygtgtgctggcccatcactttggcaa

SEQ ID NO: 1561 - DNA, 51 bp, Artificial Sequence
  Synthetic polynucleotide
ggtctacccttggacccagaggttcbttgagtcctttggggatctgtccac

SEQ ID NO: 1562 - DNA, 51 bp, Artificial Sequence
  Synthetic polynucleotide
ctcccacagctcctgggcaacgtgcyggtctgtgtgctggcccatcacttt

SEQ ID NO: 1563 - DNA, 51 bp, Artificial Sequence
  Synthetic polynucleotide
ggtggtgaggccctgggcaggttgghatcaaggttacaagacaggtttaag

SEQ ID NO: 1564 - DNA, 51 bp, Artificial Sequence
  Synthetic polynucleotide
ctgggcaacgtgctggtctgtgtgcyggcccatcactttggcaaagaattc

SEQ ID NO: 1565 - DNA, 51 bp, Artificial Sequence
  Synthetic polynucleotide
  misc_feature (26)..(26): n is a, c, g, t or u
caccgtgctgacctccaaataccgtnaagctggagcctcggtagccgttcc

SEQ ID NO: 1566 - DNA, 51 bp, Artificial Sequence
  Synthetic polynucleotide
ccacagactcagagagaacccaccayggtgctgtctcctgccgacaagacc

SEQ ID NO: 1567 - DNA, 51 bp, Artificial Sequence
  Synthetic polynucleotide
gctggcgagtatggtgcggaggcccyggagaggtgaggctccctcccctgc

SEQ ID NO: 1568 - DNA, 51 bp, Artificial Sequence
  Synthetic polynucleotide
caagaagtcactatcaaccagagccytcttcagcccctcaatgtggagatt

SEQ ID NO: 1569 - DNA, 51 bp, Artificial Sequence
  Synthetic polynucleotide
accaagctggccctggatctggagaytgccacctacaggaccctcctggag

SEQ ID NO: 1570 - DNA, 51 bp, Artificial Sequence
  Synthetic polynucleotide
gagctgatgaacaccaagctggcccyggatctggagattgccacctacagg

SEQ ID NO: 1571 - DNA, 51 bp, Artificial Sequence
  Synthetic polynucleotide
aaagtgcaggacatcaaaaacaaccygaaagaggcgattgaagtacgtgct

SEQ ID NO: 1572 - DNA, 51 bp, Artificial Sequence
  Synthetic polynucleotide
aggaaacacaacagaaatccgtgagyggatgccttctccccaggcggggat

SEQ ID NO: 1573 - DNA, 51 bp, Artificial Sequence
  Synthetic polynucleotide
tccttggtactttgcaggcagaccaygtggaccctggtgagctgggtggcc

SEQ ID NO: 1574 - DNA, 51 bp, Artificial Sequence
  Synthetic polynucleotide
ggtgattttgcacccagagtttctaycctccaccagtcccttactacccat

SEQ ID NO: 1575 - DNA, 51 bp, Artificial Sequence
  Synthetic polynucleotide
aggtataagaagagatttcataagtytgatgcagaccagaaaggctttatt

SEQ ID NO: 1576 - DNA, 51 bp, Artificial Sequence
  Synthetic polynucleotide
atcttcatgtcagtgggacttgtgcbgctggtaagtttggtgcctgcactg

SEQ ID NO: 1577 - DNA, 51 bp, Artificial Sequence
  Synthetic polynucleotide
gtgttcttttccctaatagggtgcayctgagaaagacatcgtgcactctgg

SEQ ID NO: 1578 - DNA, 51 bp, Artificial Sequence
  Synthetic polynucleotide
cttcgactacatctctgagtgcatcyccgacttcctggacaagcatcagat

SEQ ID NO: 1579 - DNA, 51 bp, Artificial Sequence
  Synthetic polynucleotide
ctcaacatgttaggagggcggcaagygattgcagcagtgaaatgggcaaag

SEQ ID NO: 1580 - DNA, 51 bp, Artificial Sequence
  Synthetic polynucleotide
tcaaatggaaatatcaaaaaacttcygtttcatcaaaagtgactgccttaa

SEQ ID NO: 1581 - DNA, 51 bp, Artificial Sequence
  Synthetic polynucleotide
ggttgaaaatctccttaactattgcytccaaacatttttggataagaccat

SEQ ID NO: 1582 - DNA, 51 bp, Artificial Sequence
  Synthetic polynucleotide
cgccacttgcaggagtaccaggaccygctcaatgtcaagctggccctggac

SEQ ID NO: 1583 - DNA, 51 bp, Artificial Sequence
  Synthetic polynucleotide
cggctcttccgcgagcgctatcggcygcaccccaagttcgtggcggccgtg

SEQ ID NO: 1584 - DNA, 51 bp, Artificial Sequence
  Synthetic polynucleotide
tttctccctgctttcctaggtatgtyctcctacgtcatgctggccagcagc

SEQ ID NO: 1585 - DNA, 51 bp, Artificial Sequence
  Synthetic polynucleotide
caagataacataaacatccacacaaytgaaagaaattctttcgtggggctg

SEQ ID NO: 1586 - DNA, 51 bp, Artificial Sequence
  Synthetic polynucleotide
ctcaatgtcctggcctttgtggtcayctgtggctgctatatccacatctac

SEQ ID NO: 1587 - DNA, 51 bp, Artificial Sequence
  Synthetic polynucleotide
agagacctggctgctcggaacattcygctgtcggaaagcgacgtggtgaag

SEQ ID NO: 1588 - DNA, 51 bp, Artificial Sequence
  Synthetic polynucleotide
ctgaagtggatggcccctgaaagcaycttcgacaaggtgtacaccacgcag

SEQ ID NO: 1589 - DNA, 51 bp, Artificial Sequence
  Synthetic polynucleotide
cacatcgaggtgaatgggagcaagaytggcccagacaacctgccttatgtc

SEQ ID NO: 1590 - DNA, 51 bp, Artificial Sequence
  Synthetic polynucleotide
cctgtacctggagatcatcatctatygcacaggggccttcctcatctcctg

SEQ ID NO: 1591 - DNA, 51 bp, Artificial Sequence
  Synthetic polynucleotide
tcctggaatctgtggtccagggacaygttacaacaccgttggcaactacac

SEQ ID NO: 1592 - DNA, 51 bp, Artificial Sequence
  Synthetic polynucleotide
ctgtttttgtgcagacattgacgaaygccgcatatctcctgacctctgtgg

SEQ ID NO: 1593 - DNA, 51 bp, Artificial Sequence
  Synthetic polynucleotide
tatccctggagagtacaggtgcttgygttatgatggattcatggcatctga

SEQ ID NO: 1594 - DNA, 51 bp, Artificial Sequence
  Synthetic polynucleotide
atccagatctaacttggggtggcttygtcttcttcttttgccaattccact

SEQ ID NO: 1595 - DNA, 51 bp, Artificial Sequence
  Synthetic polynucleotide
catgaatctccaactttaaatcctghaggtattgaaataggtatcagcttt

SEQ ID NO: 1596 - DNA, 51 bp, Artificial Sequence
  Synthetic polynucleotide
atcctggacacttgcctgtatgtgayggacagagcacaaatggacctctct

SEQ ID NO: 1597 - DNA, 51 bp, Artificial Sequence
  Synthetic polynucleotide
gctgaatgacacattggactatgaaygccatgatggttatgaaagcaatac

SEQ ID NO: 1598 - DNA, 51 bp, Artificial Sequence
  Synthetic polynucleotide
aagttaataaatttggcttatttgcytggaagtgattataccgaaggaata

SEQ ID NO: 1599 - DNA, 51 bp, Artificial Sequence
  Synthetic polynucleotide
ccagtttacaaatatgcccaagactycttggtggctattgcagagccagtg

SEQ ID NO: 1600 - DNA, 51 bp, Artificial Sequence
  Synthetic polynucleotide
ctgggtcgctgcgtgggccacgcccyggaggtggaggaggcgctgctctgc

SEQ ID NO: 1601 - DNA, 51 bp, Artificial Sequence
  Synthetic polynucleotide
cgcacaggcccccacgtggacagcayggaccgcggcacgctccctctggct

SEQ ID NO: 1602 - DNA, 51 bp, Artificial Sequence
  Synthetic polynucleotide
aaaccaatcagaaaacacaggaacabgcactgcaaggtttctttgttggat

SEQ ID NO: 1603 - DNA, 51 bp, Artificial Sequence
  Synthetic polynucleotide
caacttcgtcatgtcggccgcgcacygcgtggcgaatgtgtgagtagccgg

SEQ ID NO: 1604 - DNA, 51 bp, Artificial Sequence
  Synthetic polynucleotide
accatggcaaccttcaccatgacgcyggcacgggtctgcctctgccctatg

SEQ ID NO: 1605 - DNA, 51 bp, Artificial Sequence
  Synthetic polynucleotide
ccacatcacgctgagcacccatgagygtgccggcctttcagaacgggacat

SEQ ID NO: 1606 - DNA, 51 bp, Artificial Sequence
  Synthetic polynucleotide
ccccctctcctgcagaacgattcccygatgaggcagatgcgggaattggag

SEQ ID NO: 1607 - DNA, 51 bp, Artificial Sequence
  Synthetic polynucleotide
ctcaaggatgagatggcccgccatcygcgcgagtaccaggacctgctcaac

SEQ ID NO: 1608 - DNA, 51 bp, Artificial Sequence
  Synthetic polynucleotide
gttctgaagcaccaagtctgagctcrccactcgctccaaaaacagacccac

SEQ ID NO: 1609 - DNA, 51 bp, Artificial Sequence
  Synthetic polynucleotide
cggcgcctggcagaggcagagatgcygctgctgctgcaccacgtaagcagg

SEQ ID NO: 1610 - DNA, 51 bp, Artificial Sequence
  Synthetic polynucleotide
taccccgccgagaggctcacctcctyccggcctgcggcctgtgctgtaagt

SEQ ID NO: 1611 - DNA, 51 bp, Artificial Sequence
  Synthetic polynucleotide
ggcttccaagggcagcagtacattcyggaacgaggcgaatatccaagctgg

SEQ ID NO: 1612 - DNA, 51 bp, Artificial Sequence
  Synthetic polynucleotide
gcaaccccagctctatgagatgttcycttcggtgatgaaacacctgccagg

SEQ ID NO: 1613 - DNA, 51 bp, Artificial Sequence
  Synthetic polynucleotide
actccttgacaaggttcaagcctacycaactgctggagggaaggtgtggct

SEQ ID NO: 1614 - DNA, 51 bp, Artificial Sequence
  Synthetic polynucleotide
gactggagcgccttaggcaaactccytgacaaggttcaagcctactcaact

SEQ ID NO: 1615 - DNA, 51 bp, Artificial Sequence
  Synthetic polynucleotide
ctcctttgcagccacaacgaggatcvtaatgcgaaaaatgaagaggacggt

SEQ ID NO: 1616 - DNA, 51 bp, Artificial Sequence
  Synthetic polynucleotide
cttccccatctcccacatccggctaygggccctgcagctgatcttcgtgtc

SEQ ID NO: 1617 - DNA, 51 bp, Artificial Sequence
  Synthetic polynucleotide
atcttcgtgtccacgccagcgctccyagtggccatgcacgtggcctaccgg

SEQ ID NO: 1618 - DNA, 51 bp, Artificial Sequence
  Synthetic polynucleotide
aagtgtgaagtcattggggagcccaygccaacaatccactggcagaagaac

SEQ ID NO: 1619 - DNA, 51 bp, Artificial Sequence
  Synthetic polynucleotide
gagtgaaaacctctactccatcgccygcgacaagccacagcaggtgcgcaa

SEQ ID NO: 1620 - DNA, 51 bp, Artificial Sequence
  Synthetic polynucleotide
ctggtcatcctggttcccctgtaaghatagccattggtggtgttttcttcc

SEQ ID NO: 1621 - DNA, 51 bp, Artificial Sequence
  Synthetic polynucleotide
gttggacttggccctggaccaatggyatgcttatctgtttatcttagccaa

SEQ ID NO: 1622 - DNA, 51 bp, Artificial Sequence
  Synthetic polynucleotide
ttgcaaggtctgcctggtatcgctgyaagtaaactgtagccatctcgcaca

SEQ ID NO: 1623 - DNA, 51 bp, Artificial Sequence
  Synthetic polynucleotide
ttcgacgttggccctgtctgcttccygtaaactccctccatcccaacctgg

SEQ ID NO: 1624 - DNA, 51 bp, Artificial Sequence
  Synthetic polynucleotide
aaagggactcatgtttgggtaggccygtataagaatggcacccctgtaatg

SEQ ID NO: 1625 - DNA, 51 bp, Artificial Sequence
  Synthetic polynucleotide
tgacccaaggactggaatctttactygtcagataccaggaatatactattt

SEQ ID NO: 1626 - DNA, 51 bp, Artificial Sequence
  Synthetic polynucleotide
cgatctcacagaaaatgaccaggtgyggctccagcttcccaatgccgagtc

SEQ ID NO: 1627 - DNA, 51 bp, Artificial Sequence
  Synthetic polynucleotide
atactcctctgagtatgtccactccyctttctcaggattcctagtggctcc

SEQ ID NO: 1628 - DNA, 51 bp, Artificial Sequence
  Synthetic polynucleotide
tcagataccaggaatatactattttycataccacgtgcatgtgaaagggac

SEQ ID NO: 1629 - DNA, 51 bp, Artificial Sequence
  Synthetic polynucleotide
atgtatctcaacaaccgcctggcccygcctgtcaactccagccctgccgtg

SEQ ID NO: 1630 - DNA, 51 bp, Artificial Sequence
  Synthetic polynucleotide
atcatgccggagcctgagcacgtcabcgtagcctgctgcaatcaggtaagc

SEQ ID NO: 1631 - DNA, 51 bp, Artificial Sequence
  Synthetic polynucleotide
gatctgttcactcagttgagaaagayagtcaaaatggcttccaacgaggac

SEQ ID NO: 1632 - DNA, 51 bp, Artificial Sequence
  Synthetic polynucleotide
tgccaagatgacgataaacccaattyatgagcacgtaggatacacaacctt

SEQ ID NO: 1633 - DNA, 51 bp, Artificial Sequence
  Synthetic polynucleotide
ttctggtgccactaccacagctcctbctctgagtggtaaaggcaatcctga

SEQ ID NO: 1634 - DNA, 51 bp, Artificial Sequence
  Synthetic polynucleotide
acatatattttctttttcagttcttycgggaggaccattgcctcaagggca

SEQ ID NO: 1635 - DNA, 51 bp, Artificial Sequence
  Synthetic polynucleotide
ccttctgggaaggtggtcatcacacygttcaggtattgggatggtggctgg

SEQ ID NO: 1636 - DNA, 51 bp, Artificial Sequence
  Synthetic polynucleotide
ctttggactctggggtttcaacagcyctctggcctgcattgcaatgggagg

SEQ ID NO: 1637 - DNA, 51 bp, Artificial Sequence
  Synthetic polynucleotide
gacacactgccaccagcacaaatacygcgaccccagtgcgtgcgctgttgg

SEQ ID NO: 1638 - DNA, 51 bp, Artificial Sequence
  Synthetic polynucleotide
agtgtgcggctcccccacaggcctgyccatcctcatggagcccatcctgtc

SEQ ID NO: 1639 - DNA, 51 bp, Artificial Sequence
  Synthetic polynucleotide
gggtagtggcagcgacacactgcgaygcctggccctggccactcatgacaa

SEQ ID NO: 1640 - DNA, 51 bp, Artificial Sequence
  Synthetic polynucleotide
tccccacaaatggctattggtgaatyttgactgttctgccatgtggtaagt

SEQ ID NO: 1641 - DNA, 51 bp, Artificial Sequence
  Synthetic polynucleotide
atacaaaaagtatgagaagtctgtgyaagtaatacaactttggaagattta

SEQ ID NO: 1642 - DNA, 51 bp, Artificial Sequence
  Synthetic polynucleotide
acccctggtgggcgccatcctgggcyccctcctctacaactacgtgctgtt

SEQ ID NO: 1643 - DNA, 51 bp, Artificial Sequence
  Synthetic polynucleotide
gctgggcgcggacatggaggacgtgygcggccgcctggtgcagtaccgcgg

SEQ ID NO: 1644 - DNA, 51 bp, Artificial Sequence
  Synthetic polynucleotide
tggcagagcggccagcgctgggaacyggcactgggtcgcttttgggattac

SEQ ID NO: 1645 - DNA, 51 bp, Artificial Sequence
  Synthetic polynucleotide
ctccagcctaaagctccttgacaacygggacagcgtgacctccaccttcag

SEQ ID NO: 1646 - DNA, 51 bp, Artificial Sequence
  Synthetic polynucleotide
ctgaggcaggagatgagcaaggatcyggaggaggtgaaggccaaggtgcag

SEQ ID NO: 1647 - DNA, 51 bp, Artificial Sequence
  Synthetic polynucleotide
tacagcgacgagctgcgccagcgctyggccgcgcgccttgaggctctcaag

SEQ ID NO: 1648 - DNA, 51 bp, Artificial Sequence
  Synthetic polynucleotide
aatatttctcatcattattgtaatayttctgatcatgttggtgatccatca

SEQ ID NO: 1649 - DNA, 51 bp, Artificial Sequence
  Synthetic polynucleotide
tgtcgatctgttcagccctgaaaagyccaaactcccaggtttgtctaggaa

SEQ ID NO: 1650 - DNA, 51 bp, Artificial Sequence
  Synthetic polynucleotide
gtttgacaccatatctgagaaaacayctgatcagatccacttcttctttgc

SEQ ID NO: 1651 - DNA, 51 bp, Artificial Sequence
  Synthetic polynucleotide
aaggtttatcttttgtccttgctgcycattggcttctgggactgcgtgacc

SEQ ID NO: 1652 - DNA, 51 bp, Artificial Sequence
  Synthetic polynucleotide
cagagcggccatcaacaaatgggtgyccaataagaccgaaggccgaatcac

SEQ ID NO: 1653 - DNA, 51 bp, Artificial Sequence
  Synthetic polynucleotide
ttttgctatgaccaagctgggtgccygtaatgacaccctccagcaactgat

SEQ ID NO: 1654 - DNA, 51 bp, Artificial Sequence
  Synthetic polynucleotide
gataagaatgtcatcttctccccacygagcatctccaccgccttggccttc

SEQ ID NO: 1655 - DNA, 51 bp, Artificial Sequence
  Synthetic polynucleotide
aatcagtatgtcaacgtgatgaacahgcttcttttcacactccctggaact

SEQ ID NO: 1656 - DNA, 51 bp, Artificial Sequence
  Synthetic polynucleotide
aatcgagcatgctattccagtgtacygaacatactgtatacctcgtgttag

SEQ ID NO: 1657 - DNA, 51 bp, Artificial Sequence
  Synthetic polynucleotide
cctgaatggactgcgtggctcatctyggctgtgatttcagtatatggtaaa

SEQ ID NO: 1658 - DNA, 51 bp, Artificial Sequence
  Synthetic polynucleotide
ttttatacccggaaggatgggcagcygtacgtatgagttttgttttattat

SEQ ID NO: 1659 - DNA, 51 bp, Artificial Sequence
  Synthetic polynucleotide
cttttctaggtcatccatgcctggcbtattatatcatctctattgttgctg

SEQ ID NO: 1660 - DNA, 51 bp, Artificial Sequence
  Synthetic polynucleotide
tatggcgccaagcatgtgatcatgcyctttgtccctgtgactctctgcatg

SEQ ID NO: 1661 - DNA, 51 bp, Artificial Sequence
  Synthetic polynucleotide
gccttcaaggacaagtacaagcagcycttcttagggggtgtggatcggcat

SEQ ID NO: 1662 - DNA, 51 bp, Artificial Sequence
  Synthetic polynucleotide
tggcaccacaccttctacaacgagcytcgcgtggctcccgaggagcacccc

SEQ ID NO: 1663 - DNA, 51 bp, Artificial Sequence
  Synthetic polynucleotide
aaggagaagctgtgctacgtggcccyggacttcgagaacgagatggcgacg

SEQ ID NO: 1664 - DNA, 51 bp, Artificial Sequence
  Synthetic polynucleotide
ctcaccctcccatccccaggaaccaygaacgctgcctgtgagctgctgggc

SEQ ID NO: 1665 - DNA, 51 bp, Artificial Sequence
  Synthetic polynucleotide
caccacttcccactccaggctgagcyggagattcagaaagacgccctggag

SEQ ID NO: 1666 - DNA, 51 bp, Artificial Sequence
  Synthetic polynucleotide
tacgacgagtcgggcccctccatcgyccaccgcaaatgcttctaaacggac

SEQ ID NO: 1667 - DNA, 51 bp, Artificial Sequence
  Synthetic polynucleotide
ccggctgaagtggaatgctgaagaayttggaaacatcagtgtcctgcgcct

SEQ ID NO: 1668 - DNA, 51 bp, Artificial Sequence
  Synthetic polynucleotide
gccctggccctcacactctccaaccycatctccctggtgagaggccctccg

SEQ ID NO: 1669 - DNA, 51 bp, Artificial Sequence
  Synthetic polynucleotide
ctctgtcttactgtctttgactgtgytccttctggtcatcgtggagctgat

SEQ ID NO: 1670 - DNA, 51 bp, Artificial Sequence
  Synthetic polynucleotide
ggagaaagagttttatggtgtgcttyaagagccctgcagaaaaagtaggta

SEQ ID NO: 1671 - DNA, 51 bp, Artificial Sequence
  Synthetic polynucleotide
agagggagctaggaggctagcatagraaggagaraaggaaaaagactttga

SEQ ID NO: 1672 - DNA, 51 bp, Artificial Sequence
  Synthetic polynucleotide
tataaagactgaggggcaaacagcasgggaaatgaggggcatagggataag

SEQ ID NO: 1673 - DNA, 51 bp, Artificial Sequence
  Synthetic polynucleotide
cgcagacagaagggctgggacggctrtcagcgcctgtgcttccaagrtaag

SEQ ID NO: 1674 - DNA, 51 bp, Artificial Sequence
  Synthetic polynucleotide
atcaggaagccttaccccacgcccaytgcctgcacaagcctcaggcctatg

SEQ ID NO: 1675 - DNA, 51 bp, Artificial Sequence
  Synthetic polynucleotide
caactgcctgggtgcctggatcaagygcggcagtgtgcagcagcatctctt

SEQ ID NO: 1676 - DNA, 51 bp, Artificial Sequence
  Synthetic polynucleotide
tgtccggaggaccacctttatgtccyagagcataatttgcatctactgatt

SEQ ID NO: 1677 - DNA, 51 bp, Artificial Sequence
  Synthetic polynucleotide
ctgtacaaacgctatgggggcttctygcggcgcattcgtcccaagctcaag

SEQ ID NO: 1678 - DNA, 51 bp, Artificial Sequence
  Synthetic polynucleotide
gtgaaggagaagatcacagcttttgyggtggagaggggcttcgggggcatt

SEQ ID NO: 1679 - DNA, 51 bp, Artificial Sequence
  Synthetic polynucleotide
ggagatttcattttctacagtgttcyggttggtaaagcctcagcaacagcc

SEQ ID NO: 1680 - DNA, 51 bp, Artificial Sequence
  Synthetic polynucleotide
ccacacttctgtgcccctgcaggagygctatttagcatcgaggtcacctcc

SEQ ID NO: 1681 - DNA, 51 bp, Artificial Sequence
  Synthetic polynucleotide
gttcggaactactggagaggattctytgcagccacgttcagcgcctttgtg

SEQ ID NO: 1682 - DNA, 51 bp, Artificial Sequence
  Synthetic polynucleotide
caatggagcggtgaatgggaaggggycactcaagggacagcccggagacat

SEQ ID NO: 1683 - DNA, 51 bp, Artificial Sequence
  Synthetic polynucleotide
agagagtgtgtggggtgatgagaaaycttccttcatctgcaacacactcca

SEQ ID NO: 1684 - DNA, 51 bp, Artificial Sequence
  Synthetic polynucleotide
atatccccgtttacacacaaattcarctgattcacctgttctcgaataaag

SEQ ID NO: 1685 - DNA, 51 bp, Artificial Sequence
  Synthetic polynucleotide
gaacttatcattgctgcttttgattaagatattggtcaaagagtacaaact

SEQ ID NO: 1686 - DNA, 51 bp, Artificial Sequence
  Synthetic polynucleotide
ttcagctataatatgaataagaacttggaatcaaacatagagatctagtga

SEQ ID NO: 1687 - DNA, 51 bp, Artificial Sequence
  Synthetic polynucleotide
ggggatgacagacaggtgcagggccrgcagctcgtagcacctgacagcctc

SEQ ID NO: 1688 - DNA, 51 bp, Artificial Sequence
  Synthetic polynucleotide
gctggggtagaggtcctgaaccaggrggatgagggcaagcaggtcggccgg

SEQ ID NO: 1689 - DNA, 51 bp, Artificial Sequence
  Synthetic polynucleotide
cctcttcaacatcggcctcctcctcytcctggtcatgttcatctactccat

SEQ ID NO: 1690 - DNA, 51 bp, Artificial Sequence
  Synthetic polynucleotide
accttcatgctgctcttcgtcctggbgtgtgagattgcagagggcatcctg

SEQ ID NO: 1691 - DNA, 51 bp, Artificial Sequence
  Synthetic polynucleotide
atcgagacttccaacttccccaagcygctaattggtaggtgaggtgtagga

SEQ ID NO: 1692 - DNA, 51 bp, Artificial Sequence
  Synthetic polynucleotide
ttcctgcagcccttcgtgaatctgcygtccaaaggcacctactggtggatg

SEQ ID NO: 1693 - DNA, 51 bp, Artificial Sequence
  Synthetic polynucleotide
attacttcataatatattgctgttaygtgttttaggccatgaccacaatgt

SEQ ID NO: 1694 - DNA, 51 bp, Artificial Sequence
  Synthetic polynucleotide
ccgtgcccgccagcggagggcccgcbttgtgtccaagaaaggcaactgcaa

SEQ ID NO: 1695 - DNA, 51 bp, Artificial Sequence
  Synthetic polynucleotide
gtgggtggcaacagcatcttcctggyggccccgctgatcatctaccatgtc

SEQ ID NO: 1696 - DNA, 51 bp, Artificial Sequence
  Synthetic polynucleotide
ggcagcagcctgagagatggctcgcyggagctcatggtgagtgggtcagag

SEQ ID NO: 1697 - DNA, 51 bp, Artificial Sequence
  Synthetic polynucleotide
gacttttcagctctttgtcctaaggyattttttgtttagttttcaatttgt

SEQ ID NO: 1698 - DNA, 51 bp, Artificial Sequence
  Synthetic polynucleotide
ctacgggggtgacgacatcccacttyctccttatcgcatccgagccacaca

SEQ ID NO: 1699 - DNA, 51 bp, Artificial Sequence
  Synthetic polynucleotide
ctccagtgaccgaacaattaaagaayatgcccaaaacatctggaacgtgga

SEQ ID NO: 1700 - DNA, 51 bp, Artificial Sequence
  Synthetic polynucleotide
ccttgctctgcgatggactattcccyggctgcagccctcactcttcatggt

SEQ ID NO: 1701 - DNA, 51 bp, Artificial Sequence
  Synthetic polynucleotide
taagtattgtgaaaactctgttttthtcaggtcgaatgagtgatttgagtg

SEQ ID NO: 1702 - DNA, 51 bp, Artificial Sequence
  Synthetic polynucleotide
tgagacctatgcagatgccctgtggyggggcctggtgagtcactaccttgg

SEQ ID NO: 1703 - DNA, 51 bp, Artificial Sequence
  Synthetic polynucleotide
tccaccccctgcagtgtcattggtcygagcttcgacttcgtggctctgaac

SEQ ID NO: 1704 - DNA, 51 bp, Artificial Sequence
  Synthetic polynucleotide
gaacgagtgtgccaccgagaaccccygcgtgcaaacctgcgtcaacaccta

SEQ ID NO: 1705 - DNA, 51 bp, Artificial Sequence
  Synthetic polynucleotide
tgatggttgtaagagtggaattaacygccctatccaaaaagacaagaccta

SEQ ID NO: 1706 - DNA, 51 bp, Artificial Sequence
  Synthetic polynucleotide
catggtaagtatattgtaaaatacayatgtactaagaattttcaaaattgg

SEQ ID NO: 1707 - DNA, 51 bp, Artificial Sequence
  Synthetic polynucleotide
ctcgtgggggatgttagcgtgcctgygcacggtgctctggcacctccctgc

SEQ ID NO: 1708 - DNA, 51 bp, Artificial Sequence
  Synthetic polynucleotide
cctgcacctgggggctcatggcttcygacttctgaccttctcctcttcgct

SEQ ID NO: 1709 - DNA, 51 bp, Artificial Sequence
  Synthetic polynucleotide
ctgccctttgccgagcgcctgcagcycctctctggacaccctcctgcctct

SEQ ID NO: 1710 - DNA, 51 bp, Artificial Sequence
  Synthetic polynucleotide
ccggggcgcctcccgccaggcaccayggtgcagaagtcgcgcaacggcggc

SEQ ID NO: 1711 - DNA, 51 bp, Artificial Sequence
  Synthetic polynucleotide
tgcatttcctttcttcccagagacaytgctgccagaaactgcctcttgacc

SEQ ID NO: 1712 - DNA, 51 bp, Artificial Sequence
  Synthetic polynucleotide
ttccttctccttttcctttaccagaygtgcagtatgtgaagctccagctgt

SEQ ID NO: 1713 - DNA, 51 bp, Artificial Sequence
  Synthetic polynucleotide
cttttcctttaccagatgtgcagtaygtgaagctccagctgtggtgatcgc

SEQ ID NO: 1714 - DNA, 51 bp, Artificial Sequence
  Synthetic polynucleotide
cagtcagacgatccagattccccatygtcctcagggatgggattctctgtg

SEQ ID NO: 1715 - DNA, 51 bp, Artificial Sequence
  Synthetic polynucleotide
taagaagcttaaacttcaaacagctyctatccaagcactgtgttccccctc

SEQ ID NO: 1716 - DNA, 51 bp, Artificial Sequence
  Synthetic polynucleotide
agacttgaggacacgaattagccgaygtcaagtgtgcatgaagaggacata

SEQ ID NO: 1717 - DNA, 51 bp, Artificial Sequence
  Synthetic polynucleotide
atttcctatagctcctgagtattggygttccattgcttactttgaaatgga

SEQ ID NO: 1718 - DNA, 51 bp, Artificial Sequence
  Synthetic polynucleotide
ggacccttctggaggagatcgctttygtttgggtcaactctccaatgtcca

SEQ ID NO: 1719 - DNA, 51 bp, Artificial Sequence
  Synthetic polynucleotide
attgaaattcacttacaccgggcccbccagctcctagacgaagtacttcat

SEQ ID NO: 1720 - DNA, 51 bp, Artificial Sequence
  Synthetic polynucleotide
  misc_feature (26)..(26): n is a, c, g, t or u
taaagctggctatggcacctgcaacngcttccctgaggaggagaagtgctt

SEQ ID NO: 1721 - DNA, 51 bp, Artificial Sequence
  Synthetic polynucleotide
accacccccacccacagatccactgygcgacgagctgtgccgcacggtgat

SEQ ID NO: 1722 - DNA, 51 bp, Artificial Sequence
  Synthetic polynucleotide
gctctcatcagccgccaagaggcctyggagctcatgaaccagaaccttgac

SEQ ID NO: 1723 - DNA, 51 bp, Artificial Sequence
  Synthetic polynucleotide
gaacccatgcctggagcctcaccgcytcaatgacacagaggtgattcctgc

SEQ ID NO: 1724 - DNA, 51 bp, Artificial Sequence
  Synthetic polynucleotide
tttggcatcttcacatgctttgatayattgttctttgaccctgccatcaga

SEQ ID NO: 1725 - DNA, 51 bp, Artificial Sequence
  Synthetic polynucleotide
gatatattgttctttgaccctgccaycagagtcctcagagactacaaggtg

SEQ ID NO: 1726 - DNA, 51 bp, Artificial Sequence
  Synthetic polynucleotide
actgcctggatgaaccagctcccacycttggcagcaattgagattcagaaa

SEQ ID NO: 1727 - DNA, 51 bp, Artificial Sequence
  Synthetic polynucleotide
ccatagtaagtttttaaaaattttgycaggcgatccgtactgtgagaagga

SEQ ID NO: 1728 - DNA, 51 bp, Artificial Sequence
  Synthetic polynucleotide
gagatgatgtatgacaatttcacccyggtccctgtctggggaaaggaaggc

SEQ ID NO: 1729 - DNA, 51 bp, Artificial Sequence
  Synthetic polynucleotide
gggaaaggaaggctatctccacgtcygttccaatggcctctgctgttattt

SEQ ID NO: 1730 - DNA, 51 bp, Artificial Sequence
  Synthetic polynucleotide
tctccacgtctgttccaatggcctcygctgttatttactttacgagaggcc

SEQ ID NO: 1731 - DNA, 51 bp, Artificial Sequence
  Synthetic polynucleotide
cacggggatatttgagtttcacctgyggggcaacttcagtacttcctatat

SEQ ID NO: 1732 - DNA, 51 bp, Artificial Sequence
  Synthetic polynucleotide
tccttgtcggtaggtgaatccccagbacgatagcaccttcctgtttgacaa

SEQ ID NO: 1733 - DNA, 51 bp, Artificial Sequence
  Synthetic polynucleotide
tgcagcctgatgcccccagtccaggyaacctggctccaactgctgctgggg

SEQ ID NO: 1734 - DNA, 51 bp, Artificial Sequence
  Synthetic polynucleotide
gatactcctttacctcaggacccagygatcatccccttttccaagcaaagt

SEQ ID NO: 1735 - DNA, 51 bp, Artificial Sequence
  Synthetic polynucleotide
tcaggacccagtgatcatcccctttyccaagcaaagtctgctcgaggagtc

SEQ ID NO: 1736 - DNA, 51 bp, Artificial Sequence
  Synthetic polynucleotide
ttccaagcaaagtctgctcgaggagyctggtaactatggatttcccctctt

SEQ ID NO: 1737 - DNA, 51 bp, Artificial Sequence
  Synthetic polynucleotide
tggtcggatgtaacgctgccactcahgtcggtccctgagatccgggctgtt

SEQ ID NO: 1738 - DNA, 51 bp, Artificial Sequence
  Synthetic polynucleotide
tcggtccctgagatccgggctgttgytgatgcatgggcctcagtcacagag

SEQ ID NO: 1739 - DNA, 51 bp, Artificial Sequence
  Synthetic polynucleotide
tgagatccgggctgttgttgatgcabgggcctcagtcacagaggagctggg

SEQ ID NO: 1740 - DNA, 51 bp, Artificial Sequence
  Synthetic polynucleotide
gcatgggcctcagtcacagaggagcygggtgcccagtacccttgggtgcag

SEQ ID NO: 1741 - DNA, 51 bp, Artificial Sequence
  Synthetic polynucleotide
agaggagctgggtgcccagtaccctygggtgcaggtttgtgaggtcgcccc

SEQ ID NO: 1742 - DNA, 51 bp, Artificial Sequence
  Synthetic polynucleotide
ggtgcccagtacccttgggtgcaggyttgtgaggtcgccccttcccctgga

SEQ ID NO: 1743 - DNA, 51 bp, Artificial Sequence
  Synthetic polynucleotide
gagctccgtatccctatctgatagahctttgaaaacaaaggtgccatgatg

SEQ ID NO: 1744 - DNA, 51 bp, Artificial Sequence
  Synthetic polynucleotide
tgacaggtatgggccagcagtttccygccagatattgcccagcgtgaggag

SEQ ID NO: 1745 - DNA, 51 bp, Artificial Sequence
  Synthetic polynucleotide
tataagagtcagcatggagagccccygctaatggagtacagccgccaggag

SEQ ID NO: 1746 - DNA, 51 bp, Artificial Sequence
  Synthetic polynucleotide
ctaatggagtacagccgccaggagcyactcaggaaggtgggagagagccaa

SEQ ID NO: 1747 - DNA, 51 bp, Artificial Sequence
  Synthetic polynucleotide
agccgccaggagctactcaggaaggygggagagagccaagccctgtgtccc

SEQ ID NO: 1748 - DNA, 51 bp, Artificial Sequence
  Synthetic polynucleotide
agtactggtccccttctgggcaacayggccctaccagacactgctgctgcc

SEQ ID NO: 1749 - DNA, 51 bp, Artificial Sequence
  Synthetic polynucleotide
ccattggcagctgcacgctcattacbaccctccgctcctgcgctctgccac

SEQ ID NO: 1750 - DNA, 51 bp, Artificial Sequence
  Synthetic polynucleotide
cacgctcattactaccctccgctccygcgctctgccactgtccggaaattc

SEQ ID NO: 1751 - DNA, 51 bp, Artificial Sequence
  Synthetic polynucleotide
ggacagggagacagcaaccatcgccygaccacgccgaccacagggccttga

SEQ ID NO: 1752 - DNA, 51 bp, Artificial Sequence
  Synthetic polynucleotide
agaagagggcttcgtggagttgaagyctcccgcggtgagcggcgggctcgg

SEQ ID NO: 1753 - DNA, 51 bp, Artificial Sequence
  Synthetic polynucleotide
catcaagtcttccttggtgaacgagyctgaaatcatcccggccagcaacgg

SEQ ID NO: 1754 - DNA, 51 bp, Artificial Sequence
  Synthetic polynucleotide
gggtgactccgggggcccgctggtgygcgggggcgtgctcgagggcgtggt

SEQ ID NO: 1755 - DNA, 51 bp, Artificial Sequence
  Synthetic polynucleotide
cccaacgtggatgagcattctgttaygacctacctgtcccagttccccaag

SEQ ID NO: 1756 - DNA, 51 bp, Artificial Sequence
  Synthetic polynucleotide
atttttggggagcgccaggggatgcyggaggaagtagtgaaccccgaggcc

SEQ ID NO: 1757 - DNA, 51 bp, Artificial Sequence
  Synthetic polynucleotide
ataataatgatggttgccaacatgcgctgagtgcttaaaatgtgccaggta

SEQ ID NO: 1758 - DNA, 51 bp, Artificial Sequence
  Synthetic polynucleotide
ataaataggtaaagggctttagaattgtgcaccatactcacaaccaccctg

SEQ ID NO: 1759 - DNA, 51 bp, Artificial Sequence
  Synthetic polynucleotide
cgcagcagattctgttattaaaccccttttacagacgaagttgaggctcac

SEQ ID NO: 1760 - DNA, 51 bp, Artificial Sequence
  Synthetic polynucleotide
agagattatgtaactcactcaagacaacacagataaaagatgaaactgaat

SEQ ID NO: 1761 - DNA, 51 bp, Artificial Sequence
  Synthetic polynucleotide
acaaattctacttactcctttgggtraagcatattcacccagaactgttgc

SEQ ID NO: 1762 - DNA, 51 bp, Artificial Sequence
  Synthetic polynucleotide
caacggggaccctgtctgcaacgccygtggcctctactacaagctgcacaa

SEQ ID NO: 1763 - DNA, 51 bp, Artificial Sequence
  Synthetic polynucleotide
caggaacttcacaacttattggaggyaataactttgtaagtggaacttact

SEQ ID NO: 1764 - DNA, 51 bp, Artificial Sequence
  Synthetic polynucleotide
gggcggcccctccatcaaggacaagbatgtgacggcgctctacttcacctt

SEQ ID NO: 1765 - DNA, 51 bp, Artificial Sequence
  Synthetic polynucleotide
ggaggaagaaccccaggtggacgtaygggagttgctgaagaacgcgaaacc

SEQ ID NO: 1766 - DNA, 51 bp, Artificial Sequence
  Synthetic polynucleotide
cattccaagacacctgaagcaaaccyatatccgcagagttggagaagctgt

SEQ ID NO: 1767 - DNA, 51 bp, Artificial Sequence
  Synthetic polynucleotide
aaactggtgaaggatggataccaaayggcccagcctgcatttgccccaaag

SEQ ID NO: 1768 - DNA, 51 bp, Artificial Sequence
  Synthetic polynucleotide
ttgaccaatggtcatgtggccaagaytggggacttcgggctggctagggac

SEQ ID NO: 1769 - DNA, 51 bp, Artificial Sequence
  Synthetic polynucleotide
gccgcgggactggctctggggcggcygcggcgacaacatcgactatggcta

SEQ ID NO: 1770 - DNA, 51 bp, Artificial Sequence
  Synthetic polynucleotide
ctccacattccaactatgtaaaatabgtgctgaaaatgataaggatgtaaa

SEQ ID NO: 1771 - DNA, 51 bp, Artificial Sequence
  Synthetic polynucleotide
tgataaggatgtaaagattgagcccygtggacacctcatgtgcacatcctg

SEQ ID NO: 1772 - DNA, 51 bp, Artificial Sequence
  Synthetic polynucleotide
cagctgcaggctttggagcgtgtctytgagcggacacactatcctgatgct

SEQ ID NO: 1773 - DNA, 51 bp, Artificial Sequence
  Synthetic polynucleotide
gcggcggccagggaggactacgtgcyggtggctggccactaccccgtgtgg

SEQ ID NO: 1774 - DNA, 51 bp, Artificial Sequence
  Synthetic polynucleotide
ggctccccaacctgaagttaggagayatgtacttcctttgaatattgacaa

SEQ ID NO: 1775 - DNA, 51 bp, Artificial Sequence
  Synthetic polynucleotide
tgagaacaatccagaaaggaaccacyggcattatcgagacctggaagctat

SEQ ID NO: 1776 - DNA, 51 bp, Artificial Sequence
  Synthetic polynucleotide
catcctcaaacgaaacatccagcagyacaacagttttgtgtcactgtctgt

SEQ ID NO: 1777 - DNA, 51 bp, Artificial Sequence
  Synthetic polynucleotide
ccatctttgctttctccaggtgaaaytgcactactgatgaatcgtcctcgt

SEQ ID NO: 1778 - DNA, 51 bp, Artificial Sequence
  Synthetic polynucleotide
gaaatactacttctaccatggccttycctggccccaggtgggcagcttctg

SEQ ID NO: 1779 - DNA, 51 bp, Artificial Sequence
  Synthetic polynucleotide
gtgtttgaagagttttgtcgggagaytggtgtgcgcaacatccgggagttt

SEQ ID NO: 1780 - DNA, 51 bp, Artificial Sequence
  Synthetic polynucleotide
cgacccagatctgcggagtctgttcyccagggcaggaatcagcgaggccca

SEQ ID NO: 1781 - DNA, 51 bp, Artificial Sequence
  Synthetic polynucleotide
acctctaaacttatctacgacttcaytgaggaccagggtgggctggaggct

SEQ ID NO: 1782 - DNA, 51 bp, Artificial Sequence
  Synthetic polynucleotide
ttggtgcaactccaaataaaagtaayaaccatgcacactactataaccacc

SEQ ID NO: 1783 - DNA, 51 bp, Artificial Sequence
  Synthetic polynucleotide
tcgaatttgcaattcaatatgaaaaycacctcggagctggtaaaaagaggc

SEQ ID NO: 1784 - DNA, 51 bp, Artificial Sequence
  Synthetic polynucleotide
gacaacagaggcttacgaccccttayttaccgagaaagctcacaagaactg

SEQ ID NO: 1785 - DNA, 51 bp, Artificial Sequence
  Synthetic polynucleotide
ggagatgacttgattgtgactccatbtgctcaggtaagcacagcttggtga

SEQ ID NO: 1786 - DNA, 51 bp, Artificial Sequence
  Synthetic polynucleotide
gttacccgtggtgcctcacgctgagygcaaaactagctatgagtcccgctc

SEQ ID NO: 1787 - DNA, 51 bp, Artificial Sequence
  Synthetic polynucleotide
tttacaagatgaatatgacttcaaaygcaaaaccttgcagaacagaggtaa

SEQ ID NO: 1788 - DNA, 51 bp, Artificial Sequence
  Synthetic polynucleotide
tgctgtgagagccattggaagactgycctctatggcaatgatctcagggct

SEQ ID NO: 1789 - DNA, 51 bp, Artificial Sequence
  Synthetic polynucleotide
tcacccgtggtggtggcctcgtcgcyagggctcgtgtcgctgggcggcaag

SEQ ID NO: 1790 - DNA, 51 bp, Artificial Sequence
  Synthetic polynucleotide
gaggaacgaatgatcagggagaaacbgaaggcaacctgtatgccagcctgg

SEQ ID NO: 1791 - DNA, 51 bp, Artificial Sequence
  Synthetic polynucleotide
gttgatgaccttcgtcgcttatgcayactcaggatgagttttgtgaaaggc

SEQ ID NO: 1792 - DNA, 51 bp, Artificial Sequence
  Synthetic polynucleotide
ctgttgctcacagctgtggaccttcygggccgggaccgtgatgggctgggt

SEQ ID NO: 1793 - DNA, 51 bp, Artificial Sequence
  Synthetic polynucleotide
aagaaacgtgctcgagtacagtggtytgtccgattctgtgaagtccctgcc

SEQ ID NO: 1794 - DNA, 51 bp, Artificial Sequence
  Synthetic polynucleotide
ctcggctgtcctggctctgcaggagygtgaccactcccagacagactccct

SEQ ID NO: 1795 - DNA, 51 bp, Artificial Sequence
  Synthetic polynucleotide
ctgtggtggttattgctctgtgttayaaactctgggaaattccatctcttg

SEQ ID NO: 1796 - DNA, 51 bp, Artificial Sequence
  Synthetic polynucleotide
tggtgtaatggagtgatagtacgttdgtggaaagatgaagaatggacattc

SEQ ID NO: 1797 - DNA, 51 bp, Artificial Sequence
  Synthetic polynucleotide
ctgcagcgagtgctctaccgccacaygcaggccaagggcgtgctgctgact

SEQ ID NO: 1798 - DNA, 51 bp, Artificial Sequence
  Synthetic polynucleotide
gagatttcttttaagcaacaacagtrcaaaaccactgcaggtatgtaaatc

SEQ ID NO: 1799 - DNA, 51 bp, Artificial Sequence
  Synthetic polynucleotide
ttgcctctctgccttccaggtcttcyccaagatcttcagccacgaggccct

SEQ ID NO: 1800 - DNA, 51 bp, Artificial Sequence
  Synthetic polynucleotide
gttcaccaacggcatgcgccatggcyacggagtacgccagagcgtgcccta

SEQ ID NO: 1801 - DNA, 51 bp, Artificial Sequence
  Synthetic polynucleotide
ccccagcgttttgggtgctccggggrtgacaccagtaagggttcagcagtg

SEQ ID NO: 1802 - DNA, 51 bp, Artificial Sequence
  Synthetic polynucleotide
ctttatctgcataataaccagcttcyagctggagggctgcatgcagggaag

SEQ ID NO: 1803 - DNA, 51 bp, Artificial Sequence
  Synthetic polynucleotide
cagagacatcatgttggaagaattaycccatctcagtaaccgtggtgccag

SEQ ID NO: 1804 - DNA, 51 bp, Artificial Sequence
  Synthetic polynucleotide
ccaataattttcaaggaagaaaatcytagggtaaggtgacttaggttttat

SEQ ID NO: 1805 - DNA, 51 bp, Artificial Sequence
  Synthetic polynucleotide
ttgtcctatccctcctccagggcccygcactcagaagggaagttacctaaa

SEQ ID NO: 1806 - DNA, 51 bp, Artificial Sequence
  Synthetic polynucleotide
attttgttctttctatttgaagctcytttaagagcctgtgccgatggaggt

SEQ ID NO: 1807 - DNA, 51 bp, Artificial Sequence
  Synthetic polynucleotide
tgtcccttctcactgaccatctctcycaacagctccaattatgctttcatg

SEQ ID NO: 1808 - DNA, 51 bp, Artificial Sequence
  Synthetic polynucleotide
cccattcttccatttgctccgcagcyggtattccctctcgagtggtttcca

SEQ ID NO: 1809 - DNA, 51 bp, Artificial Sequence
  Synthetic polynucleotide
tttgtgaggtccagcacctacagccygatccccatcactgtggccgaggca

SEQ ID NO: 1810 - DNA, 51 bp, Artificial Sequence
  Synthetic polynucleotide
ctggtggcccaggtggatagtggccyctaccctgggctcatctggctacac

SEQ ID NO: 1811 - DNA, 51 bp, Artificial Sequence
  Synthetic polynucleotide
ggaaatgttggcatagtgatgtcctyggaacaaataaaggtaaacagcatg

SEQ ID NO: 1812 - DNA, 51 bp, Artificial Sequence
  Synthetic polynucleotide
tttattttttagcgtattttctcacygctagaaaagacttggcttggcgca

SEQ ID NO: 1813 - DNA, 51 bp, Artificial Sequence
  Synthetic polynucleotide
aagtaaaaaataccagtctgatatgyactgggcacagtcacaagatggact

SEQ ID NO: 1814 - DNA, 51 bp, Artificial Sequence
  Synthetic polynucleotide
gtagtcctcaaggtttataagaatgwgagtcatggagcaacaggtcctctt

SEQ ID NO: 1815 - DNA, 51 bp, Artificial Sequence
  Synthetic polynucleotide
gagctggacagctggattgacaagtyttgtctggatgctgatgtgtttgtg

SEQ ID NO: 1816 - DNA, 51 bp, Artificial Sequence
  Synthetic polynucleotide
gtaaactcaattgcaattgtgttacytttattatttggatgaatatcagtg

SEQ ID NO: 1817 - DNA, 51 bp, Artificial Sequence
  Synthetic polynucleotide
ttcgagcttctcagtatatttagtcrtactgttacctaaaaagaaaataag

SEQ ID NO: 1818 - DNA, 51 bp, Artificial Sequence
  Synthetic polynucleotide
cctgctgcagctcacctgcgtcagcygcgtgcgcgccgtcatgaactcgcg

SEQ ID NO: 1819 - DNA, 51 bp, Artificial Sequence
  Synthetic polynucleotide
agcaaccagggctacgtgcgccagcyctcccagggtgagccgcagtgtggg

SEQ ID NO: 1820 - DNA, 51 bp, Artificial Sequence
  Synthetic polynucleotide
ggcgcgctgagcaacgcggtcttccycaccgcgctctgcttcaccatcttc

SEQ ID NO: 1821 - DNA, 51 bp, Artificial Sequence
  Synthetic polynucleotide
cagtccatttgaatttggcttcacaytccgtaacccagatgatgtcttcag

SEQ ID NO: 1822 - DNA, 51 bp, Artificial Sequence
  Synthetic polynucleotide
caaaagaattatctttgctatgaccyggctgagctcttattaaaattgaaa

SEQ ID NO: 1823 - DNA, 51 bp, Artificial Sequence
  Synthetic polynucleotide
tgactgcgaccacatttctgggcagygtacttgccgcactggattcatggg

SEQ ID NO: 1824 - DNA, 51 bp, Artificial Sequence
  Synthetic polynucleotide
cgttctctgtgctgagacctgccagygtgtcaacggagggaagtgttacca

SEQ ID NO: 1825 - DNA, 51 bp, Artificial Sequence
  Synthetic polynucleotide
gaagcgctacgcggacgcccagctgycctgccagggccgcgggggcacgct

SEQ ID NO: 1826 - DNA, 51 bp, Artificial Sequence
  Synthetic polynucleotide
gccccagaagaacccgtgtgaacatrctgtcctttggccgcctggcagtta

SEQ ID NO: 1827 - DNA, 51 bp, Artificial Sequence
  Synthetic polynucleotide
ccttctatcataatacagagcccagrgcagagtaatggtgagaatcatggc

SEQ ID NO: 1828 - DNA, 51 bp, Artificial Sequence
  Synthetic polynucleotide
ctccttgcccaggccgcccacgtacrgacgctcgtccttcactgccagcca

SEQ ID NO: 1829 - DNA, 51 bp, Artificial Sequence
  Synthetic polynucleotide
tggcatgtacgtagtaggcatccagyggaaccacatgggcagcgtgttagc

SEQ ID NO: 1830 - DNA, 51 bp, Artificial Sequence
  Synthetic polynucleotide
tcaacagtactgcctgggggctgccycgcctgtgacaaccatgccctccag

SEQ ID NO: 1831 - DNA, 51 bp, Artificial Sequence
  Synthetic polynucleotide
agggcccaggtcagaatgaggacctrccggccaggtgagaagggcacgtgc

SEQ ID NO: 1832 - DNA, 51 bp, Artificial Sequence
  Synthetic polynucleotide
attgcagtccatgtagtcagagtgcygacctgcatcatgagtgactccccc

SEQ ID NO: 1833 - DNA, 51 bp, Artificial Sequence
  Synthetic polynucleotide
gctggcagctcggccccgccgccgcyattaccccggccagggcctggggct

SEQ ID NO: 1834 - DNA, 51 bp, Artificial Sequence
  Synthetic polynucleotide
gcttaccgcccccctcccttccagaytgtggatccgctggcccggggccgg

SEQ ID NO: 1835 - DNA, 51 bp, Artificial Sequence
  Synthetic polynucleotide
ggctctgtggatggacggcacctgcygcggaccctgtcccgagcgaagttc

SEQ ID NO: 1836 - DNA, 51 bp, Artificial Sequence
  Synthetic polynucleotide
gaaaatgaaggaactgaagaaaattygcaagtatgtcttagggttcagtaa

SEQ ID NO: 1837 - DNA, 51 bp, Artificial Sequence
  Synthetic polynucleotide
ttgtttcctcagtctataccaaaacycacctttcctggtggtttactaatt

SEQ ID NO: 1838 - DNA, 51 bp, Artificial Sequence
  Synthetic polynucleotide
ctcatcgagtacctcatccaccgctycctgttccacatgaagccccccagc

SEQ ID NO: 1839 - DNA, 51 bp, Artificial Sequence
  Synthetic polynucleotide
aaaataaacattccatttgatgaatyaaagaattatttgtctgaagcaaca

SEQ ID NO: 1840 - DNA, 51 bp, Artificial Sequence
  Synthetic polynucleotide
tcggctcagaaacactaaatacaaayctgctccggctgctgaaaagaaagt

SEQ ID NO: 1841 - DNA, 51 bp, Artificial Sequence
  Synthetic polynucleotide
agtatttggaatgaatggaagaataygggttaaggcaaaaaccatccagca

SEQ ID NO: 1842 - DNA, 51 bp, Artificial Sequence
  Synthetic polynucleotide
caggtggcccgtaagctggtcatcaytgagagcgacctggaacgtgcagag

SEQ ID NO: 1843 - DNA, 51 bp, Artificial Sequence
  Synthetic polynucleotide
gagctggaccacgctctcaacgataygacttccatgtaaacgttcatccac

SEQ ID NO: 1844 - DNA, 51 bp, Artificial Sequence
  Synthetic polynucleotide
ggagtacagtgcaatgagggaccagyacatgaggactggggagggctttct

SEQ ID NO: 1845 - DNA, 51 bp, Artificial Sequence
  Synthetic polynucleotide
tttttctttgttttttaaggaacacygtccattggcatggggaaatataaa

SEQ ID NO: 1846 - DNA, 51 bp, Artificial Sequence
  Synthetic polynucleotide
tgaatctatcagtttgcttgagttaygtcgaaatacgaacagaaaacaagc

SEQ ID NO: 1847 - DNA, 51 bp, Artificial Sequence
  Synthetic polynucleotide
attaagtcagatgcggccatgactgycgctgtaaagatgctcaagcgtaag

SEQ ID NO: 1848 - DNA, 51 bp, Artificial Sequence
  Synthetic polynucleotide
cgcgcgctgtcgcccgcagatttctycgccaagcgcaagagatcagcgcct

SEQ ID NO: 1849 - DNA, 51 bp, Artificial Sequence
  Synthetic polynucleotide
agactattggctggccacatggacaycggagtacagtataaacaatactgg

SEQ ID NO: 1850 - DNA, 51 bp, Artificial Sequence
  Synthetic polynucleotide
atgcctggtcagcttaatgtgctgcyggctgaggctggtgtgccatatgac

SEQ ID NO: 1851 - DNA, 51 bp, Artificial Sequence
  Synthetic polynucleotide
gtgctgctgcggcggtgccagcagcygcaggagcacctgggcctggccgag

SEQ ID NO: 1852 - DNA, 51 bp, Artificial Sequence
  Synthetic polynucleotide
gatgggttttatttccagacttcacytctaatggtgattatgggagaactg

SEQ ID NO: 1853 - DNA, 51 bp, Artificial Sequence
  Synthetic polynucleotide
  misc_feature (26)..(26): n is a, c, g, t or u
cactagcaacctcaaacagacaccanggtgcatctgactcctgaggagaag

SEQ ID NO: 1854 - DNA, 51 bp, Artificial Sequence
  Synthetic polynucleotide
ccttgagcatctggattctgcctaahaaaaaacatttattttcattgcaat

SEQ ID NO: 1855 - DNA, 51 bp, Artificial Sequence
  Synthetic polynucleotide
  misc_feature (26)..(26): n is a, c, g, t or u
agttggtggtgaggccctgggcaggntggtatcaaggttacaagacaggtt

SEQ ID NO: 1856 - DNA, 51 bp, Artificial Sequence
  Synthetic polynucleotide
accacatatgcacacatatctccagygatcccctgggctccagagaaccta

SEQ ID NO: 1857 - DNA, 51 bp, Artificial Sequence
  Synthetic polynucleotide
gctgtggttggggcctgccaggcccygggtctccgggatgtccacctcgcc

SEQ ID NO: 1858 - DNA, 51 bp, Artificial Sequence
  Synthetic polynucleotide
ccgccatcgtaggcaggcggctcccvctgtactgtgcaggagtcctctccc

SEQ ID NO: 1859 - DNA, 51 bp, Artificial Sequence
  Synthetic polynucleotide
gaggagcgggcggtgaaggacgagcygctgggcgagaagcccgagatcaag

SEQ ID NO: 1860 - DNA, 51 bp, Artificial Sequence
  Synthetic polynucleotide
cctcctccagcgctagtcctgctgaygggcaaagaaggtgtccacggtggt

SEQ ID NO: 1861 - DNA, 51 bp, Artificial Sequence
  Synthetic polynucleotide
cttgcaggtgcccatcagaagcgacygatccccatcaagtacaaggcaatg

SEQ ID NO: 1862 - DNA, 51 bp, Artificial Sequence
  Synthetic polynucleotide
gccagtgatgacaagactgttaagcygtgggacaagagcagccgggaatgt

SEQ ID NO: 1863 - DNA, 51 bp, Artificial Sequence
  Synthetic polynucleotide
cccccgaaactccttgaccctgcccyccatccccgcaggcatcagcaacat

SEQ ID NO: 1864 - DNA, 51 bp, Artificial Sequence
  Synthetic polynucleotide
ctcctccgcctaggtccctgccatcycactggcgtacgaggctgccgaaag

SEQ ID NO: 1865 - DNA, 51 bp, Artificial Sequence
  Synthetic polynucleotide
gagaaacactgcagaagctaagacayaggaattctacagcatgatatttca

SEQ ID NO: 1866 - DNA, 51 bp, Artificial Sequence
  Synthetic polynucleotide
acacttaatgattgttggcaagaaaygtgctgctgatctgggcctgaataa

SEQ ID NO: 1867 - DNA, 51 bp, Artificial Sequence
  Synthetic polynucleotide
ttccacccctggtcggatgtaacgcygccactcatgtcggtccctgagatc

SEQ ID NO: 1868 - DNA, 51 bp, Artificial Sequence
  Synthetic polynucleotide
ctcccgtcaccacccagtaaggtcaygtgcttccacccctggtcggatgta

SEQ ID NO: 1869 - DNA, 51 bp, Artificial Sequence
  Synthetic polynucleotide
atggagtacagccgccaggagctacycaggaaggtgggagagagccaagcc

SEQ ID NO: 1870 - DNA, 51 bp, Artificial Sequence
  Synthetic polynucleotide
gcctgaccccagaagaatttgtgagbgtatccatatgtatctccctaatga

SEQ ID NO: 1871 - DNA, 51 bp, Artificial Sequence
  Synthetic polynucleotide
ctactcatgttgttatgaaaacaggyataccaagaacctttacagaatacc

SEQ ID NO: 1872 - DNA, 51 bp, Artificial Sequence
  Synthetic polynucleotide
ggtttctttcagcatgattttgaagbcagaggagatgtggtcaatggaaga

SEQ ID NO: 1873 - DNA, 51 bp, Artificial Sequence
  Synthetic polynucleotide
tgaagccctgttgaggggagaacttrccacaaagccacagcccagggacac

SEQ ID NO: 1874 - DNA, 51 bp, Artificial Sequence
  Synthetic polynucleotide
gaggagaattctgtcccctaccaggygtccctgaattctggctaccacttc

SEQ ID NO: 1875 - DNA, 51 bp, Artificial Sequence
  Synthetic polynucleotide
gattttcttctctttatctgctgcayggggaggcctgatcactctctcttc

SEQ ID NO: 1876 - DNA, 51 bp, Artificial Sequence
  Synthetic polynucleotide
ttctccagccaagtagcccagggcayggccttcctcgcttccaagaatgtg

SEQ ID NO: 1877 - DNA, 51 bp, Artificial Sequence
  Synthetic polynucleotide
tatggcatcctcctctgggagatctyctcacttggtgagccactgggccca

SEQ ID NO: 1878 - DNA, 51 bp, Artificial Sequence
  Synthetic polynucleotide
ctggtgaacagcaagttctataaacbggtgaaggatggataccaaatggcc

SEQ ID NO: 1879 - DNA, 51 bp, Artificial Sequence
  Synthetic polynucleotide
atttttcagattgttcagtttggcabgaatgaaaaggttgggcaaatctcc

SEQ ID NO: 1880 - DNA, 51 bp, Artificial Sequence
  Synthetic polynucleotide
gtaagtggaaagattattgccacccygcacatcaagtatcctaaggacagg

SEQ ID NO: 1881 - DNA, 51 bp, Artificial Sequence
  Synthetic polynucleotide
gcggagggctgtgtccccggcgcttycggggggcctcagggcgcggaggac

SEQ ID NO: 1882 - DNA, 51 bp, Artificial Sequence
  Synthetic polynucleotide
tatgagcatccatccatcctgagtcygaaccctctggctctcatcagccgc

SEQ ID NO: 1883 - DNA, 51 bp, Artificial Sequence
  Synthetic polynucleotide
tttcctggtttacagggtcctccagyaagttataaaatttgggattatgat

SEQ ID NO: 1884 - DNA, 51 bp, Artificial Sequence
  Synthetic polynucleotide
caggcagcagaagatgtcgttttcaytggacctgacacacatgctattcaa

SEQ ID NO: 1885 - DNA, 51 bp, Artificial Sequence
  Synthetic polynucleotide
acacgtgcccgaatctgctgtgaccyggatgtcttggccagcaagaaggta

SEQ ID NO: 1886 - DNA, 51 bp, Artificial Sequence
  Synthetic polynucleotide
cataaggagcgccccacagtcatgcygtttccctttaggaatctcggctca

SEQ ID NO: 1887 - DNA, 51 bp, Artificial Sequence
  Synthetic polynucleotide
taaggagcgccccacagtcatgctgyttccctttaggaatctcggctcacc

SEQ ID NO: 1888 - DNA, 51 bp, Artificial Sequence
  Synthetic polynucleotide
tcaatgcctgtagctattgcattaaygaccacagcggtcatctctacctgc

SEQ ID NO: 1889 - DNA, 51 bp, Artificial Sequence
  Synthetic polynucleotide
aagctgatgatcaagcagggccttcyggacaagcatgggaagcccacagac

SEQ ID NO: 1890 - DNA, 51 bp, Artificial Sequence
  Synthetic polynucleotide
caggaaaaagagaaaaaatcagtggyaagtccctcttttatgtgtactctc

SEQ ID NO: 1891 - DNA, 51 bp, Artificial Sequence
  Synthetic polynucleotide
gaatacctggaagcaattcaccatcyccatgaggagtggctcatcaaaggc

SEQ ID NO: 1892 - DNA, 51 bp, Artificial Sequence
  Synthetic polynucleotide
atcgaagggctgtcccagaagtttayttacctaaatgatgatgtcatgttt

SEQ ID NO: 1893 - DNA, 51 bp, Artificial Sequence
  Synthetic polynucleotide
tttgccttctcttatttttattatcycatgagtgcagtgcagccactgaat

SEQ ID NO: 1894 - DNA, 51 bp, Artificial Sequence
  Synthetic polynucleotide
ccgccatcctctcaggtttcacgcaygtgtgctgcagctcccatttcatca

SEQ ID NO: 1895 - DNA, 51 bp, Artificial Sequence
  Synthetic polynucleotide
tacaactgcagctgcaataaactggyccttatacctgttgggttctaaccc

SEQ ID NO: 1896 - DNA, 51 bp, Artificial Sequence
  Synthetic polynucleotide
tgctcaaagtaatgatgattccgagyatgtccgtgcagtttataggtaaat

SEQ ID NO: 1897 - DNA, 51 bp, Artificial Sequence
  Synthetic polynucleotide
gccaagcccaaccagataagcctcaycaacatggacctgcccatggtgagt

SEQ ID NO: 1898 - DNA, 51 bp, Artificial Sequence
  Synthetic polynucleotide
ctcggccgcaagattctggccgccaycattatgaaaaaagactctgaggac

SEQ ID NO: 1899 - DNA, 51 bp, Artificial Sequence
  Synthetic polynucleotide
atcgaagagtatttgaccaaagagcygctggccctggattcagtggacccc

SEQ ID NO: 1900 - DNA, 51 bp, Artificial Sequence
  Synthetic polynucleotide
ttttatgtcacgaggcctagaaatcygtctgaacagtcaagtcctcctggt

SEQ ID NO: 1901 - DNA, 51 bp, Artificial Sequence
  Synthetic polynucleotide
ttggggctgagtcctgaagaggccayggagctgctgcagggtcagggccca

SEQ ID NO: 1902 - DNA, 51 bp, Artificial Sequence
  Synthetic polynucleotide
aacctgtgttgtggtttacactggayatggaaatagagaggagcaaaatct

SEQ ID NO: 1903 - DNA, 51 bp, Artificial Sequence
  Synthetic polynucleotide
aggaggaattgtcttaagtgtagaaycaatgaaaagacttaacagccttct

SEQ ID NO: 1904 - DNA, 51 bp, Artificial Sequence
  Synthetic polynucleotide
ttagcactggcctttgtgctggcacyggcatgctgtgcctcgaatgtcact

SEQ ID NO: 1905 - DNA, 51 bp, Artificial Sequence
  Synthetic polynucleotide
gctcactgcaggtccttggcagggcygggcggcctctctctgctgggcgtg

SEQ ID NO: 1906 - DNA, 51 bp, Artificial Sequence
  Synthetic polynucleotide
tcggagctgaagatcatgagtcaccytgggccccacctgaacgtggtcaac

SEQ ID NO: 1907 - DNA, 51 bp, Artificial Sequence
  Synthetic polynucleotide
caacagctatgaagacgccaaggccyacgggttcaagaacaagctgatcat

SEQ ID NO: 1908 - DNA, 51 bp, Artificial Sequence
  Synthetic polynucleotide
actatagatcattttaattgcatttrtaagtgtaggaatagcatccatcat

SEQ ID NO: 1909 - DNA, 51 bp, Artificial Sequence
  Synthetic polynucleotide
gtccagtacctgtaccgagagttgcyggttcaccttgacgatccagagagg

SEQ ID NO: 1910 - DNA, 51 bp, Artificial Sequence
  Synthetic polynucleotide
gaggggaacctcactttcaacgactytgtggacatgttttccgtgctctgc

SEQ ID NO: 1911 - DNA, 51 bp, Artificial Sequence
  Synthetic polynucleotide
acagacttcaacactgacaacttcayctgcaaggaggacctggagctgacg

SEQ ID NO: 1912 - DNA, 51 bp, Artificial Sequence
  Synthetic polynucleotide
ttagttgttacttcttcacacaagayggcggctcccagggaggaggcatga

SEQ ID NO: 1913 - DNA, 51 bp, Artificial Sequence
  Synthetic polynucleotide
ggagccgagctggtcgactcggtccyggatgtggtgaggaaggagtcagag

SEQ ID NO: 1914 - DNA, 51 bp, Artificial Sequence
  Synthetic polynucleotide
gtggctggcgtcagaaacaggctgcycaaggtgactcttgttcccttcttg

SEQ ID NO: 1915 - DNA, 51 bp, Artificial Sequence
  Synthetic polynucleotide
ttgaacttgagaacattcctccggcytcaaccccacagcaatgggaaagtg

SEQ ID NO: 1916 - DNA, 51 bp, Artificial Sequence
  Synthetic polynucleotide
gtggcatcacactcctcaagccaggyatcccgggggtaggtgggccaggct

SEQ ID NO: 1917 - DNA, 51 bp, Artificial Sequence
  Synthetic polynucleotide
aagcaggccctgaccagctgtggctytgactgcttggaaaccagcatcggt

SEQ ID NO: 1918 - DNA, 51 bp, Artificial Sequence
  Synthetic polynucleotide
acagcagctgacatggaggcccgccyggcgtgcggcctggtaaagggccac

SEQ ID NO: 1919 - DNA, 51 bp, Artificial Sequence
  Synthetic polynucleotide
gccgtcttccagctggtctacaattyctacctgtccggggtgctgctggtg

SEQ ID NO: 1920 - DNA, 51 bp, Artificial Sequence
  Synthetic polynucleotide
atgatcctctacgacatccctgatayccgtctcttctggtgtgaggacgag

SEQ ID NO: 1921 - DNA, 51 bp, Artificial Sequence
  Synthetic polynucleotide
gcctgcgctttctgcagcggaacggygcgcggacccgggcgggagagggcg

SEQ ID NO: 1922 - DNA, 51 bp, Artificial Sequence
  Synthetic polynucleotide
tatgaggaactcccaggcactgataycaggtgagagccagggtccgggcag

SEQ ID NO: 1923 - DNA, 51 bp, Artificial Sequence
  Synthetic polynucleotide
tgcagggaaggtcattaaaggttggygatgaaacatgacccactttccttg

SEQ ID NO: 1924 - DNA, 51 bp, Artificial Sequence
  Synthetic polynucleotide
ttcacacttctagtaagcctctaccygcacgacaacacataatgacccacc

SEQ ID NO: 1925 - DNA, 51 bp, Artificial Sequence
  Synthetic polynucleotide
gtagttgatgctgatgtaacagttayaggttctggtcctggaggatatgtt

SEQ ID NO: 1926 - DNA, 51 bp, Artificial Sequence
  Synthetic polynucleotide
agaggagactctcaccactagcgtcyggattggaatcgtgagtcaaatctg

SEQ ID NO: 1927 - DNA, 51 bp, Artificial Sequence
  Synthetic polynucleotide
tgccattacagtgctctacttcctcbctcggagaattccccttcctagaag

SEQ ID NO: 1928 - DNA, 51 bp, Artificial Sequence
  Synthetic polynucleotide
ggacaaagaattggatctggatcatytggaacagtctacaagggaaagtgg

SEQ ID NO: 1929 - DNA, 51 bp, Artificial Sequence
  Synthetic polynucleotide
ttaggtgatgtggcagtgaaaatgtygaatgtgacagcacctacacctcag

SEQ ID NO: 1930 - DNA, 51 bp, Artificial Sequence
  Synthetic polynucleotide
gattgagccctgtggacacctcatgygcacatcctgtcttacatcctggca

SEQ ID NO: 1931 - DNA, 51 bp, Artificial Sequence
  Synthetic polynucleotide
ctatgacctgtatggaggggagaaabttgccactttggctgagttggtcca

SEQ ID NO: 1932 - DNA, 51 bp, Artificial Sequence
  Synthetic polynucleotide
aaatagatataaaaacatcctgcccbgtaagtatcaatattccgctcagta

SEQ ID NO: 1933 - DNA, 51 bp, Artificial Sequence
  Synthetic polynucleotide
aggttccctctcccagaggcagaggycgacatccacacctaatgtccacat

SEQ ID NO: 1934 - DNA, 51 bp, Artificial Sequence
  Synthetic polynucleotide
agtccttaacaagcattgagatatayttctccatgaaggcttaacagtgaa

SEQ ID NO: 1935 - DNA, 51 bp, Artificial Sequence
  Synthetic polynucleotide
ggccatatagaagatacagtagaaabgacagatgaaggcagtccccatcca

SEQ ID NO: 1936 - DNA, 51 bp, Artificial Sequence
  Synthetic polynucleotide
atatctttacagtaccggagtacacyggaaaggatgcttgatgtaacaatg

SEQ ID NO: 1937 - DNA, 51 bp, Artificial Sequence
  Synthetic polynucleotide
tcggcactgggtagagcaccacttcyatgattttgaaagagatgcatatct

SEQ ID NO: 1938 - DNA, 51 bp, Artificial Sequence
  Synthetic polynucleotide
caactctccgtacatcgtgggcttcyatggtgcgttctacagcgatggcga

SEQ ID NO: 1939 - DNA, 51 bp, Artificial Sequence
  Synthetic polynucleotide
tttcaagccaaccccatggcctccaygactttttcaaaaaggtattagaaa

SEQ ID NO: 1940 - DNA, 51 bp, Artificial Sequence
  Synthetic polynucleotide
gtggcttgctgctgtgggaacatccygtgccactgcttcaacaaatacagg

SEQ ID NO: 1941 - DNA, 51 bp, Artificial Sequence
  Synthetic polynucleotide
gcagtgctgtccccggcccaggccaycgtggtttacaccgacagggaggtc

SEQ ID NO: 1942 - DNA, 51 bp, Artificial Sequence
  Synthetic polynucleotide
ccctcattcctcatagatcttccacyatgccaagggacaaccctacattga

SEQ ID NO: 1943 - DNA, 51 bp, Artificial Sequence
  Synthetic polynucleotide
cactatgccaagggacaaccctacahtgacgaggtggggaccttcaaagag

SEQ ID NO: 1944 - DNA, 51 bp, Artificial Sequence
  Synthetic polynucleotide
tacctcatgttcaccatggtgcttgycaccttctccatcgtcaccagcgtg

SEQ ID NO: 1945 - DNA, 51 bp, Artificial Sequence
  Synthetic polynucleotide
cggggtatactggatacactcaaggyatcggatttaggcgtatctgtgtca

SEQ ID NO: 1946 - DNA, 51 bp, Artificial Sequence
  Synthetic polynucleotide
aagatgtggctatgaatattcacttyctgttttctttccagaaagtggttt

SEQ ID NO: 1947 - DNA, 51 bp, Artificial Sequence
  Synthetic polynucleotide
gccccaccctgtgacaggtctcctgygtcatctggatgatgcatgcatcag

SEQ ID NO: 1948 - DNA, 51 bp, Artificial Sequence
  Synthetic polynucleotide
tctggataagattggaggcttcacaygtctgtgcatgccaggtaaatgggc

SEQ ID NO: 1949 - DNA, 51 bp, Artificial Sequence
  Synthetic polynucleotide
ccccgctgcccttctaggacagtgaygaagtcaggccctgagatcgtgaag

SEQ ID NO: 1950 - DNA, 51 bp, Artificial Sequence
  Synthetic polynucleotide
aaagaaaaacatattgaccgagaatytgtggtgatgttttctgtggtggat

SEQ ID NO: 1951 - DNA, 51 bp, Artificial Sequence
  Synthetic polynucleotide
gtgactaggatttaccattcccacabtgatgctccaaaagatattgcctca

SEQ ID NO: 1952 - DNA, 51 bp, Artificial Sequence
  Synthetic polynucleotide
caggaggagtcccaggccgcccgcaygatccacagcaccaatggcctatac

SEQ ID NO: 1953 - DNA, 51 bp, Artificial Sequence
  Synthetic polynucleotide
ttcgggggccttatcgtcgtctgtcytttcctgggcctttgcgatggcttc

SEQ ID NO: 1954 - DNA, 51 bp, Artificial Sequence
  Synthetic polynucleotide
ccgtgggaagcatgttagacactacyacattgccgctgaggaaatcatctg

SEQ ID NO: 1955 - DNA, 51 bp, Artificial Sequence
  Synthetic polynucleotide
cgggcttgtgcaccagggcatgaaahgctcctgtgagtgacctgggccttg

SEQ ID NO: 1956 - DNA, 51 bp, Artificial Sequence
  Synthetic polynucleotide
gacccctgcagctgcagacatctgcytcaccaaggagctacactcccactt

SEQ ID NO: 1957 - DNA, 51 bp, Artificial Sequence
  Synthetic polynucleotide
cagtctcctttgtgacaatggacaaygtagaaatactcctggaagttttgt

SEQ ID NO: 1958 - DNA, 51 bp, Artificial Sequence
  Synthetic polynucleotide
ctttctggctgtagaccttgatgagygctctgagaacctgaatctctgtgg

SEQ ID NO: 1959 - DNA, 51 bp, Artificial Sequence
  Synthetic polynucleotide
gtagcacggagctctttgtgaaaggygggcctgggacctgaggatgtggga

SEQ ID NO: 1960 - DNA, 51 bp, Artificial Sequence
  Synthetic polynucleotide
gacgcggaagtagtagccattgccartgatgagctctggcaccacgcagtg

SEQ ID NO: 1961 - DNA, 51 bp, Artificial Sequence
  Synthetic polynucleotide
cctcctatcagccttccgccgcacgygagtggccatcctcagggcctgggg

SEQ ID NO: 1962 - DNA, 51 bp, Artificial Sequence
  Synthetic polynucleotide
accaagcagccacgccagtacttcayaggagtcctggacatcgctggcttc

SEQ ID NO: 1963 - DNA, 51 bp, Artificial Sequence
  Synthetic polynucleotide
atgcaccagctgcgctgcaatggtgygctggagggcatccgcatctgcagg

SEQ ID NO: 1964 - DNA, 51 bp, Artificial Sequence
  Synthetic polynucleotide
aagagtgcagaaagagagaaggagayggcctccatgaaggaggagttcaca

SEQ ID NO: 1965 - DNA, 51 bp, Artificial Sequence
  Synthetic polynucleotide
gaaagagagaaggagatggcctccahgaaggaggagttcacacgcctcaaa

SEQ ID NO: 1966 - DNA, 51 bp, Artificial Sequence
  Synthetic polynucleotide
cagtactttgctgttattgcagccaytggggaccgcagcaagaaggaccag

SEQ ID NO: 1967 - DNA, 51 bp, Artificial Sequence
  Synthetic polynucleotide
acaggaaagttggcatctgcagacayagagacctgtgagtgccatgaatct

SEQ ID NO: 1968 - DNA, 51 bp, Artificial Sequence
  Synthetic polynucleotide
ctcctgccccacgtgcagcgcttccygcagtcccgaaagcactgcccactc

SEQ ID NO: 1969 - DNA, 51 bp, Artificial Sequence
  Synthetic polynucleotide
ggagagcctggccaagtgctgcaggyagcggccgcgcgggcctgcgtagag

SEQ ID NO: 1970 - DNA, 51 bp, Artificial Sequence
  Synthetic polynucleotide
tcgctgtcctctggctcgcaggtcabggcagcgccaggcggcaggtcggag

SEQ ID NO: 1971 - DNA, 51 bp, Artificial Sequence
  Synthetic polynucleotide
aatggagttctctctattatctatgyaagtgttgcttcttgctccagggat

SEQ ID NO: 1972 - DNA, 51 bp, Artificial Sequence
  Synthetic polynucleotide
ctgaaagagcgatgcctccaggttgyccggagcctagtcaagcctgagaat

SEQ ID NO: 1973 - DNA, 51 bp, Artificial Sequence
  Synthetic polynucleotide
agagagtgggtgtctccggaggccaygggctacccggaggtggagcgcagg

SEQ ID NO: 1974 - DNA, 51 bp, Artificial Sequence
  Synthetic polynucleotide
ctgttgaagagttgagtgcagcacgyaagagtctttttttttttttttaat

SEQ ID NO: 1975 - DNA, 51 bp, Artificial Sequence
  Synthetic polynucleotide
ttgcggacacttttggcgatcaaggrcagatacatccttataacaatggaa

SEQ ID NO: 1976 - DNA, 51 bp, Artificial Sequence
  Synthetic polynucleotide
attgatggttgggagggaaaagacabtggacagtgttgtaatgaatttata

SEQ ID NO: 1977 - DNA, 51 bp, Artificial Sequence
  Synthetic polynucleotide
gtataagaaggagctggagaagactyattctgccaaggtgcttgctctcga

SEQ ID NO: 1978 - DNA, 51 bp, Artificial Sequence
  Synthetic polynucleotide
tcttgaagatacaattgtcttaaacyggagaaaacctatacaatcaaatgg

SEQ ID NO: 1979 - DNA, 51 bp, Artificial Sequence
  Synthetic polynucleotide
cgacacaacaagccagccatatagaygcctctgctcccaggagagcttcac

SEQ ID NO: 1980 - DNA, 51 bp, Artificial Sequence
  Synthetic polynucleotide
gtcgaggacgtacaacaggagcaggyaaatacttatcttcaaatgcatatg

SEQ ID NO: 1981 - DNA, 51 bp, Artificial Sequence
  Synthetic polynucleotide
ctgggctgtacaaacatggtatgacyctcttggagcaataaacaaaataca

SEQ ID NO: 1982 - DNA, 51 bp, Artificial Sequence
  Synthetic polynucleotide
cccttcgtggcccgccagatggcccygcacgcaaatgtgagtgggggtggg

SEQ ID NO: 1983 - DNA, 51 bp, Artificial Sequence
  Synthetic polynucleotide
cctcatccaccgctgtgccagccagygcgtcgtggccttgtccatctgcag

SEQ ID NO: 1984 - DNA, 51 bp, Artificial Sequence
  Synthetic polynucleotide
ggacatgatggctcgatacgtcttcyccaacttcacggctgtcccgaagag

SEQ ID NO: 1985 - DNA, 51 bp, Artificial Sequence
  Synthetic polynucleotide
gccgccctgctcatctggaaactccycatcaccatccacgaccgaaaagaa

SEQ ID NO: 1986 - DNA, 51 bp, Artificial Sequence
  Synthetic polynucleotide
agatgatctgggatggaattgtaggyaagagaaaaggtgtctgctgttgtt

SEQ ID NO: 1987 - DNA, 51 bp, Artificial Sequence
  Synthetic polynucleotide
ccttttagcttgtagtgaacaggacyctgagccaggggcccggcttacctg

SEQ ID NO: 1988 - DNA, 51 bp, Artificial Sequence
  Synthetic polynucleotide
ctagccctccatacctgggagcagayggggctgaggtcactgtgcgcccaa

SEQ ID NO: 1989 - DNA, 51 bp, Artificial Sequence
  Synthetic polynucleotide
atgcctatatgaacttttctggttcyaatggatgtctgctgggctctttta

SEQ ID NO: 1990 - DNA, 51 bp, Artificial Sequence
  Synthetic polynucleotide
gcgtggcagggcctgggcgaggtgcygcaggcccagggccagaacgaggct

SEQ ID NO: 1991 - DNA, 51 bp, Artificial Sequence
  Synthetic polynucleotide
tacagctatgatttgtcccactcacytcaatataatctcactgtcttgcga

SEQ ID NO: 1992 - DNA, 51 bp, Artificial Sequence
  Synthetic polynucleotide
attggaggaatatcgtaggtaaaaabgcctattggatccaaagagaggcca

SEQ ID NO: 1993 - DNA, 51 bp, Artificial Sequence
  Synthetic polynucleotide
tagataaattcaaattagacttaggyaagtaatgcaatatggtagactggg

SEQ ID NO: 1994 - DNA, 51 bp, Artificial Sequence
  Synthetic polynucleotide
ttaagacacgctgcaacaaagcagghattgacaaattttatataactttat

SEQ ID NO: 1995 - DNA, 51 bp, Artificial Sequence
  Synthetic polynucleotide
agatgcctaagcccagaaagggtgcytcttcaactaaaatacaggcaagtt

SEQ ID NO: 1996 - DNA, 51 bp, Artificial Sequence
  Synthetic polynucleotide
tgcttctctgtctttgccatctccthctttgcgctcccagcggtaggtgcc

SEQ ID NO: 1997 - DNA, 51 bp, Artificial Sequence
  Synthetic polynucleotide
cttctctccaggctggaccagtccabtgggaagccctcactgttcatctcc

SEQ ID NO: 1998 - DNA, 51 bp, Artificial Sequence
  Synthetic polynucleotide
ggctgccgcagcaagtacgtgggccyctgggggcggctgcgctttgcccgg

SEQ ID NO: 1999 - DNA, 51 bp, Artificial Sequence
  Synthetic polynucleotide
cctccggaaaatattcaccaccatcycattctgcattgttctgcgcatggc

SEQ ID NO: 2000 - DNA, 51 bp, Artificial Sequence
  Synthetic polynucleotide
ttaaagaaagctgacaaaatattaaytttgcatgaaggtagcagctatttt

SEQ ID NO: 2001 - DNA, 51 bp, Artificial Sequence
  Synthetic polynucleotide
tacgtgggagtagccgacactttgcytgctatgggattcttcagaggtcta

SEQ ID NO: 2002 - DNA, 51 bp, Artificial Sequence
  Synthetic polynucleotide
ggacggcagccttactttgaaactcygttccacaaagctctgaatttacat

SEQ ID NO: 2003 - DNA, 51 bp, Artificial Sequence
  Synthetic polynucleotide
  misc_feature (26)..(26): n is a, c, g, t or u
gatcaaggaacctgtctccacaaagngtgaccacatattttgcaagtaagt

SEQ ID NO: 2004 - DNA, 51 bp, Artificial Sequence
  Synthetic polynucleotide
gaaagggccttcacagtgtcctttabgtaagaatgatataaccaaaaggta

SEQ ID NO: 2005 - DNA, 51 bp, Artificial Sequence
  Synthetic polynucleotide
atgtaagaatgatataaccaaaaggyatataatttggtaatgatgctaggt

SEQ ID NO: 2006 - DNA, 51 bp, Artificial Sequence
  Synthetic polynucleotide
taaagttcattggaacagaaagaaabggatttatctgctcttcgcgttgaa

SEQ ID NO: 2007 - DNA, 51 bp, Artificial Sequence
  Synthetic polynucleotide
cagaacaaagcacatcagaaaaaggbgtgtattgttggccaaacactgata

SEQ ID NO: 2008 - DNA, 51 bp, Artificial Sequence
  Synthetic polynucleotide
ctcttcttccagatcttcagggggcyagaaatctgttgctatgggcccttc

SEQ ID NO: 2009 - DNA, 51 bp, Artificial Sequence
  Synthetic polynucleotide
gtcattaatgctatgcagaaaatctyagagtgtcccatctggtaagtcagc

SEQ ID NO: 2010 - DNA, 51 bp, Artificial Sequence
  Synthetic polynucleotide
atgcttgctatacagactgctatacyggacattttaaatgcatgtctaaag

SEQ ID NO: 2011 - DNA, 51 bp, Artificial Sequence
  Synthetic polynucleotide
tgctatactggacattttaaatgcaygtctaaaggaactaaaatgccataa

SEQ ID NO: 2012 - DNA, 51 bp, Artificial Sequence
  Synthetic polynucleotide
ggcgtgctggtgctcacagtgctgcygccgccagaggagctactgcgttcc

SEQ ID NO: 2013 - DNA, 51 bp, Artificial Sequence
  Synthetic polynucleotide
ggaaattttctcaagtggcaaacttyagaaggaggtgttttacaggtaagc

SEQ ID NO: 2014 - DNA, 51 bp, Artificial Sequence
  Synthetic polynucleotide
gtctaaaaaagcagaaagtccagagyatgtccatatgtatactcaaagaag

SEQ ID NO: 2015 - DNA, 51 bp, Artificial Sequence
  Synthetic polynucleotide
gcgcttctcacactcgggctcgtacycgcagcacatgaatcacaggtattc

SEQ ID NO: 2016 - DNA, 51 bp, Artificial Sequence
  Synthetic polynucleotide
cccctctgctacttcgcccgggtctytgacgtcttcctggtggagggctac

SEQ ID NO: 2017 - DNA, 51 bp, Artificial Sequence
  Synthetic polynucleotide
gtgggagccctgaaggagaagtaccygcggccgtccccgctgctcttccac

SEQ ID NO: 2018 - DNA, 51 bp, Artificial Sequence
  Synthetic polynucleotide
agcttctgggggaaagctcatcttcyatgatcttcgaggagagggggtgaa

SEQ ID NO: 2019 - DNA, 51 bp, Artificial Sequence
  Synthetic polynucleotide
ctcatcttctcccacctgcacgagcyctcactgcgctggcacctggggcgc

SEQ ID NO: 2020 - DNA, 51 bp, Artificial Sequence
  Synthetic polynucleotide
cccctgttttctgcacaccccaagcycttcgagagaacctgtcgccagtat

SEQ ID NO: 2021 - DNA, 51 bp, Artificial Sequence
  Synthetic polynucleotide
cgggcccctctcagcaggctgtgtgygccagggctgtggggcagaggacgt

SEQ ID NO: 2022 - DNA, 51 bp, Artificial Sequence
  Synthetic polynucleotide
atcacccacattgccatccaggcctygagagaggagtgtctctccaggtga

SEQ ID NO: 2023 - DNA, 51 bp, Artificial Sequence
  Synthetic polynucleotide
ctaccatctctccccgcaggaatccygtactatgtctacatggggctgctg

SEQ ID NO: 2024 - DNA, 51 bp, Artificial Sequence
  Synthetic polynucleotide
ccataaaattcttcttagtagctatyaccttcttattatttgatctagaaa

SEQ ID NO: 2025 - DNA, 51 bp, Artificial Sequence
  Synthetic polynucleotide
tcccttcccctactcatcgcactaayttacactcacaacaccctaggctca

SEQ ID NO: 2026 - DNA, 51 bp, Artificial Sequence
  Synthetic polynucleotide
atccttcttgctcatcagttgatgayacgcccgagcagatgccaacacagc

SEQ ID NO: 2027 - DNA, 51 bp, Artificial Sequence
  Synthetic polynucleotide
attcagcttcctacactattaaagtytaccacaaccaccaccccatcatac

SEQ ID NO: 2028 - DNA, 51 bp, Artificial Sequence
  Synthetic polynucleotide
  misc_feature (26)..(26): n is a, c, g, t or u
acccagcagtgggggctcgcggacgngaagggccactggtccccaacaatg

SEQ ID NO: 2029 - DNA, 51 bp, Artificial Sequence
  Synthetic polynucleotide
gtagccaagaagattgctgctgtacytacggtaaatgtatattttaactgt

SEQ ID NO: 2030 - DNA, 51 bp, Artificial Sequence
  Synthetic polynucleotide
tgagtttttgtctcttcccagtttcyctgagaaggtaaggcctgttgtgac

SEQ ID NO: 2031 - DNA, 51 bp, Artificial Sequence
  Synthetic polynucleotide
tctggcaccattcagagatacagtcyacctaatgttggtttgattcaaaaa

SEQ ID NO: 2032 - DNA, 51 bp, Artificial Sequence
  Synthetic polynucleotide
gcagatgcgccgatcgtggcccaccyttgggaggtgagttttcacactttt

SEQ ID NO: 2033 - DNA, 51 bp, Artificial Sequence
  Synthetic polynucleotide
gacgaagattcaccttatcaaaatayaaaaattctacactcgaagcagttt

SEQ ID NO: 2034 - DNA, 51 bp, Artificial Sequence
  Synthetic polynucleotide
aagtggatggccccagagagcatctytgactgtgtctacacggttcagagc

SEQ ID NO: 2035 - DNA, 51 bp, Artificial Sequence
  Synthetic polynucleotide
tccttcctccaacccttccaggagcygcgtgagaccaagcgccgtcatgag

SEQ ID NO: 2036 - DNA, 51 bp, Artificial Sequence
  Synthetic polynucleotide
ccaccctccaacctctcccaggtgcygttctggggcctacgggacctaaag

SEQ ID NO: 2037 - DNA, 51 bp, Artificial Sequence
  Synthetic polynucleotide
tacagggtggtcttcgacatcacctycttcttcttcgtcatcgtcatcctg

SEQ ID NO: 2038 - DNA, 51 bp, Artificial Sequence
  Synthetic polynucleotide
gccggcaagggtgaggccctgcggayccgcgccatcctccgctcccttgtg

SEQ ID NO: 2039 - DNA, 51 bp, Artificial Sequence
  Synthetic polynucleotide
gaagtgtcagccgtgctctactaccyggaccaggtgggtggggccggaggg

SEQ ID NO: 2040 - DNA, 51 bp, Artificial Sequence
  Synthetic polynucleotide
ttttacaccctgcggttccttgcccycttcttggcatttgccatcaacttc

SEQ ID NO: 2041 - DNA, 51 bp, Artificial Sequence
  Synthetic polynucleotide
cccgccctgcggtgtctgagcctccygcatacactggtggcctttctctgc

SEQ ID NO: 2042 - DNA, 51 bp, Artificial Sequence
  Synthetic polynucleotide
gtgtgcccacagtccttcctgtaccygggctggtatatggtgatgtccctc

SEQ ID NO: 2043 - DNA, 51 bp, Artificial Sequence
  Synthetic polynucleotide
ctcagggcttagcagcaggttgtacrgggcgatccacacttgcccgtccaa

SEQ ID NO: 2044 - DNA, 51 bp, Artificial Sequence
  Synthetic polynucleotide
aaaatacctcgaagcaatcaaaataytttctggtccattgaaaggaataga

SEQ ID NO: 2045 - DNA, 51 bp, Artificial Sequence
  Synthetic polynucleotide
cctgcgggtcaccatcctcacgtacygtacaaaaggacagcagaggagaag

SEQ ID NO: 2046 - DNA, 51 bp, Artificial Sequence
  Synthetic polynucleotide
tccccagaaaagatggaaaagaaatygcatgcagtgccggctgccaagaca

SEQ ID NO: 2047 - DNA, 51 bp, Artificial Sequence
  Synthetic polynucleotide
ccatattatcgtcattatactggtgyactgtttcccattgctcatcatggg

SEQ ID NO: 2048 - DNA, 51 bp, Artificial Sequence
  Synthetic polynucleotide
taccaggacctgctcaatgtcaagchggccctggacatcgagatcgccacc

SEQ ID NO: 2049 - DNA, 51 bp, Artificial Sequence
  Synthetic polynucleotide
gacctgctcaatgtcaagctggcccyggacatcgagatcgccacctacagg

SEQ ID NO: 2050 - DNA, 51 bp, Artificial Sequence
  Synthetic polynucleotide
ggccctggacatcgagatcgccaccyacaggaagctgctagagggcgagga

SEQ ID NO: 2051 - DNA, 51 bp, Artificial Sequence
  Synthetic polynucleotide
cgggccagtgagcgggcagagatgayggagctcaatgaccgctttgccagc

SEQ ID NO: 2052 - DNA, 51 bp, Artificial Sequence
  Synthetic polynucleotide
ggagctcaatgaccgctttgccagcyacatcgagaaggttcgcttcctgga

SEQ ID NO: 2053 - DNA, 51 bp, Artificial Sequence
  Synthetic polynucleotide
agctacatcgagaaggttcgcttccyggaacagcaaaacaaggcgctggct

SEQ ID NO: 2054 - DNA, 51 bp, Artificial Sequence
  Synthetic polynucleotide
ttcctggaacagcaaaacaaggcgcyggctgctgagctgaaccagctgcgg

SEQ ID NO: 2055 - DNA, 51 bp, Artificial Sequence
  Synthetic polynucleotide
caaaacaaggcgctggctgctgagcygaaccagctgcgggccaaggagccc

SEQ ID NO: 2056 - DNA, 51 bp, Artificial Sequence
  Synthetic polynucleotide
gccaagccagacctcaccgcagcccygaaagagatccgcacgcagtatgag

SEQ ID NO: 2057 - DNA, 51 bp, Artificial Sequence
  Synthetic polynucleotide
ccgcacgcagtatgaggcaatggcgyccagcaacatgcatgaagccgaaga

SEQ ID NO: 2058 - DNA, 51 bp, Artificial Sequence
  Synthetic polynucleotide
agttatcaggaggcgctggcgcggcyggaggaagaggggcagagcctcaag

SEQ ID NO: 2059 - DNA, 51 bp, Artificial Sequence
  Synthetic polynucleotide
gagatcgccacctaccgcaagctgcbggagggtgaggagtgcaggtgggta

SEQ ID NO: 2060 - DNA, 51 bp, Artificial Sequence
  Synthetic polynucleotide
cagatcaagaccctcaacaacaagtbtgcctccttcatcgacaaggtgagc

SEQ ID NO: 2061 - DNA, 51 bp, Artificial Sequence
  Synthetic polynucleotide
aatgagaagatcaccatgcagaaccycaacgaccgcctggcttcctacctg

SEQ ID NO: 2062 - DNA, 51 bp, Artificial Sequence
  Synthetic polynucleotide
ccatgtccccaccaggaagtggccaygcgcaagctggtgcgctcagtgact

SEQ ID NO: 2063 - DNA, 51 bp, Artificial Sequence
  Synthetic polynucleotide
tccccctgcccgacctcagaccgcabggaggtgctatgctgccgagaaccc

SEQ ID NO: 2064 - DNA, 51 bp, Artificial Sequence
  Synthetic polynucleotide
ctggtccgccggctgccgcagcaagbacgtgggcctctgggggcggctgcg

SEQ ID NO: 2065 - DNA, 51 bp, Artificial Sequence
  Synthetic polynucleotide
gaccgccagggaggcacctggaggchcctgggctccgtggtcttcatccac

SEQ ID NO: 2066 - DNA, 51 bp, Artificial Sequence
  Synthetic polynucleotide
aacgctcgggtggagaactgcgccgbcatctactgcaacgacggcttctgc

SEQ ID NO: 2067 - DNA, 51 bp, Artificial Sequence
  Synthetic polynucleotide
gagtacggcgcggccgtgctgttctygctcatgtgcacctttgcgctcatc

SEQ ID NO: 2068 - DNA, 51 bp, Artificial Sequence
  Synthetic polynucleotide
  misc_feature (26)..(26): n is a, c, g, t or u
tggctgcacaacctgggcgaccaganaggcaaaccctacaacagcagcggc

SEQ ID NO: 2069 - DNA, 51 bp, Artificial Sequence
  Synthetic polynucleotide
cttcagcagcctcaccagtgtgggchtcggcaacgtctctcccaacaccaa

SEQ ID NO: 2070 - DNA, 51 bp, Artificial Sequence
  Synthetic polynucleotide
tggcctccagggaagaatgacatctbtggggagcctctgaacctgtatgca

SEQ ID NO: 2071 - DNA, 51 bp, Artificial Sequence
  Synthetic polynucleotide
gctgccgcgcagatcgcgcaggcacbgctgggcgccgaggagcgcaaagtg

SEQ ID NO: 2072 - DNA, 51 bp, Artificial Sequence
  Synthetic polynucleotide
aagaacgaggatggggctgtcatcabgttcatcctcaatttcgaggtggtg

SEQ ID NO: 2073 - DNA, 51 bp, Artificial Sequence
  Synthetic polynucleotide
gcccccctaggccgtaagttcatcabcgccaacgctcgggtggagaactgc

SEQ ID NO: 2074 - DNA, 51 bp, Artificial Sequence
  Synthetic polynucleotide
caagcggaccacctgggatttctgcygtggtctcctgcggcagcggcctca

SEQ ID NO: 2075 - DNA, 51 bp, Artificial Sequence
  Synthetic polynucleotide
tgccgcccagggccagctgcccagcygcattgccaccccctactccccgcc

SEQ ID NO: 2076 - DNA, 51 bp, Artificial Sequence
  Synthetic polynucleotide
ttgtctgcaggccttcgaggacatcyacctagaggagcggaagaccatcaa

SEQ ID NO: 2077 - DNA, 51 bp, Artificial Sequence
  Synthetic polynucleotide
tgccgacaagatgttcacatatgtcytcgtgctggagatgctgctcaagtg

SEQ ID NO: 2078 - DNA, 51 bp, Artificial Sequence
  Synthetic polynucleotide
tttattggtgtcatcattgacaactbcaaccaacagaagaaaaagatacgt

SEQ ID NO: 2079 - DNA, 51 bp, Artificial Sequence
  Synthetic polynucleotide
cgcacgctgctctttgccctcatgabgtccctgcctgccctcttcaacatc

SEQ ID NO: 2080 - DNA, 51 bp, Artificial Sequence
  Synthetic polynucleotide
tttgccgatgccctgtctgagccacyccgtatcgccaagcccaaccagata

SEQ ID NO: 2081 - DNA, 51 bp, Artificial Sequence
  Synthetic polynucleotide
gagatggacgccctgaagatccagahggaggagaagttcatggcagccaac

SEQ ID NO: 2082 - DNA, 51 bp, Artificial Sequence
  Synthetic polynucleotide
agatacacaactgaatttgtggacchgggcaatgtctcagccttacgcacc

SEQ ID NO: 2083 - DNA, 51 bp, Artificial Sequence
  Synthetic polynucleotide
ttacacagagaaggccaagctattayttttgtcattgatagtagtgataga

SEQ ID NO: 2084 - DNA, 51 bp, Artificial Sequence
  Synthetic polynucleotide
tcccgaggcggctgctccggtctctygcggtgtggaaagggaacgacctac

SEQ ID NO: 2085 - DNA, 51 bp, Artificial Sequence
  Synthetic polynucleotide
gaattaattacagggctcgtccaacyggtccctcagtcacacatgccagag

SEQ ID NO: 2086 - DNA, 51 bp, Artificial Sequence
  Synthetic polynucleotide
cttcagaaaagagtgatggcactgcbgaggcgcattgagcatcccactgca

SEQ ID NO: 2087 - DNA, 51 bp, Artificial Sequence
  Synthetic polynucleotide
cctcaccagaatcacccaggacattytccagcagttgctgaaacgaggttt

SEQ ID NO: 2088 - DNA, 51 bp, Artificial Sequence
  Synthetic polynucleotide
ttctatgtctggtttgatgccactaytggctatctgtccatcacagccaac

SEQ ID NO: 2089 - DNA, 51 bp, Artificial Sequence
  Synthetic polynucleotide
gttcattgtgctatttactggagagygtgtactgaaactcatctctctacg

SEQ ID NO: 2090 - DNA, 51 bp, Artificial Sequence
  Synthetic polynucleotide
tgagacctttggcaacagcatgatcygcctattccaaattacaacctctgc

SEQ ID NO: 2091 - DNA, 51 bp, Artificial Sequence
  Synthetic polynucleotide
caacctgaggaataaatgtatacaayggcctcccaccaatgcttccttgga

SEQ ID NO: 2092 - DNA, 51 bp, Artificial Sequence
  Synthetic polynucleotide
tgttgtgttcctgtcttacagacttytatagtattgaataaagggaaggcc

SEQ ID NO: 2093 - DNA, 51 bp, Artificial Sequence
  Synthetic polynucleotide
tgtgttcctgtcttacagacttttayagtattgaataaagggaaggccatc

SEQ ID NO: 2094 - DNA, 51 bp, Artificial Sequence
  Synthetic polynucleotide
tatttcaccaatgcctggtgttggcyggacttcttaattgttgatgtaggt

SEQ ID NO: 2095 - DNA, 51 bp, Artificial Sequence
  Synthetic polynucleotide
ccaaacaaactccagctcattgccayggatttgcccatggtgagtggtgac

SEQ ID NO: 2096 - DNA, 51 bp, Artificial Sequence
  Synthetic polynucleotide
agattttactttccttcgggatccayggaactggctcgatttcactgtcat

SEQ ID NO: 2097 - DNA, 51 bp, Artificial Sequence
  Synthetic polynucleotide
atagaccgcaccaacgccaacttccyggtgtggccgccctgtgtggaggtg

SEQ ID NO: 2098 - DNA, 51 bp, Artificial Sequence
  Synthetic polynucleotide
ttgcagggaccgtcagtggcgactaygggcagagtgggctattggaccctg

SEQ ID NO: 2099 - DNA, 51 bp, Artificial Sequence
  Synthetic polynucleotide
ctccccatcgctgcacttggactgcdgctcctgcacctgcgcctccagctt

SEQ ID NO: 2100 - DNA, 51 bp, Artificial Sequence
  Synthetic polynucleotide
ctcaacctcttcattgccttactgcycaattcctttagcaatgaggaaaga

SEQ ID NO: 2101 - DNA, 51 bp, Artificial Sequence
  Synthetic polynucleotide
ggagtcagggttgctgggttgaggargagggcttctagggagggggccttg

SEQ ID NO: 2102 - DNA, 51 bp, Artificial Sequence
  Synthetic polynucleotide
cttattggagtcagtgaactggggcyggtattcatgaaaggcaactgggcc

SEQ ID NO: 2103 - DNA, 51 bp, Artificial Sequence
  Synthetic polynucleotide
gaatcagtcactacgattatttcggyaactaactaactataatggaattat

SEQ ID NO: 2104 - DNA, 51 bp, Artificial Sequence
  Synthetic polynucleotide
gcttcttcctaggagccagcaccgcyctttgaccttgccatgcttgcctta

SEQ ID NO: 2105 - DNA, 51 bp, Artificial Sequence
  Synthetic polynucleotide
ctgcagcttgctaacctgcctgatchatacaaagtctttgagaggtgttaa

SEQ ID NO: 2106 - DNA, 51 bp, Artificial Sequence
  Synthetic polynucleotide
acagaaagaagatctggatattgtaygtgaaaggttcactactagtaaact

SEQ ID NO: 2107 - DNA, 51 bp, Artificial Sequence
  Synthetic polynucleotide
ggcaatcaagggacccagatcacggyaagaatggtacatgggagagtaaat

SEQ ID NO: 2108 - DNA, 51 bp, Artificial Sequence
  Synthetic polynucleotide
agccttcaaaatgaatggttacatabccaatgcaaactactcagtgaagaa

SEQ ID NO: 2109 - DNA, 51 bp, Artificial Sequence
  Synthetic polynucleotide
gcatcttcttactcttcatcaaccghaagttaaaaagaaccacatgggaaa

SEQ ID NO: 2110 - DNA, 51 bp, Artificial Sequence
  Synthetic polynucleotide
ttgttggcagtttttgtgactcctcytactgatcttcgttctgacttctcc

SEQ ID NO: 2111 - DNA, 51 bp, Artificial Sequence
  Synthetic polynucleotide
aacagatgttccacatcattactggyaaaaaacctggtttttgggctttgt

SEQ ID NO: 2112 - DNA, 51 bp, Artificial Sequence
  Synthetic polynucleotide
ggcccaaattgggtgttttgtgccaygtgagtcagcagaagtgtccattgt

SEQ ID NO: 2113 - DNA, 51 bp, Artificial Sequence
  Synthetic polynucleotide
cctgataatgatcagttctccaatcbtgaggctctcctcatccagattgga

SEQ ID NO: 2114 - DNA, 51 bp, Artificial Sequence
  Synthetic polynucleotide
cctcatccagattggaccaaaggaaygtgttttacccggaggagagactgc

SEQ ID NO: 2115 - DNA, 51 bp, Artificial Sequence
  Synthetic polynucleotide
ttggatattgcagcagtcagagcccbtaacctttttcaggtaaaaaaaaaa

SEQ ID NO: 2116 - DNA, 51 bp, Artificial Sequence
  Synthetic polynucleotide
aaagtgtgaccacatattttgcaagbaagtttgaatgtgttatgtggctcc

SEQ ID NO: 2117 - DNA, 51 bp, Artificial Sequence
  Synthetic polynucleotide
tatgaggaagacatcctgactgtacytggggttcttttaagtgatacccaa

SEQ ID NO: 2118 - DNA, 51 bp, Artificial Sequence
  Synthetic polynucleotide
aggggtgaatgttcctgaaattcctygtatcccaatgctaaggcaccttta

SEQ ID NO: 2119 - DNA, 51 bp, Artificial Sequence
  Synthetic polynucleotide
acatcgaatagatggatcacaaaacytcaatgaaacgtgggagaactacaa

SEQ ID NO: 2120 - DNA, 51 bp, Artificial Sequence
  Synthetic polynucleotide
ctctcatagcggagctgatactgccrcataaaatcagcttgctcaaattct

SEQ ID NO: 2121 - DNA, 51 bp, Artificial Sequence
  Synthetic polynucleotide
ttcttctagtatccagtccccctaaytagaagagcctgggaacttggttta

SEQ ID NO: 2122 - DNA, 51 bp, Artificial Sequence
  Synthetic polynucleotide
ttcctgtcacagttacagtaaaaggyagagataatgttccaaaaaggatga

SEQ ID NO: 2123 - DNA, 51 bp, Artificial Sequence
  Synthetic polynucleotide
gaagcatcccccagcagcctggctgrgtgtaacacatttttaatctttgag

SEQ ID NO: 2124 - DNA, 51 bp, Artificial Sequence
  Synthetic polynucleotide
gctcctttattcatgtctaatgaccyccgacacatcagccctcaagccaaa

SEQ ID NO: 2125 - DNA, 51 bp, Artificial Sequence
  Synthetic polynucleotide
gtgctggatgttcccgagggcacctygcctgacaaacagagcactgagcaa

SEQ ID NO: 2126 - DNA, 51 bp, Artificial Sequence
  Synthetic polynucleotide
tctgacttaaccataggtgctgtcayggattcatccagaaaataagacggt

SEQ ID NO: 2127 - DNA, 51 bp, Artificial Sequence
  Synthetic polynucleotide
gagtacaatcacatttttccacttcytgaaaagtactgtggcttccatgaa

SEQ ID NO: 2128 - DNA, 51 bp, Artificial Sequence
  Synthetic polynucleotide
ttcttctccgctcctccgacccaggyaggttgttacagatgtcttgagaag

SEQ ID NO: 2129 - DNA, 51 bp, Artificial Sequence
  Synthetic polynucleotide
agagatggctcgctggagctcatggygagtgggtcagagccccatccgagc

SEQ ID NO: 2130 - DNA, 51 bp, Artificial Sequence
  Synthetic polynucleotide
ctggctgattacctcacgctccagghtggtttatttatttgtcttacaaaa

SEQ ID NO: 2131 - DNA, 51 bp, Artificial Sequence
  Synthetic polynucleotide
ttcaccgctccattggtcttgagccragtgggtgatgtccaggggctggca

SEQ ID NO: 2132 - DNA, 51 bp, Artificial Sequence
  Synthetic polynucleotide
cgcctcaacagccacatgaatgcccyccacctggggtcacaggccaaccgc

SEQ ID NO: 2133 - DNA, 51 bp, Artificial Sequence
  Synthetic polynucleotide
caccgatgcacccatgatgatgaatrtgtgtgtatccgactgatggaaggc

SEQ ID NO: 2134 - DNA, 51 bp, Artificial Sequence
  Synthetic polynucleotide
gggtatctctctttgcttcaagttgyaagtgaacactattttctctgaata

SEQ ID NO: 2135 - DNA, 51 bp, Artificial Sequence
  Synthetic polynucleotide
cagaaagagaagtatctcccgaaggygaggaaatggaaatgtaatacacgc

SEQ ID NO: 2136 - DNA, 51 bp, Artificial Sequence
  Synthetic polynucleotide
gaggtcagctttgcggggaaaatggyaaggagcaagggagcaggagggttc

SEQ ID NO: 2137 - DNA, 51 bp, Artificial Sequence
  Synthetic polynucleotide
ccctggtggaacagatggtgaatggyaattacacgagttgatttagataat

SEQ ID NO: 2138 - DNA, 51 bp, Artificial Sequence
  Synthetic polynucleotide
acccgcatccaggatctctacactgygagtaagctggaagtggattgcctc

SEQ ID NO: 2139 - DNA, 51 bp, Artificial Sequence
  Synthetic polynucleotide
aagccaatcccaggaggaaaaacggyaagaagcagcccgaaccaaactttt

SEQ ID NO: 2140 - DNA, 51 bp, Artificial Sequence
  Synthetic polynucleotide
acaagggctggaactggacttcaggygagggctggggtgggcaggaatgga

SEQ ID NO: 2141 - DNA, 51 bp, Artificial Sequence
  Synthetic polynucleotide
cctgttctgtatttagcggaagaagyccctatagaaccatacaacatccca

SEQ ID NO: 2142 - DNA, 51 bp, Artificial Sequence
  Synthetic polynucleotide
tactgcatcatacagacacttgaggracttgatttctttgtccagtgagtc

SEQ ID NO: 2143 - DNA, 51 bp, Artificial Sequence
  Synthetic polynucleotide
gacattcaggatgaaaaccagctgcyggtggccgacgtgaagcggctggga

SEQ ID NO: 2144 - DNA, 51 bp, Artificial Sequence
  Synthetic polynucleotide
ctctgcagacgtggcgtgctgcaccyccaccagagccatggcatcgacgac

SEQ ID NO: 2145 - DNA, 51 bp, Artificial Sequence
  Synthetic polynucleotide
ctgatgaatttcagcacgtcctggcrcactgggctgtgggaggtctgtgag

SEQ ID NO: 2146 - DNA, 51 bp, Artificial Sequence
  Synthetic polynucleotide
gcgcgtggcatagtaatgagcgatcrgcagcatcgtcttgaactcctcatg

SEQ ID NO: 2147 - DNA, 51 bp, Artificial Sequence
  Synthetic polynucleotide
accgggaagatcaagagagctgttcygcagttcactcctgctagctggacc

SEQ ID NO: 2148 - DNA, 51 bp, Artificial Sequence
  Synthetic polynucleotide
ggaccccaaggagtccatcaagcagygtgagctgctcctggaggaaccaga

SEQ ID NO: 2149 - DNA, 51 bp, Artificial Sequence
  Synthetic polynucleotide
gaaaacagaaagtggacaatcatggyaagcaagaaacaaggaatggaggat

SEQ ID NO: 2150 - DNA, 51 bp, Artificial Sequence
  Synthetic polynucleotide
gttgtgtcatcaggctgtcatggtgyccctgctgacagattactcacctca

SEQ ID NO: 2151 - DNA, 51 bp, Artificial Sequence
  Synthetic polynucleotide
tgtcatcaggctgtcatggtgtcccygctgacagattactcacctcagctc

SEQ ID NO: 2152 - DNA, 51 bp, Artificial Sequence
  Synthetic polynucleotide
tgtcatggtgtccctgctgacagatbactcacctcagctccagaagcctaa

SEQ ID NO: 2153 - DNA, 51 bp, Artificial Sequence
  Synthetic polynucleotide
cgtgaccttctcactctaaaaaactytaccggagaagaaattaaatatatg

SEQ ID NO: 2154 - DNA, 51 bp, Artificial Sequence
  Synthetic polynucleotide
ctaaaaaactttaccggagaagaaabtaaatatatgctatggctatcagca

SEQ ID NO: 2155 - DNA, 51 bp, Artificial Sequence
  Synthetic polynucleotide
tttaccggagaagaaattaaatataygctatggctatcagcagatctgaaa

SEQ ID NO: 2156 - DNA, 51 bp, Artificial Sequence
  Synthetic polynucleotide
tatatgctatggctatcagcagatcygaaatttaggataaaacagaaagga

SEQ ID NO: 2157 - DNA, 51 bp, Artificial Sequence
  Synthetic polynucleotide
gtccttgatttatagtatttgccttyattgcaagggaagtccttaggcatg

SEQ ID NO: 2158 - DNA, 51 bp, Artificial Sequence
  Synthetic polynucleotide
gagaaaagaagtactcgaacaagatygtctacagaaacaggtaagtccact

SEQ ID NO: 2159 - DNA, 51 bp, Artificial Sequence
  Synthetic polynucleotide
cgtcctttacacaattaaaagaagaygctgtttaatctgaggatcctgtta

SEQ ID NO: 2160 - DNA, 51 bp, Artificial Sequence
  Synthetic polynucleotide
tgaaagtctcacggacacggcccggyttgtaaatattttcttctctccaaa

SEQ ID NO: 2161 - DNA, 51 bp, Artificial Sequence
  Synthetic polynucleotide
tttttcttggtttgccacagtgtatygtctagcatggcagatgcagtattg

SEQ ID NO: 2162 - DNA, 51 bp, Artificial Sequence
  Synthetic polynucleotide
tttcttggtttgccacagtgtattgyctagcatggcagatgcagtattggc

SEQ ID NO: 2163 - DNA, 51 bp, Artificial Sequence
  Synthetic polynucleotide
ttgtctagcatggcagatgcagtatyggctcgagtgtataaacaatcagat

SEQ ID NO: 2164 - DNA, 51 bp, Artificial Sequence
  Synthetic polynucleotide
gctcgagtgtataaacaatcagattbggacaccctggctaaagaagcatcc

SEQ ID NO: 2165 - DNA, 51 bp, Artificial Sequence
  Synthetic polynucleotide
ctggctaaagaagcatccatcccaaytatcaatgggctgtcagatttgtac

SEQ ID NO: 2166 - DNA, 51 bp, Artificial Sequence
  Synthetic polynucleotide
  misc_feature (26)..(26): n is a, c, g, t or u
gctaaagaagcatccatcccaattancaatgggctgtcagatttgtaccat

SEQ ID NO: 2167 - DNA, 51 bp, Artificial Sequence
  Synthetic polynucleotide
atccatcccaattatcaatgggctgycagatttgtaccatcctatccagat

SEQ ID NO: 2168 - DNA, 51 bp, Artificial Sequence
  Synthetic polynucleotide
ccatcctatccagatcctggctgatyacctcacgctccaggttggtttatt

SEQ ID NO: 2169 - DNA, 51 bp, Artificial Sequence
  Synthetic polynucleotide
cagatcctggctgattacctcacgcyccaggttggtttatttatttgtctt

SEQ ID NO: 2170 - DNA, 51 bp, Artificial Sequence
  Synthetic polynucleotide
ctctctgaaaggtcttaccctcagcbggatcggggatgggaacaatatcct

SEQ ID NO: 2171 - DNA, 51 bp, Artificial Sequence
  Synthetic polynucleotide
tggatcggggatgggaacaatatccygcactccatcatgatgagcgcagcg

SEQ ID NO: 2172 - DNA, 51 bp, Artificial Sequence
  Synthetic polynucleotide
caccttcaggcagctactccaaaggyagggaaactttttgccttgaaacta

SEQ ID NO: 2173 - DNA, 51 bp, Artificial Sequence
  Synthetic polynucleotide
gaagcagcgcatggaggcaatgtatyaattacagacacttggataagcatg

SEQ ID NO: 2174 - DNA, 51 bp, Artificial Sequence
  Synthetic polynucleotide
aggcaatgtattaattacagacactyggataagcatgggacaagaagagga

SEQ ID NO: 2175 - DNA, 51 bp, Artificial Sequence
  Synthetic polynucleotide
ttaattacagacacttggataagcaygggacaagaagaggagaagaaaaag

SEQ ID NO: 2176 - DNA, 51 bp, Artificial Sequence
  Synthetic polynucleotide
tgcctctgactggacatttttacacbgcttgcccagaaagccagaagaagt

SEQ ID NO: 2177 - DNA, 51 bp, Artificial Sequence
  Synthetic polynucleotide
ccagaagaagtggatgatgaagtctyttattctcctcgatcactagtgttc

SEQ ID NO: 2178 - DNA, 51 bp, Artificial Sequence
  Synthetic polynucleotide
cctggtggacggcgtccctttcagcygctgcaatcctagctcgccacggcc

SEQ ID NO: 2179 - DNA, 51 bp, Artificial Sequence
  Synthetic polynucleotide
ccaccagacggaggagctcaacctgygggtgcgtggctgcagggctgccct

SEQ ID NO: 2180 - DNA, 51 bp, Artificial Sequence
  Synthetic polynucleotide
agagtcaataatcctttcaagaaagrtactatttcatttcctcccaacttg

SEQ ID NO: 2181 - DNA, 51 bp, Artificial Sequence
  Synthetic polynucleotide
gggttcatgggtgagtccttgggacrgtggaaagcccggccaaactcctca

SEQ ID NO: 2182 - DNA, 51 bp, Artificial Sequence
  Synthetic polynucleotide
ggccggagatgggcactctcgggtcrtatctctagacctggggcttcacgg

SEQ ID NO: 2183 - DNA, 51 bp, Artificial Sequence
  Synthetic polynucleotide
tcttttgtttccttgtaggtacatgyttataggtgggaccaattttgccta

SEQ ID NO: 2184 - DNA, 51 bp, Artificial Sequence
  Synthetic polynucleotide
ttaggagttggaccactcattgtacycagagcactagaaggactaggagag

SEQ ID NO: 2185 - DNA, 51 bp, Artificial Sequence
  Synthetic polynucleotide
cccctcaccctgtggcaagtacatgygagtgcaggcggagcaggcagggcg

SEQ ID NO: 2186 - DNA, 51 bp, Artificial Sequence
  Synthetic polynucleotide
acctccatgttcactgggtctgcctytaaccgcagcatccatcgggtcttc

SEQ ID NO: 2187 - DNA, 51 bp, Artificial Sequence
  Synthetic polynucleotide
tctgaaggatgaccagccccatgggracctacaaataagatataaagaata

SEQ ID NO: 2188 - DNA, 51 bp, Artificial Sequence
  Synthetic polynucleotide
ccatgtctcccagaggggatgaacartatagtctatgaagcccacctagtt

SEQ ID NO: 2189 - DNA, 51 bp, Artificial Sequence
  Synthetic polynucleotide
ccttctgtcctctgtgttggagcaarcatgcctaactcagaaacacataca

SEQ ID NO: 2190 - DNA, 51 bp, Artificial Sequence
  Synthetic polynucleotide
caggacttcctggggctgcagtgaghatagctgctaacatcacacaattac

SEQ ID NO: 2191 - DNA, 51 bp, Artificial Sequence
  Synthetic polynucleotide
gcacctggagctccaggaggcaaggyagtatttcaatttattctctacctt

SEQ ID NO: 2192 - DNA, 51 bp, Artificial Sequence
  Synthetic polynucleotide
cggccaggacttcctggggctgcaghgagtatagctgctaacatcacacaa

SEQ ID NO: 2193 - DNA, 51 bp, Artificial Sequence
  Synthetic polynucleotide
cgagatggatctcctggtggcaaggbataataaacacatgtgcaattgatt

SEQ ID NO: 2194 - DNA, 51 bp, Artificial Sequence
  Synthetic polynucleotide
ccagctggccagcctggagataaggyaacccttaatactacctggatataa

SEQ ID NO: 2195 - DNA, 51 bp, Artificial Sequence
  Synthetic polynucleotide
ttccccggtcctaaaggaaatgatgbgagttccttcattaatttcttcaat

SEQ ID NO: 2196 - DNA, 51 bp, Artificial Sequence
  Synthetic polynucleotide
ctggtgaacctggaagagatgtgagyagcagtttttattcaaccagccagg

SEQ ID NO: 2197 - DNA, 51 bp, Artificial Sequence
  Synthetic polynucleotide
ggacgttggccctgtttgctttttayaaaccaaactctatctgaaatccca

SEQ ID NO: 2198 - DNA, 51 bp, Artificial Sequence
  Synthetic polynucleotide
ccccctggaggttctggacctgctgyaagttccttcctctttctctgtcta

SEQ ID NO: 2199 - DNA, 51 bp, Artificial Sequence
  Synthetic polynucleotide
tatactccaactggggagttccgtgyggaccgtgaaggttctccagtgctg

SEQ ID NO: 2200 - DNA, 51 bp, Artificial Sequence
  Synthetic polynucleotide
taacattccccagctggaagacgttyctcagttcctgcagagtaagtccac

SEQ ID NO: 2201 - DNA, 51 bp, Artificial Sequence
  Synthetic polynucleotide
ggacagaggacaatggcttccatggbaaggtgcctgcatgtacctgtgcta

SEQ ID NO: 2202 - DNA, 51 bp, Artificial Sequence
  Synthetic polynucleotide
ataccacttctcagcttgtgcaaacrgctgtcgcagaagtaacacattggt

SEQ ID NO: 2203 - DNA, 51 bp, Artificial Sequence
  Synthetic polynucleotide
cgccagccacagccctggtgcctggyggcacacaatggtgaccgctacgac

SEQ ID NO: 2204 - DNA, 51 bp, Artificial Sequence
  Synthetic polynucleotide
tttgtgttgataagctctacggtgtraagagttgcgagtgtggaacatgtc

SEQ ID NO: 2205 - DNA, 51 bp, Artificial Sequence
  Synthetic polynucleotide
cagatcaccgaccaggtgtccctgcyacgcctcacctggagcgagctgttc

SEQ ID NO: 2206 - DNA, 51 bp, Artificial Sequence
  Synthetic polynucleotide
tgcctatatatatttaaagatactcrctactatgcttccttctgggagttt

SEQ ID NO: 2207 - DNA, 51 bp, Artificial Sequence
  Synthetic polynucleotide
aggatcagatgaagcagatggaaggyaggaaccagttttgaatgttttcca

SEQ ID NO: 2208 - DNA, 51 bp, Artificial Sequence
  Synthetic polynucleotide
catatgtctttattggcgtgcgctcytgaggttgtaatggccacatatagc

SEQ ID NO: 2209 - DNA, 51 bp, Artificial Sequence
  Synthetic polynucleotide
gctattgttaatgcagtaccctgctytgctttggatggacaatggattcta

SEQ ID NO: 2210 - DNA, 51 bp, Artificial Sequence
  Synthetic polynucleotide
tcggtcagcggcggggtggtgagcgrgcccgcgtaggtccagtaatcccag

SEQ ID NO: 2211 - DNA, 51 bp, Artificial Sequence
  Synthetic polynucleotide
tccctgagtcgggaggccaagccatrtaacaggatcccggtagctttgtca

SEQ ID NO: 2212 - DNA, 51 bp, Artificial Sequence
  Synthetic polynucleotide
ggcatcaagttgaccatcaacaaacycctggacatggcagcccaagtaagg

SEQ ID NO: 2213 - DNA, 51 bp, Artificial Sequence
  Synthetic polynucleotide
taccaagtcattcacataatttttcrgctgatcaacaatatctataagttg

SEQ ID NO: 2214 - DNA, 51 bp, Artificial Sequence
  Synthetic polynucleotide
tgtggcaagatcagctttgagctgaygcgggagccgtgcatcacgcccagt

SEQ ID NO: 2215 - DNA, 51 bp, Artificial Sequence
  Synthetic polynucleotide
tcagaacacttcccatcctccgcagygtaaccagctctttgagctcctgca

SEQ ID NO: 2216 - DNA, 51 bp, Artificial Sequence
  Synthetic polynucleotide
ctgaagtaccccatcgagcacggcaycgtcaccaactgggacgacatggag

SEQ ID NO: 2217 - DNA, 51 bp, Artificial Sequence
  Synthetic polynucleotide
aaccccaaggccaaccgcgagaagaygacccaggtgagtggcccgctacct

SEQ ID NO: 2218 - DNA, 51 bp, Artificial Sequence
  Synthetic polynucleotide
tacacttactgatggtcattcagcayggactgggacaggtaatactaaaaa

SEQ ID NO: 2219 - DNA, 51 bp, Artificial Sequence
  Synthetic polynucleotide
ctggagagagccaaagtaccataggyaaatacatatttactacttgggatt

SEQ ID NO: 2220 - DNA, 51 bp, Artificial Sequence
  Synthetic polynucleotide
cgaggcggatcgggtgttgcatccahggagcgagctgagagctcgaggtga

SEQ ID NO: 2221 - DNA, 51 bp, Artificial Sequence
  Synthetic polynucleotide
atgccacgtacctcttctgctgtccrgaaggaagcctgtgcctgtttatac

SEQ ID NO: 2222 - DNA, 51 bp, Artificial Sequence
  Synthetic polynucleotide
ctcgatgagaatttgaaagccatagraacagcgagcctctggaacctgcac

SEQ ID NO: 2223 - DNA, 51 bp, Artificial Sequence
  Synthetic polynucleotide
ttaaaagaaactcaagtttgtactcrccgattttcaaaacataacacgcat

SEQ ID NO: 2224 - DNA, 51 bp, Artificial Sequence
  Synthetic polynucleotide
aaacataacacgcattcattgggatragtatttccatcagtcccacagaca

SEQ ID NO: 2225 - DNA, 51 bp, Artificial Sequence
  Synthetic polynucleotide
gcggatgtagctcagcatgatgcccrgggtgaagaagccgaagaatcccag

SEQ ID NO: 2226 - DNA, 51 bp, Artificial Sequence
  Synthetic polynucleotide
cgtttgtaaagcacatctccaaaggyagcgggttccgttccttgtaataat

SEQ ID NO: 2227 - DNA, 51 bp, Artificial Sequence
  Synthetic polynucleotide
cacctgccctgtccttctgcaggacygccccattgcctgggccaacctcat

SEQ ID NO: 2228 - DNA, 51 bp, Artificial Sequence
  Synthetic polynucleotide
tacattgggttgcccttgaccctcaytgtgattgaagtcatcccgttcctg

SEQ ID NO: 2229 - DNA, 51 bp, Artificial Sequence
  Synthetic polynucleotide
gggagtgccggggccaccattcggcygtacatcgatagctatgagaaggac

SEQ ID NO: 2230 - DNA, 51 bp, Artificial Sequence
  Synthetic polynucleotide
ttggttgatcctttgggtgaaatgtyggcaccatcctgggaggaacatgcc

SEQ ID NO: 2231 - DNA, 51 bp, Artificial Sequence
  Synthetic polynucleotide
gaattacaacaatcagtcttcaaatbttggacccatgaagggaggaaattt

SEQ ID NO: 2232 - DNA, 51 bp, Artificial Sequence
  Synthetic polynucleotide
ttttggacccatgaagggaggaaatyttggaggcagaagctctggccccta

SEQ ID NO: 2233 - DNA, 51 bp, Artificial Sequence
  Synthetic polynucleotide
ggtggtgcttccctcaagcccgaatycgtggacatcatcaatgccaaacaa

SEQ ID NO: 2234 - DNA, 51 bp, Artificial Sequence
  Synthetic polynucleotide
tctgacgacattgaagctagccgaaygtaagtgtaacttggttgagactgt

SEQ ID NO: 2235 - DNA, 51 bp, Artificial Sequence
  Synthetic polynucleotide
attgaaactgcctttctcaatgcachtgtatatttgtcacctaacgtggaa

SEQ ID NO: 2236 - DNA, 51 bp, Artificial Sequence
  Synthetic polynucleotide
agtggagactggaatcccttacacaytgatcctaactttgctagtctagca

SEQ ID NO: 2237 - DNA, 51 bp, Artificial Sequence
  Synthetic polynucleotide
gtccatttgatcattgtctctggtgrgcgatataggaatattaatttggca

SEQ ID NO: 2238 - DNA, 51 bp, Artificial Sequence
  Synthetic polynucleotide
gcacctcaggcccacagaggtcctcrccgcggtaggtcagattgtccgggt

SEQ ID NO: 2239 - DNA, 51 bp, Artificial Sequence
  Synthetic polynucleotide
gccgatgaacgcgttcatggtatggyccaagatcgaacgcaggaagatcat

SEQ ID NO: 2240 - DNA, 51 bp, Artificial Sequence
  Synthetic polynucleotide
tgatgtatgtatctaattaaccttgraagtcgtaataaacgcaagagactg

SEQ ID NO: 2241 - DNA, 51 bp, Artificial Sequence
  Synthetic polynucleotide
caccagtggcaaagaatgcgctctaygtggagagtggcccaccatgcctca

SEQ ID NO: 2242 - DNA, 51 bp, Artificial Sequence
  Synthetic polynucleotide
ctgaatgcccaagtccttcagcaccrggagccctgcaccagccagcagaca

SEQ ID NO: 2243 - DNA, 51 bp, Artificial Sequence
  Synthetic polynucleotide
cgcaaaatactccttcagcggagcgragaggtggcggatgactggcacgct

SEQ ID NO: 2244 - DNA, 51 bp, Artificial Sequence
  Synthetic polynucleotide
gaggaagaccagaaggatgtacatcrtgatttctgagaccacagaggtgaa

SEQ ID NO: 2245 - DNA, 51 bp, Artificial Sequence
  Synthetic polynucleotide
ttctccatgtatgccccagccttcaygatggtggtgatcagcctggaccgc

SEQ ID NO: 2246 - DNA, 51 bp, Artificial Sequence
  Synthetic polynucleotide
gcagacgcctaccttaatgaaaccgrtatccttcgcgtactgacggaaaca

SEQ ID NO: 2247 - DNA, 51 bp, Artificial Sequence
  Synthetic polynucleotide
cagggtacagggcagcatgatgtacrgcggattgaggccgatggagcgaga

SEQ ID NO: 2248 - DNA, 51 bp, Artificial Sequence
  Synthetic polynucleotide
ttttcaagaaaatagctataataccbatgcctcagcaatacatagaactga

SEQ ID NO: 2249 - DNA, 51 bp, Artificial Sequence
  Synthetic polynucleotide
agaggacccttttcactcttggaggyaataaaaatttcatcatctactatt

SEQ ID NO: 2250 - DNA, 51 bp, Artificial Sequence
  Synthetic polynucleotide
gtgttggagcagctcaatggaagacrggatctgaaacaaagcccaagaatg

SEQ ID NO: 2251 - DNA, 51 bp, Artificial Sequence
  Synthetic polynucleotide
gtcagagcccttaacctttttcaggbaaaaaaaaaaaaaaaaaaaaaaaaa

SEQ ID NO: 2252 - DNA, 51 bp, Artificial Sequence
  Synthetic polynucleotide
gggaggggatggggcagctgcgccaygtgcaccacccttttcctgctcagc

SEQ ID NO: 2253 - DNA, 51 bp, Artificial Sequence
  Synthetic polynucleotide
agccacaaagtttttatgtggatcartatcctcggaaagaattagactgtt

SEQ ID NO: 2254 - DNA, 51 bp, Artificial Sequence
  Synthetic polynucleotide
tcctaaattgacaggtgaagtatgcygtccagatgaacagcacaatcgggt

SEQ ID NO: 2255 - DNA, 51 bp, Artificial Sequence
  Synthetic polynucleotide
gaggctcgctccctcagcacagagcycttcaaactcaagaacgcctatgag

SEQ ID NO: 2256 - DNA, 51 bp, Artificial Sequence
  Synthetic polynucleotide
gagacacgcagccgcaacgaggcccygagggtgaagaagaagatggaagga

SEQ ID NO: 2257 - DNA, 51 bp, Artificial Sequence
  Synthetic polynucleotide
gaggcccagaagcaagtcaagagccyccagagcttgttgaaggtactcacc

SEQ ID NO: 2258 - DNA, 51 bp, Artificial Sequence
  Synthetic polynucleotide
aatctcatgaagacccctctctttgyggtcatcacttgtgcaatccagatg

SEQ ID NO: 2259 - DNA, 51 bp, Artificial Sequence
  Synthetic polynucleotide
gcgcaagaggctgcggtgagccaagygagtacagcgcacctgggggggcgc

SEQ ID NO: 2260 - DNA, 51 bp, Artificial Sequence
  Synthetic polynucleotide
cctggagaaagtgaaattgaccaacyttttactattcagaaggtgctagga

SEQ ID NO: 2261 - DNA, 51 bp, Artificial Sequence
  Synthetic polynucleotide
ctcaccttctgctccgttgtggaccycatcaatcactaccgccacgagtct

SEQ ID NO: 2262 - DNA, 51 bp, Artificial Sequence
  Synthetic polynucleotide
ttcctgctctttgtgctggagaacaygctggggcttttgcggcaccgaggg

SEQ ID NO: 2263 - DNA, 51 bp, Artificial Sequence
  Synthetic polynucleotide
ccttgctgcctccagccagcgcagcrcgtgggcacctgggagctgcgagca

SEQ ID NO: 2264 - DNA, 51 bp, Artificial Sequence
  Synthetic polynucleotide
ggggcacttgtgaccggcccggcgcygtacggcctgctgacctatgtgacc

SEQ ID NO: 2265 - DNA, 51 bp, Artificial Sequence
  Synthetic polynucleotide
cgtgaggccatcaaccgggcccgacygcgggatgctggtggcttggatcta

SEQ ID NO: 2266 - DNA, 51 bp, Artificial Sequence
  Synthetic polynucleotide
ataatcctatttattacctcagaagyttttttcttcgcaggatttttctga

SEQ ID NO: 2267 - DNA, 51 bp, Artificial Sequence
  Synthetic polynucleotide
actagtcacagccctatactccctcyacatatttaccacaacacaatgggg

SEQ ID NO: 2268 - DNA, 51 bp, Artificial Sequence
  Synthetic polynucleotide
atcagctcggtccagaagctggttcygtatgagactagagctgtgagtacc

SEQ ID NO: 2269 - DNA, 51 bp, Artificial Sequence
  Synthetic polynucleotide
tcaagaaattcaaggacagtgaaggyagatatatatatatatatatatata

SEQ ID NO: 2270 - DNA, 51 bp, Artificial Sequence
  Synthetic polynucleotide
ccatctgataagattaaaaagttccycacggagtcccatgaccgacaggcc

SEQ ID NO: 2271 - DNA, 51 bp, Artificial Sequence
  Synthetic polynucleotide
atcttcatagtggttttcttcatggrataccaccgggttttccaagtggcc

SEQ ID NO: 2272 - DNA, 51 bp, Artificial Sequence
  Synthetic polynucleotide
tcgaaggagcccagcgtgttgatgcrcttgcccgcatgctcgcaggggttg

SEQ ID NO: 2273 - DNA, 51 bp, Artificial Sequence
  Synthetic polynucleotide
gatgattcagattgacacatacagtyataacaatcgtagcaataaacccat

SEQ ID NO: 2274 - DNA, 51 bp, Artificial Sequence
  Synthetic polynucleotide
cgcaggttaatccccagaggctccayggagttccctggcctggggtccctg

SEQ ID NO: 2275 - DNA, 51 bp, Artificial Sequence
  Synthetic polynucleotide
tactgtggtggctccgctcagctcaygagggcacagagcatggcctccaga

SEQ ID NO: 2276 - DNA, 51 bp, Artificial Sequence
  Synthetic polynucleotide
ggcgcgggcggcaacaagagccgccytactctctccatgtcagtggccgtg

SEQ ID NO: 2277 - DNA, 51 bp, Artificial Sequence
  Synthetic polynucleotide
ttctgggcaaaccagaatttgacttytagtaaggtaagtttaagttttaga

SEQ ID NO: 2278 - DNA, 51 bp, Artificial Sequence
  Synthetic polynucleotide
taagacctgggctcactgcatgtccyacagcaactccgcgctgaacccgct

SEQ ID NO: 2279 - DNA, 51 bp, Artificial Sequence
  Synthetic polynucleotide
aaagcttgatacgattagcagaaggyctatttcattcagcgaatgatgctt

SEQ ID NO: 2280 - DNA, 51 bp, Artificial Sequence
  Synthetic polynucleotide
gacatgtggtcggtgggctgtattcytggggagcttagcgatggacagcct

SEQ ID NO: 2281 - DNA, 51 bp, Artificial Sequence
  Synthetic polynucleotide
gagaaattctccaacaacaacgaggyattgccagcagtgcaggcggcccct

SEQ ID NO: 2282 - DNA, 51 bp, Artificial Sequence
  Synthetic polynucleotide
ttcaggatggccacgctgcccgtccrctccgcagggttggcgccgtctgtg

SEQ ID NO: 2283 - DNA, 51 bp, Artificial Sequence
  Synthetic polynucleotide
gctccggttcctgaagtacagggtgrggttgaaggcctggccccggcgaac

SEQ ID NO: 2284 - DNA, 51 bp, Artificial Sequence
  Synthetic polynucleotide
taccttcattccttcaaactgggacrgcgcacgaagaggcctcagtgctcg

SEQ ID NO: 2285 - DNA, 51 bp, Artificial Sequence
  Synthetic polynucleotide
gggctctactcagtcttcttcttcaytgtggtcattttcctgggctccttc

SEQ ID NO: 2286 - DNA, 51 bp, Artificial Sequence
  Synthetic polynucleotide
catgatcctgagactttggaagcaaytgcagaaaatgcaaaaggcttggct

SEQ ID NO: 2287 - DNA, 51 bp, Artificial Sequence
  Synthetic polynucleotide
taatgaataggttttgatggcacttyatttgactactttaatggttatgaa

SEQ ID NO: 2288 - DNA, 51 bp, Artificial Sequence
  Synthetic polynucleotide
atagacacctatggaaagatgtgggyaagaagactgcagaaatcttgacat

SEQ ID NO: 2289 - DNA, 51 bp, Artificial Sequence
  Synthetic polynucleotide
tggggtctacggacaaaaacagataytaaaaaggttagaaaaagctaaatt

SEQ ID NO: 2290 - DNA, 51 bp, Artificial Sequence
  Synthetic polynucleotide
tcaagaacatgatatcactaatttcyatatgctcaccctagacaaagtaag

SEQ ID NO: 2291 - DNA, 51 bp, Artificial Sequence
  Synthetic polynucleotide
aaaaaatatgctggattcattcatgyatgtattttaacattttataaccta

SEQ ID NO: 2292 - DNA, 51 bp, Artificial Sequence
  Synthetic polynucleotide
ggaggacggacgttactctgtggacyactccaagtttggcaacaccgtcaa

SEQ ID NO: 2293 - DNA, 51 bp, Artificial Sequence
  Synthetic polynucleotide
ctcttcatttttcgcattatgatccycgttgtggctgcaaaggaggtgtgg

SEQ ID NO: 2294 - DNA, 51 bp, Artificial Sequence
  Synthetic polynucleotide
ctttaatgtgcttttacttccggaayactcaagcaaagaaaaacttaaaga

SEQ ID NO: 2295 - DNA, 51 bp, Artificial Sequence
  Synthetic polynucleotide
gccatcttcctgcacttctccctgcycacctgcctttcctggatgggcctc

SEQ ID NO: 2296 - DNA, 51 bp, Artificial Sequence
  Synthetic polynucleotide
ccgagagcatgagcatgtggtagaaygcatttcctgggctccagaaagctc

SEQ ID NO: 2297 - DNA, 51 bp, Artificial Sequence
  Synthetic polynucleotide
gtggacagctggaaggcctcgttccyccgagctggcgtctaccccgagaag

SEQ ID NO: 2298 - DNA, 51 bp, Artificial Sequence
  Synthetic polynucleotide
ctggagaccggggttgtcaaaaaacyctacactctggatggaaaacaggta

SEQ ID NO: 2299 - DNA, 51 bp, Artificial Sequence
  Synthetic polynucleotide
tcttttgagcaagtcctcactgataycacagaagccatcaaactggagacc

SEQ ID NO: 2300 - DNA, 51 bp, Artificial Sequence
  Synthetic polynucleotide
agacaacttctttaaaaaggtggagyacaccaagaatgtcaatcccaactg

SEQ ID NO: 2301 - DNA, 51 bp, Artificial Sequence
  Synthetic polynucleotide
ttgctggctgacctgacgcgatctcygtctgacaacatcaacctgcctcag

SEQ ID NO: 2302 - DNA, 51 bp, Artificial Sequence
  Synthetic polynucleotide
tgtagcttctaccgaaccagaacctygcaggcactgagtaatgagaagaaa

SEQ ID NO: 2303 - DNA, 51 bp, Artificial Sequence
  Synthetic polynucleotide
aggtctctgaggttccaccaaaatayggaacttgattttggacactttgac

SEQ ID NO: 2304 - DNA, 51 bp, Artificial Sequence
  Synthetic polynucleotide
tcttctctaatacttgatgttcctcygggtgtgatctcgagaattgaaaaa

SEQ ID NO: 2305 - DNA, 51 bp, Artificial Sequence
  Synthetic polynucleotide
aactttctgacttaaccataggtgcygtcatggattcatccagaaaataag

SEQ ID NO: 2306 - DNA, 51 bp, Artificial Sequence
  Synthetic polynucleotide
tcataatattcatgttatgcgggaayctttaaaaaaagtgaaggacattgt

SEQ ID NO: 2307 - DNA, 51 bp, Artificial Sequence
  Synthetic polynucleotide
tgtgtgtggcaaatgtcaaaacaggyaaggaatatgagggatgaaaataca

SEQ ID NO: 2308 - DNA, 51 bp, Artificial Sequence
  Synthetic polynucleotide
gtttttgtttagttccctacagcttytgaattcaatgaacaatttttgatt

SEQ ID NO: 2309 - DNA, 51 bp, Artificial Sequence
  Synthetic polynucleotide
ctgtatagttgccgatttggtacttycttattcaactgtgaatctgctcga

SEQ ID NO: 2310 - DNA, 51 bp, Artificial Sequence
  Synthetic polynucleotide
ggttacagaaaggactgtttctttayggtcactgataaacagtaataaaga

SEQ ID NO: 2311 - DNA, 51 bp, Artificial Sequence
  Synthetic polynucleotide
tctcttcttttcttcagggaaagagyatgccaagggagacagccgatacat

SEQ ID NO: 2312 - DNA, 51 bp, Artificial Sequence
  Synthetic polynucleotide
gagcctgcctgtgccacaggccgccygatcttcgacaacctaaagaagtcc

SEQ ID NO: 2313 - DNA, 51 bp, Artificial Sequence
  Synthetic polynucleotide
gtggccctgtctcacatcgctgggcyctgcaatcgcgctgtcttcaagggt

SEQ ID NO: 2314 - DNA, 51 bp, Artificial Sequence
  Synthetic polynucleotide
gaaccgcatgacagtcgcccacatgyggtttgacaaccagatccacgaggc

SEQ ID NO: 2315 - DNA, 51 bp, Artificial Sequence
  Synthetic polynucleotide
atctgctcagataagacagggacccycactcagaaccgcatgacagtcgcc

SEQ ID NO: 2316 - DNA, 51 bp, Artificial Sequence
  Synthetic polynucleotide
ctttctgtccttcatttcaggtcccygtgctgctggagttgtgggaatcaa

SEQ ID NO: 2317 - DNA, 51 bp, Artificial Sequence
  Synthetic polynucleotide
gttcactgcatcttctttttctgaargccatgcactaaaaaggcactgcaa

SEQ ID NO: 2318 - DNA, 51 bp, Artificial Sequence
  Synthetic polynucleotide
cagcaactaccccagctctgagaccyttgaggagatccagttttttaatgg

SEQ ID NO: 2319 - DNA, 51 bp, Artificial Sequence
  Synthetic polynucleotide
ggtgtcacagcctccgttcattatcrtacattcatcaatatctgtgaaaac

SEQ ID NO: 2320 - DNA, 51 bp, Artificial Sequence
  Synthetic polynucleotide
accttccaaactgaagcgctcctacycctccccagatataacccaggctat

SEQ ID NO: 2321 - DNA, 51 bp, Artificial Sequence
  Synthetic polynucleotide
cctctttctgagggaaaggacaagaygaagtggaaggcgcttttcaccgcg

SEQ ID NO: 2322 - DNA, 51 bp, Artificial Sequence
  Synthetic polynucleotide
aaatccattcgtttccgtcccacgcyggtcttcagggatcaccacgctcac

SEQ ID NO: 2323 - DNA, 51 bp, Artificial Sequence
  Synthetic polynucleotide
acccacagacccaccttccagcagayctgctccttccttcaggagcaggcc

SEQ ID NO: 2324 - DNA, 51 bp, Artificial Sequence
  Synthetic polynucleotide
cttggcctttgcagggctgaatcccyaccctggcatcctggtgaacagcaa

SEQ ID NO: 2325 - DNA, 51 bp, Artificial Sequence
  Synthetic polynucleotide
gtgaagtggatggccccagagagcayctttgactgtgtctacacggttcag

SEQ ID NO: 2326 - DNA, 51 bp, Artificial Sequence
  Synthetic polynucleotide
tggggactgtcatcccaggcccgccygcctgtgaagtggatggccccagag

SEQ ID NO: 2327 - DNA, 51 bp, Artificial Sequence
  Synthetic polynucleotide
gaacatcgtcaaccttctgggagccygtacccatggaggtaagggccttgg

SEQ ID NO: 2328 - DNA, 51 bp, Artificial Sequence
  Synthetic polynucleotide
aagtgggagttcccccggaacaaccygcagtttggtgagatggcagctcat

SEQ ID NO: 2329 - DNA, 51 bp, Artificial Sequence
  Synthetic polynucleotide
aattcccaggagcacctggatcttcyccagcaggtgagcctaaacaccaca

SEQ ID NO: 2330 - DNA, 51 bp, Artificial Sequence
  Synthetic polynucleotide
agcagcggtaggcccgggccccaccrtgactcttcagtgacagtttttctt

SEQ ID NO: 2331 - DNA, 51 bp, Artificial Sequence
  Synthetic polynucleotide
  misc_feature (26)..(26): n is a, c, g, t or u
ggcaactccagcccccgaacccaggngagttgtctctgctttgtctccaaa

SEQ ID NO: 2332 - DNA, 51 bp, Artificial Sequence
  Synthetic polynucleotide
agaaaccccctgtgcaccctgtgccyggaggagcgcaggcacccaacagcc

SEQ ID NO: 2333 - DNA, 51 bp, Artificial Sequence
  Synthetic polynucleotide
tcgggaccacccgaacccgcggccayggccccggccgccgccagccccccg

SEQ ID NO: 2334 - DNA, 51 bp, Artificial Sequence
  Synthetic polynucleotide
aatgcttctacaacatcagtagcatraaggaagtttcttgtttgaagccct

SEQ ID NO: 2335 - DNA, 51 bp, Artificial Sequence
  Synthetic polynucleotide
gtgaaccttctcatccctttccaggygggactggcccccttccctgtcccc

SEQ ID NO: 2336 - DNA, 51 bp, Artificial Sequence
  Synthetic polynucleotide
ctcatgtgcccccccagccaggctcdccctgcacaatgagctcagccagcg

SEQ ID NO: 2337 - DNA, 51 bp, Artificial Sequence
  Synthetic polynucleotide
gcggccatccctgagggacagttcahtgatagcaggaagggggcagagaag

SEQ ID NO: 2338 - DNA, 51 bp, Artificial Sequence
  Synthetic polynucleotide
tgccagcatggctgccagaacatcaytgggggctacaggtgcagctgcccc

SEQ ID NO: 2339 - DNA, 51 bp, Artificial Sequence
  Synthetic polynucleotide
ggctgctgatgacacctgggagccayttgcctctgggtaagttgccaaaga

SEQ ID NO: 2340 - DNA, 51 bp, Artificial Sequence
  Synthetic polynucleotide
gaggttgcggcggaagcggagaccaygttccgagcggcggctccggggcag

SEQ ID NO: 2341 - DNA, 51 bp, Artificial Sequence
  Synthetic polynucleotide
gcgggccgggcgcggggaggtgtcaygcgccggaacctgcgcttggggcca

SEQ ID NO: 2342 - DNA, 51 bp, Artificial Sequence
  Synthetic polynucleotide
ctcagtgctgagcccatctgaggccygtggcctgctcctgggctccacctg

SEQ ID NO: 2343 - DNA, 51 bp, Artificial Sequence
  Synthetic polynucleotide
ttcctggaattggaggcatcgcaggyaacatctgtcccagcagggggcggg

SEQ ID NO: 2344 - DNA, 51 bp, Artificial Sequence
  Synthetic polynucleotide
tggacatcttttaaccaggagagaaytgttgatgttgctggaccagggggt

SEQ ID NO: 2345 - DNA, 51 bp, Artificial Sequence
  Synthetic polynucleotide
gagcacccctgcctggtggagctgcygtcccatgtgctgaaagtccaggac

SEQ ID NO: 2346 - DNA, 51 bp, Artificial Sequence
  Synthetic polynucleotide
ctctacgggtctcaccctttctaccbggcgctggaggacggcgggtcggca

SEQ ID NO: 2347 - DNA, 51 bp, Artificial Sequence
  Synthetic polynucleotide
aatgtgtcccagggtattttattacytctcatgttaaaacaacatttgaag

SEQ ID NO: 2348 - DNA, 51 bp, Artificial Sequence
  Synthetic polynucleotide
attctttagcttcaaggcgtagtcadtgtcactggtggtgagcttctgccg

SEQ ID NO: 2349 - DNA, 51 bp, Artificial Sequence
  Synthetic polynucleotide
attgacaatgggaagcagcgtgagtytgagagccggctggcggatgcgctg

SEQ ID NO: 2350 - DNA, 51 bp, Artificial Sequence
  Synthetic polynucleotide
ggactggatccacagcaacatctacyggaccgactctgtcctgggcactgt

SEQ ID NO: 2351 - DNA, 51 bp, Artificial Sequence
  Synthetic polynucleotide
catgaacaattctccatttgacttaygtcatgttttgttatctttattaga

SEQ ID NO: 2352 - DNA, 51 bp, Artificial Sequence
  Synthetic polynucleotide
cttacagggcgaggcacggtgtgagygccgcctggaggtgcgaggtgagga

SEQ ID NO: 2353 - DNA, 51 bp, Artificial Sequence
  Synthetic polynucleotide
ttcagcaagcagggagtgttgactcyggagattagaaagccctgccccttt

SEQ ID NO: 2354 - DNA, 51 bp, Artificial Sequence
  Synthetic polynucleotide
cagaaagccgacaagaagaccatggbgagcccagggtctggggtccccacg

SEQ ID NO: 2355 - DNA, 51 bp, Artificial Sequence
  Synthetic polynucleotide
cgcaaaggaccaggcggtgttcaaaygtgaggtctcagatgagaatgttcg

SEQ ID NO: 2356 - DNA, 51 bp, Artificial Sequence
  Synthetic polynucleotide
atcggaggagggggcgcaagtcaaabggtgagttccagaagcacggggcat

SEQ ID NO: 2357 - DNA, 51 bp, Artificial Sequence
  Synthetic polynucleotide
tgcccagcctgccttcactggcagcyaccgctgtgaggtgtccaccaagga

SEQ ID NO: 2358 - DNA, 51 bp, Artificial Sequence
  Synthetic polynucleotide
ggagcccccgatgaccccattggccycttcgtgatgcggccacaggatggc

SEQ ID NO: 2359 - DNA, 51 bp, Artificial Sequence
  Synthetic polynucleotide
gatgctgaggagcgctgtgatcagcygatcaaaaacaagattcagctggag

SEQ ID NO: 2360 - DNA, 51 bp, Artificial Sequence
  Synthetic polynucleotide
tcgggccttcatgggggtcaagaatyggccctggatgaagctctacttcaa

SEQ ID NO: 2361 - DNA, 51 bp, Artificial Sequence
  Synthetic polynucleotide
gtcctggacatcgctggcttcgagaycttcgatgtgagttgggacccctgg

SEQ ID NO: 2362 - DNA, 51 bp, Artificial Sequence
  Synthetic polynucleotide
cacttcagaggagaaaaactccatgyataagctgacaggcgccatcatgca

SEQ ID NO: 2363 - DNA, 51 bp, Artificial Sequence
  Synthetic polynucleotide
cgtccggaacgacaactcctcccgcytcgtgagtggtccctgaccttggcc

SEQ ID NO: 2364 - DNA, 51 bp, Artificial Sequence
  Synthetic polynucleotide
ctgcctgatggccaagtcatcactaytggcaatgagcgcttccgctgtcct

SEQ ID NO: 2365 - DNA, 51 bp, Artificial Sequence
  Synthetic polynucleotide
  misc_feature (26)..(26): n is a, c, g, t or u
gcagcagaagaagcggctggaagccnttctcacccagaaagccaaggtcgg

SEQ ID NO: 2366 - DNA, 51 bp, Artificial Sequence
  Synthetic polynucleotide
ccagaactacatctgggctgcgcgcytgcgcttcgcttcctggccctcgtt

SEQ ID NO: 2367 - DNA, 51 bp, Artificial Sequence
  Synthetic polynucleotide
tatctagactttgtctttgctgtggygagtaacagattttttaaagttagg

SEQ ID NO: 2368 - DNA, 51 bp, Artificial Sequence
  Synthetic polynucleotide
tcgcgcgagccctcccaggtcatctyctgcaatcgcagtccgcgcgtcgtg

SEQ ID NO: 2369 - DNA, 51 bp, Artificial Sequence
  Synthetic polynucleotide
ccgcgcgtcgtgctgcccgtatggchcaacttcgacggcgagccgcagccc

SEQ ID NO: 2370 - DNA, 51 bp, Artificial Sequence
  Synthetic polynucleotide
gtttttgcccttccagtgtatactchgaaagagcgatgcctccaggttgtc

SEQ ID NO: 2371 - DNA, 51 bp, Artificial Sequence
  Synthetic polynucleotide
gcagtgtagctacttcttctattggyaatcttcttgtacatatagtagatt

SEQ ID NO: 2372 - DNA, 51 bp, Artificial Sequence
  Synthetic polynucleotide
aggtgttggaaaaacacaattatggyaaaataaagtgttctccttttaagg

SEQ ID NO: 2373 - DNA, 51 bp, Artificial Sequence
  Synthetic polynucleotide
cacaaggacatcaagccggggaaccygctgctcaccaccggtggcaccctc

SEQ ID NO: 2374 - DNA, 51 bp, Artificial Sequence
  Synthetic polynucleotide
ggacaacacgcaggtgcccagctacygcctgaatgcacgcggcgagggggc

SEQ ID NO: 2375 - DNA, 51 bp, Artificial Sequence
  Synthetic polynucleotide
actgaagggatctgcaggaatcgtgygactaataatgtaaaagacgtcact

SEQ ID NO: 2376 - DNA, 51 bp, Artificial Sequence
  Synthetic polynucleotide
gcagtgcctgcagcgccggcggcgaygcggtcagttctgttcacccggacc

SEQ ID NO: 2377 - DNA, 51 bp, Artificial Sequence
  Synthetic polynucleotide
tagtgaagaagaaatccgtgaggcaytccgagtctttgacaaggtaatcca

SEQ ID NO: 2378 - DNA, 51 bp, Artificial Sequence
  Synthetic polynucleotide
gaagatagaaagaatattctcaggcytcaagatttggtagataaacttcag

SEQ ID NO: 2379 - DNA, 51 bp, Artificial Sequence
  Synthetic polynucleotide
ctacgagtgcattctctgtgcctgcygtagcaccagctgccccagctactg

SEQ ID NO: 2380 - DNA, 51 bp, Artificial Sequence
  Synthetic polynucleotide
aaagggacgaactggtgtaatgataygtgcatatttattacatcggggcaa

SEQ ID NO: 2381 - DNA, 51 bp, Artificial Sequence
  Synthetic polynucleotide
atgtgtgttctgaaattgtgaaccaygagtctagtacttaatgatctgctt

SEQ ID NO: 2382 - DNA, 51 bp, Artificial Sequence
  Synthetic polynucleotide
ggtcctggaaaaaagcttgggagttyggttgtatttactgccagcctcttg

SEQ ID NO: 2383 - DNA, 51 bp, Artificial Sequence
  Synthetic polynucleotide
tatgtgtattattatagctacctgtyaaagaatcatctggattatagacca

SEQ ID NO: 2384 - DNA, 51 bp, Artificial Sequence
  Synthetic polynucleotide
acgcagggcgtcaggacgcagggtcrtggagcctccgtttctctcgcattc

SEQ ID NO: 2385 - DNA, 51 bp, Artificial Sequence
  Synthetic polynucleotide
aacctggtggacaatgacttcccacyggacaactgcctctggcaggtggtg

SEQ ID NO: 2386 - DNA, 51 bp, Artificial Sequence
  Synthetic polynucleotide
ctgtggattgagcggtggggaaagcygtatgaggaggagtccccgtcccgc

SEQ ID NO: 2387 - DNA, 51 bp, Artificial Sequence
  Synthetic polynucleotide
agcgggggctatgtcttccagaaggygtggtagggaggcacggggtgcccc

SEQ ID NO: 2388 - DNA, 51 bp, Artificial Sequence
  Synthetic polynucleotide
cctggagaccatcctgcacatgaccygctgccgtcagcgcctggaggagat

SEQ ID NO: 2389 - DNA, 51 bp, Artificial Sequence
  Synthetic polynucleotide
aacccctggacggccgggatcattgygagtgtattataaggggctttgtgg

SEQ ID NO: 2390 - DNA, 51 bp, Artificial Sequence
  Synthetic polynucleotide
gtgctggagcctggggactccttccyggttggggccaatggcatttggggg

SEQ ID NO: 2391 - DNA, 51 bp, Artificial Sequence
  Synthetic polynucleotide
cttcctggttggggccaatggcattygggggcagcgagccgtggacatcgg

SEQ ID NO: 2392 - DNA, 51 bp, Artificial Sequence
  Synthetic polynucleotide
actcggcagaggctggtgctggagaytggggacccagaaggtacctctagc

SEQ ID NO: 2393 - DNA, 51 bp, Artificial Sequence
  Synthetic polynucleotide
cgccatcgccgcggagccggcggccracagccctttctgcagcggggaggt

SEQ ID NO: 2394 - DNA, 51 bp, Artificial Sequence
  Synthetic polynucleotide
gtatacatacccagtggccacccagygtcactgtggcaagtgtgacagcga

SEQ ID NO: 2395 - DNA, 51 bp, Artificial Sequence
  Synthetic polynucleotide
cgcctgggtcgcttcctctggtcgcygcccgtggcccctgcggcctgcgag

SEQ ID NO: 2396 - DNA, 51 bp, Artificial Sequence
  Synthetic polynucleotide
aaagcataaaaaccattacaagatahacaatctgtaagtatgttttcttat

SEQ ID NO: 2397 - DNA, 51 bp, Artificial Sequence
  Synthetic polynucleotide
gagaagcacctggatattcctaaaaygttggatgctgaaggtgagatgaaa

SEQ ID NO: 2398 - DNA, 51 bp, Artificial Sequence
  Synthetic polynucleotide
gcagaactccatccgccacaatctgyccctcaacaagtgcttcgtgaaggt

SEQ ID NO: 2399 - DNA, 51 bp, Artificial Sequence
  Synthetic polynucleotide
attccatccatcatgaatgtgcttcyggtttgtcttatattctggctaatt

SEQ ID NO: 2400 - DNA, 51 bp, Artificial Sequence
  Synthetic polynucleotide
gctctgggaaatttaaccctcgtctyggccatcatcgtcttcatttttgcc

SEQ ID NO: 2401 - DNA, 51 bp, Artificial Sequence
  Synthetic polynucleotide
ctaataaatttgatcctggctgtgghggccatggcctacgaggaacagaat

SEQ ID NO: 2402 - DNA, 51 bp, Artificial Sequence
  Synthetic polynucleotide
tttcttttaccccacttgcagccaaygtccagagggatatatgtgtgtgaa

SEQ ID NO: 2403 - DNA, 51 bp, Artificial Sequence
  Synthetic polynucleotide
agatgtaatgatcctgactgtgttcygtctgagcgtatttgctctaattgg

SEQ ID NO: 2404 - DNA, 51 bp, Artificial Sequence
  Synthetic polynucleotide
ttccggttcagtgccacctctgcccygtacattttaactcccttcaatcct

SEQ ID NO: 2405 - DNA, 51 bp, Artificial Sequence
  Synthetic polynucleotide
gcagaatcagaaccagctcttttgayagggagcaagcagttcgggctttca

SEQ ID NO: 2406 - DNA, 51 bp, Artificial Sequence
  Synthetic polynucleotide
gtctgtgacatttcctgttgtgaagyaaaagagggacccctgcgtcctgct

SEQ ID NO: 2407 - DNA, 51 bp, Artificial Sequence
  Synthetic polynucleotide
ctttgggattacgtctatcagttgcyttctgacagccggtacgaaaacttc

SEQ ID NO: 2408 - DNA, 51 bp, Artificial Sequence
  Synthetic polynucleotide
atgaacatcattgacattgtggccaycatcccctacttcatcaccctgggg

SEQ ID NO: 2409 - DNA, 51 bp, Artificial Sequence
  Synthetic polynucleotide
gtgtcccccacctagtttgcagaccygacagacgctgctgcccgcaacgcg

SEQ ID NO: 2410 - DNA, 51 bp, Artificial Sequence
  Synthetic polynucleotide
gagatgatggagctcaatgaccgctytgccagctacatcgagaaggttcgc

SEQ ID NO: 2411 - DNA, 51 bp, Artificial Sequence
  Synthetic polynucleotide
acccgggccagtgagcgggcagagadgatggagctcaatgaccgctttgcc

SEQ ID NO: 2412 - DNA, 51 bp, Artificial Sequence
  Synthetic polynucleotide
tttgcctgatgcccatgatgcagacyctggtaagaacgagctccttgggcc

SEQ ID NO: 2413 - DNA, 51 bp, Artificial Sequence
  Synthetic polynucleotide
tcccggaagctggcggagcaggagcygattgagactagtgagcgggtgcag

SEQ ID NO: 2414 - DNA, 51 bp, Artificial Sequence
  Synthetic polynucleotide
atggaacaggccaagcgcaaccaccwgcgggtggtggactcgctgcagacc

SEQ ID NO: 2415 - DNA, 51 bp, Artificial Sequence
  Synthetic polynucleotide
tgagtcttgatgaagcctacttgaayataacaaagcacttagaagaaagac

SEQ ID NO: 2416 - DNA, 51 bp, Artificial Sequence
  Synthetic polynucleotide
tattttataatcaatgaatttgttcyttctgattttaagtttgcagattta

SEQ ID NO: 2417 - DNA, 51 bp, Artificial Sequence
  Synthetic polynucleotide
agtcctgggggccagtctgttgtgcyaggaagttatgacaggtaagtcccc

SEQ ID NO: 2418 - DNA, 51 bp, Artificial Sequence
  Synthetic polynucleotide
gacatctgctgctttcatattttcayacattactgcagtaacactccacca

SEQ ID NO: 2419 - DNA, 51 bp, Artificial Sequence
  Synthetic polynucleotide
ctcttcctagctgaggtggtgctgcyctgctgggtcaagttcttgcccctc

SEQ ID NO: 2420 - DNA, 51 bp, Artificial Sequence
  Synthetic polynucleotide
gagttctacctcagtctaatcctgcygcagaactatcaggtacttagattc

SEQ ID NO: 2421 - DNA, 51 bp, Artificial Sequence
  Synthetic polynucleotide
aaactggccttcagtgagttctaccycagtctaatcctgctgcagaactat

SEQ ID NO: 2422 - DNA, 51 bp, Artificial Sequence
  Synthetic polynucleotide
gacagacaaaaggctatgaagcgttyacgtgtcccccctttgggagctgct

SEQ ID NO: 2423 - DNA, 51 bp, Artificial Sequence
  Synthetic polynucleotide
cgggtggacatccagaacaagcgctyctacctggacgtgaagcagaacgcc

SEQ ID NO: 2424 - DNA, 51 bp, Artificial Sequence
  Synthetic polynucleotide
ctgggctccacgcagggccagaccaytgcgctgcccgcgcaggggctcatc

SEQ ID NO: 2425 - DNA, 51 bp, Artificial Sequence
  Synthetic polynucleotide
tctgactcccaggacgggcaccaggkgagtcacctagtaggggcggcggcg

SEQ ID NO: 2426 - DNA, 51 bp, Artificial Sequence
  Synthetic polynucleotide
tccaggggacccaagggctacaaggygagcgtgggctgctgggagggggga

SEQ ID NO: 2427 - DNA, 51 bp, Artificial Sequence
  Synthetic polynucleotide
tcactctcaggagaccattgcatcaytggccgcacactggtggtaagtttt

SEQ ID NO: 2428 - DNA, 51 bp, Artificial Sequence
  Synthetic polynucleotide
cttctactacactgtgatgttccggygagtgggccacactggctggcctgg

SEQ ID NO: 2429 - DNA, 51 bp, Artificial Sequence
  Synthetic polynucleotide
ggtctagactatcagaatccataccygagtccatttagagagttccaaagg

SEQ ID NO: 2430 - DNA, 51 bp, Artificial Sequence
  Synthetic polynucleotide
cagctgtggactccaggggggtaggytgccacagtggcttcttccaccaag

SEQ ID NO: 2431 - DNA, 51 bp, Artificial Sequence
  Synthetic polynucleotide
ttcacagggattttcacagcagagabgaccttcaagatcattgccctcgac

SEQ ID NO: 2432 - DNA, 51 bp, Artificial Sequence
  Synthetic polynucleotide
agagttagaggagtctcgccacaagbgtccaccatgctggaaccgtctcgc

SEQ ID NO: 2433 - DNA, 51 bp, Artificial Sequence
  Synthetic polynucleotide
gaaaagcagaggacccaggaagagcygaggaggctctcttctgaggtcgag

SEQ ID NO: 2434 - DNA, 51 bp, Artificial Sequence
  Synthetic polynucleotide
cggggcgacgtcgtcgtggccatccygggtatggggtggggggcgggcact

SEQ ID NO: 2435 - DNA, 51 bp, Artificial Sequence
  Synthetic polynucleotide
ttcatctcccggggctccatcgagaycctgcggggcgacgtcgtcgtggcc

SEQ ID NO: 2436 - DNA, 51 bp, Artificial Sequence
  Synthetic polynucleotide
ctgcgtcatgctcattggctgtgagygtgcccaggggcgggcggcggggag

SEQ ID NO: 2437 - DNA, 51 bp, Artificial Sequence
  Synthetic polynucleotide
tcccaacaccaactcagagaagatcbtctccatctgcgtcatgctcattgg

SEQ ID NO: 2438 - DNA, 51 bp, Artificial Sequence
  Synthetic polynucleotide
ctacacggctgtcttcacaccctacycggctgccttcctgctgaaggagac

SEQ ID NO: 2439 - DNA, 51 bp, Artificial Sequence
  Synthetic polynucleotide
gctcgggtggagaactgcgccgtcahctactgcaacgacggcttctgcgag

SEQ ID NO: 2440 - DNA, 51 bp, Artificial Sequence
  Synthetic polynucleotide
gtctttgccatctccttctttgcgcycccagcggtaggtgccccgtgggtg

SEQ ID NO: 2441 - DNA, 51 bp, Artificial Sequence
  Synthetic polynucleotide
cccaaacccaagaagtctgtggtggygagtagcccacctgccaccagggca

SEQ ID NO: 2442 - DNA, 51 bp, Artificial Sequence
  Synthetic polynucleotide
cctcgccctgtctgaggatcatgccygggtagtgtttgggcccaatgggga

SEQ ID NO: 2443 - DNA, 51 bp, Artificial Sequence
  Synthetic polynucleotide
caccattggcggcttcacatgcaaaygtcctcccggatttacccaacacca

SEQ ID NO: 2444 - DNA, 51 bp, Artificial Sequence
  Synthetic polynucleotide
atgctgctgtgacggagggagaggcyggggtccccactgtgagatctgccc

SEQ ID NO: 2445 - DNA, 51 bp, Artificial Sequence
  Synthetic polynucleotide
ctgctgtgccttgaagggagaaggcyggggagacccctgcgagctctgccc

SEQ ID NO: 2446 - DNA, 51 bp, Artificial Sequence
  Synthetic polynucleotide
cacaattggttccttcaactgccgcygcaatcatggtttcatcctttctca

SEQ ID NO: 2447 - DNA, 51 bp, Artificial Sequence
  Synthetic polynucleotide
gggaatggaacttgccggaacacaaytggttccttcaactgccgctgcaat

SEQ ID NO: 2448 - DNA, 51 bp, Artificial Sequence
  Synthetic polynucleotide
tggacctccgtggggagtgtattggyacgtgatccatcctaggttggcacc

SEQ ID NO: 2449 - DNA, 51 bp, Artificial Sequence
  Synthetic polynucleotide
tctcattgaaactacagcctctgccygttacacattgaacaacataatcca

SEQ ID NO: 2450 - DNA, 51 bp, Artificial Sequence
  Synthetic polynucleotide
agacctcacagtaaaaataggtgatyttggtctagctacagtgaaatctcg

SEQ ID NO: 2451 - DNA, 51 bp, Artificial Sequence
  Synthetic polynucleotide
gccgtgtgccaatccattgtccaccyctttgaggatgacatggtggaggtg

SEQ ID NO: 2452 - DNA, 51 bp, Artificial Sequence
  Synthetic polynucleotide
gaagcagataccccaggaattcagahtgggagaaaggtaaagtatttatta

SEQ ID NO: 2453 - DNA, 51 bp, Artificial Sequence
  Synthetic polynucleotide
aggaggacctgcttacaatggaatgyaaactgcagctagccagtttctttc

SEQ ID NO: 2454 - DNA, 51 bp, Artificial Sequence
  Synthetic polynucleotide
gccattctggagctggcctatacttyagcagatggattggagtactctaga

SEQ ID NO: 2455 - DNA, 51 bp, Artificial Sequence
  Synthetic polynucleotide
agacctcactcccggggagccagcabgtccactgcggtcctggaaaaccca

SEQ ID NO: 2456 - DNA, 51 bp, Artificial Sequence
  Synthetic polynucleotide
ggcagccatggccaagctggccgccycggaggccgcgaccgccatcagcca

SEQ ID NO: 2457 - DNA, 51 bp, Artificial Sequence
  Synthetic polynucleotide
gcgtattgggcatcacagcccctggygagtatagtgtctttccctaaaaag

SEQ ID NO: 2458 - DNA, 51 bp, Artificial Sequence
  Synthetic polynucleotide
cgagcggcaggttgggtgcggaccayggcctctcacaagctgctggtgacc

SEQ ID NO: 2459 - DNA, 51 bp, Artificial Sequence
  Synthetic polynucleotide
ctctccatccccaaccagctcctgcyggggcctggtccttccaacctgcct

SEQ ID NO: 2460 - DNA, 51 bp, Artificial Sequence
  Synthetic polynucleotide
ggcctggcccagcacaagccagtgcygctgttcttaacccacggggagtcg

SEQ ID NO: 2461 - DNA, 51 bp, Artificial Sequence
  Synthetic polynucleotide
tcgtccaccggcgtgctgcagcccchtgatggcttcggggaactctgccac

SEQ ID NO: 2462 - DNA, 51 bp, Artificial Sequence
  Synthetic polynucleotide
cgcccctccagggacctcgctcatcyccttcagtgacaaggccaagtgagt

SEQ ID NO: 2463 - DNA, 51 bp, Artificial Sequence
  Synthetic polynucleotide
caagtggctggccaacttctggggcygtgacgaccagcccaggatgtgagg

SEQ ID NO: 2464 - DNA, 51 bp, Artificial Sequence
  Synthetic polynucleotide
catcacacaatccccgtcatcagccygtacagcctgagagagagcctggcc

SEQ ID NO: 2465 - DNA, 51 bp, Artificial Sequence
  Synthetic polynucleotide
ccagcgccatctcccacacagggccyggagaacagctggcgccagcaccgc

SEQ ID NO: 2466 - DNA, 51 bp, Artificial Sequence
  Synthetic polynucleotide
cagcaccgcgaggccgcggcgtatcygcatgggcgcctgcaggcactgggg

SEQ ID NO: 2467 - DNA, 51 bp, Artificial Sequence
  Synthetic polynucleotide
tgagccaggcccctcctgcaggcgcyccggcttcccacagtcaccactgtg

SEQ ID NO: 2468 - DNA, 51 bp, Artificial Sequence
  Synthetic polynucleotide
agcccgccctgtgccccccaggtgcygcggatcggcctgctgggctgcaat

SEQ ID NO: 2469 - DNA, 51 bp, Artificial Sequence
  Synthetic polynucleotide
gtgacggaggccctgagggcggcccygcagcactgccccaagaagaagctg

SEQ ID NO: 2470 - DNA, 51 bp, Artificial Sequence
  Synthetic polynucleotide
tccgaccacgtggacaagaggatccyggatgctgcaggtgcacactgggtg

SEQ ID NO: 2471 - DNA, 51 bp, Artificial Sequence
  Synthetic polynucleotide
ctggctggcctgagaggggagccgabgcctagtgaactcaagctgtagcca

SEQ ID NO: 2472 - DNA, 51 bp, Artificial Sequence
  Synthetic polynucleotide
gtcccagccaacacagggctggaccygcctgtggatgcagtggtcacgctt

SEQ ID NO: 2473 - DNA, 51 bp, Artificial Sequence
  Synthetic polynucleotide
gggatcccagggctgaagaaaatcayggactggtttggctactatggaggc

SEQ ID NO: 2474 - DNA, 51 bp, Artificial Sequence
  Synthetic polynucleotide
ttcttgactgatgcctcctggagcaytggggacgataattttaacaaagtt

SEQ ID NO: 2475 - DNA, 51 bp, Artificial Sequence
  Synthetic polynucleotide
cctgtgcaagaagcgcaatgaccacytcggccactatgtgtgccagccaga

SEQ ID NO: 2476 - DNA, 51 bp, Artificial Sequence
  Synthetic polynucleotide
ccagggggccaactatgcttgtgaaygtccccccaacttcaccggctccaa

SEQ ID NO: 2477 - DNA, 51 bp, Artificial Sequence
  Synthetic polynucleotide
tcagagcttttggaaaaacatggacycgagaaaccaatttcatttgttaaa

SEQ ID NO: 2478 - DNA, 51 bp, Artificial Sequence
  Synthetic polynucleotide
gcctccttccagggccagcccttcayctggtgcatgctgcacaactttggg

SEQ ID NO: 2479 - DNA, 51 bp, Artificial Sequence
  Synthetic polynucleotide
tctacagtttcgtctccaggtcagaygcactcggaacccccatgctgctaa

SEQ ID NO: 2480 - DNA, 51 bp, Artificial Sequence
  Synthetic polynucleotide
ccagggcatatatggctatcatcatyatatgcaggatcgcatagatgacaa

SEQ ID NO: 2481 - DNA, 51 bp, Artificial Sequence
  Synthetic polynucleotide
ccgcggtcatgtgacacagcgaagayggcgtcgcccggctgcctgtggctc

SEQ ID NO: 2482 - DNA, 51 bp, Artificial Sequence
  Synthetic polynucleotide
ctaataaatttgatcttggctgtggyggccatggcctatgaggaacagaat

SEQ ID NO: 2483 - DNA, 51 bp, Artificial Sequence
  Synthetic polynucleotide
gttgacctggccatcaccatctgcaytgtcttaaatacactcttcatggct

SEQ ID NO: 2484 - DNA, 51 bp, Artificial Sequence
  Synthetic polynucleotide
tatgcagctgttgattcacgaaatgyaagtctagttagagggaaattgttt

SEQ ID NO: 2485 - DNA, 51 bp, Artificial Sequence
  Synthetic polynucleotide
tggattaatctggtgtttattgttcygttcactggagaatgtgtgctgaaa

SEQ ID NO: 2486 - DNA, 51 bp, Artificial Sequence
  Synthetic polynucleotide
cagctcattgccatggatttgcccahggtgagtggtgaccggatccactgt

SEQ ID NO: 2487 - DNA, 51 bp, Artificial Sequence
  Synthetic polynucleotide
aatcccaattatggctacacaagctytgataccttcagttgggcttttttg

SEQ ID NO: 2488 - DNA, 51 bp, Artificial Sequence
  Synthetic polynucleotide
tcggcattgagaacattcagagttcyccgagcattgaagacgatttcagtc

SEQ ID NO: 2489 - DNA, 51 bp, Artificial Sequence
  Synthetic polynucleotide
attcaaacatacctgccatgcataaygacagtgattctctcacaagtctcc

SEQ ID NO: 2490 - DNA, 51 bp, Artificial Sequence
  Synthetic polynucleotide
gcccgtattgggcgcatcttgcgtcygatcaaaggcgccaaagggattcgt

SEQ ID NO: 2491 - DNA, 51 bp, Artificial Sequence
  Synthetic polynucleotide
ttactaccgcgagaacaagcagggcyggcagaactccatccgccacaatct

SEQ ID NO: 2492 - DNA, 51 bp, Artificial Sequence
  Synthetic polynucleotide
aagaatctcaagccggagacgctggygaggccacctcctgctccctgcctg

SEQ ID NO: 2493 - DNA, 51 bp, Artificial Sequence
  Synthetic polynucleotide
agggaagccatcccaggtaagtgccrtgagtttaggtgtgacccgcatctg

SEQ ID NO: 2494 - DNA, 51 bp, Artificial Sequence
  Synthetic polynucleotide
aggcaggtaggagacacccatctccrgcatgccggccagagtcactgggtg

SEQ ID NO: 2495 - DNA, 51 bp, Artificial Sequence
  Synthetic polynucleotide
gggtcacgtggccggcggccccccaygacgtgctggctgcggggcgtcacg

SEQ ID NO: 2496 - DNA, 51 bp, Artificial Sequence
  Synthetic polynucleotide
acccccacccccgccccagggcctcrccggatcaaaggctgggagctcgaa

SEQ ID NO: 2497 - DNA, 51 bp, Artificial Sequence
  Synthetic polynucleotide
ctcccagggcaacgtctttgccacayctgcgctccggagcctgcgcttcct

SEQ ID NO: 2498 - DNA, 51 bp, Artificial Sequence
  Synthetic polynucleotide
tattcaccttggtgctacttcttgcyatgttggagacaatactgtaggcgc

SEQ ID NO: 2499 - DNA, 51 bp, Artificial Sequence
  Synthetic polynucleotide
ccagttggatcatttactggatcctycttctttcactggtcgtgcctccca

SEQ ID NO: 2500 - DNA, 51 bp, Artificial Sequence
  Synthetic polynucleotide
gggtctggaaaaactgcagcatttcygttgcccatcttgagtcagatttat

SEQ ID NO: 2501 - DNA, 51 bp, Artificial Sequence
  Synthetic polynucleotide
taaaaattttttttctttcagatgcyggctcgtgatttcttagatgaatat

SEQ ID NO: 2502 - DNA, 51 bp, Artificial Sequence
  Synthetic polynucleotide
gacatttcaaatgtgaaacatgttaycaattttgacttgccaagtgatatt

SEQ ID NO: 2503 - DNA, 51 bp, Artificial Sequence
  Synthetic polynucleotide
accatcgccttccgacacctcttccygctgggctactcggacggagcggat

SEQ ID NO: 2504 - DNA, 51 bp, Artificial Sequence
  Synthetic polynucleotide
tactgcttctgtggctggatcgtgcyggggccctatcatgtgaaggtacat

SEQ ID NO: 2505 - DNA, 51 bp, Artificial Sequence
  Synthetic polynucleotide
ccccgcgaagccatcagtactttgtytgacaacaatacatgggtgaaacac

SEQ ID NO: 2506 - DNA, 51 bp, Artificial Sequence
  Synthetic polynucleotide
cagctccgaactggaaggcgcctgcyctgagtacctggcaccgctgagcgc

SEQ ID NO: 2507 - DNA, 51 bp, Artificial Sequence
  Synthetic polynucleotide
ggacgccaactccgacttctcctccyacgccgactcgctctggtgggggac

SEQ ID NO: 2508 - DNA, 51 bp, Artificial Sequence
  Synthetic polynucleotide
cttctcctcctacgccgactcgctcyggtgggggacggtgcgtgagggtct

SEQ ID NO: 2509 - DNA, 51 bp, Artificial Sequence
  Synthetic polynucleotide
ggggaagaaaccagcgaagccaaaabgccctgccgtgtgtacttgtaccaa

SEQ ID NO: 2510 - DNA, 51 bp, Artificial Sequence
  Synthetic polynucleotide
cagctcagccagctccagaagcaggygataccccacctcacccctctctcc

SEQ ID NO: 2511 - DNA, 51 bp, Artificial Sequence
  Synthetic polynucleotide
aaacgtgcctttgttcactggtacgytggggaggggatggaggaaggtgag

SEQ ID NO: 2512 - DNA, 51 bp, Artificial Sequence
  Synthetic polynucleotide
gacgtgttcaatatgttctgttaccytggtcctcacctttctcacgatccc

SEQ ID NO: 2513 - DNA, 51 bp, Artificial Sequence
  Synthetic polynucleotide
acatcaacagaaaactccaaattttyccacacttctttgctatgatcgagt

SEQ ID NO: 2514 - DNA, 51 bp, Artificial Sequence
  Synthetic polynucleotide
gattatataaagcgagtgccttcaaytgatgtactctgtaatgaatttcat

SEQ ID NO: 2515 - DNA, 51 bp, Artificial Sequence
  Synthetic polynucleotide
caggtagcagcaagaggactggacayttcaaatgtgaaacatgttatcaat

SEQ ID NO: 2516 - DNA, 51 bp, Artificial Sequence
  Synthetic polynucleotide
tgaataaaaatcacagttattacttrccaaggcctttgattcttggtagta

SEQ ID NO: 2517 - DNA, 51 bp, Artificial Sequence
  Synthetic polynucleotide
atgaacatcttcgtgggcttcgtcaycgtcacctttcaggagcagggggag

SEQ ID NO: 2518 - DNA, 51 bp, Artificial Sequence
  Synthetic polynucleotide
tgtacatcaggaagtggctctggtcytccttttctggtacaaagaacagtg

SEQ ID NO: 2519 - DNA, 51 bp, Artificial Sequence
  Synthetic polynucleotide
ccctacgggcgtctggcctaccaccyggctgtggtgctgggcagtgctgcc

SEQ ID NO: 2520 - DNA, 51 bp, Artificial Sequence
  Synthetic polynucleotide
agctgcctttccgaagtgcccatcaycttcaccctgctgggcgtgggaacc

SEQ ID NO: 2521 - DNA, 51 bp, Artificial Sequence
  Synthetic polynucleotide
ggtctgcgtcttcggaatgggctccygggtgaccatcaatgggctctgggt

SEQ ID NO: 2522 - DNA, 51 bp, Artificial Sequence
  Synthetic polynucleotide
ccataccttaccactaaatgtagtgyaagtatagagctgtcttattcttgt

SEQ ID NO: 2523 - DNA, 51 bp, Artificial Sequence
  Synthetic polynucleotide
cgtaatctgaatcttttttctccccdtagtccccgtttttcttctctctct

SEQ ID NO: 2524 - DNA, 51 bp, Artificial Sequence
  Synthetic polynucleotide
aatactcgctgaccctgcttgtgccrtattttcaacaaagactcaacaaca

SEQ ID NO: 2525 - DNA, 51 bp, Artificial Sequence
  Synthetic polynucleotide
gttcatgctgttctacaaagaggcgyaagtagaagagttagagagacgctg

SEQ ID NO: 2526 - DNA, 51 bp, Artificial Sequence
  Synthetic polynucleotide
ctcccgcccgcgttgaagaactcacrcttggccactgggaggcagagatga

SEQ ID NO: 2527 - DNA, 51 bp, Artificial Sequence
  Synthetic polynucleotide
cattatgctctccacagtggagtgaygcttcggggctcaggcatccagtgg

SEQ ID NO: 2528 - DNA, 51 bp, Artificial Sequence
  Synthetic polynucleotide
aaggaagtgataaactatgaggacaytgaggctctcattggcccgccgccc

SEQ ID NO: 2529 - DNA, 51 bp, Artificial Sequence
  Synthetic polynucleotide
cacacgcaaatttccttccactcggrtaagatgctgaggaggggccagacc

SEQ ID NO: 2530 - DNA, 51 bp, Artificial Sequence
  Synthetic polynucleotide
aggttaatgcctgataaagaaagcakgtattacccacgggtacaacattac

SEQ ID NO: 2531 - DNA, 51 bp, Artificial Sequence
  Synthetic polynucleotide
tgcctgccaacgtacaacaatcaacyggttttcaccaagtccaaccaccgc

SEQ ID NO: 2532 - DNA, 51 bp, Artificial Sequence
  Synthetic polynucleotide
ttaattcctccattttcccaccagayggaaggactggagctttgtggacaa

SEQ ID NO: 2533 - DNA, 51 bp, Artificial Sequence
  Synthetic polynucleotide
aaattgttcttttcataccgtggctrggagagactgaagttcaatttccag

SEQ ID NO: 2534 - DNA, 51 bp, Artificial Sequence
  Synthetic polynucleotide
ccaggtgtattcaatggaaagcgtgbcctggtggttggcctggggaattcg

SEQ ID NO: 2535 - DNA, 51 bp, Artificial Sequence
  Synthetic polynucleotide
gaaattcaagctgaaataagtgaacygttagaagagcacacggaggagtac

SEQ ID NO: 2536 - DNA, 51 bp, Artificial Sequence
  Synthetic polynucleotide
taccaagtcatattttcttcacagaytgatggaacatttaaaatagatatt

SEQ ID NO: 2537 - DNA, 51 bp, Artificial Sequence
  Synthetic polynucleotide
cctgtaacaaatgtattaaatattcrttctgagaattaatgatactggcac

SEQ ID NO: 2538 - DNA, 51 bp, Artificial Sequence
  Synthetic polynucleotide
cgtttggccctcccgcacgcctgacrggagcttccatgccgcccctgcagt

SEQ ID NO: 2539 - DNA, 51 bp, Artificial Sequence
  Synthetic polynucleotide
acatccctctctgctctgcagcaaaktcaaccaccagaacattgttcgctg

SEQ ID NO: 2540-3143 - skipped (604 entries)

SEQ ID NO: 3144 - DNA, 51 bp, Artificial Sequence
  Synthetic polynucleotide
gtgggcccccacccgctagttgtcavcatgtactttgctactggcttcagt

SEQ ID NO: 3145 - DNA, 51 bp, Artificial Sequence
  Synthetic polynucleotide
ctagtgcggctgtggttgctttttcvgatttccattcccaataacgtgaag

SEQ ID NO: 3146 - DNA, 51 bp, Artificial Sequence
  Synthetic polynucleotide
tatgttttcagaaacttggatcctgrggtaaaaacaagaaatgagtgttaa

SEQ ID NO: 3147 - DNA, 51 bp, Artificial Sequence
  Synthetic polynucleotide
ggcaacctggacccctgtgccttgtrtgcatctgaggtaacagccagggcc

SEQ ID NO: 3148 - DNA, 51 bp, Artificial Sequence
  Synthetic polynucleotide
acagaggactgcagaaaatcaacctrtcctccttcaggaccaacgtgagta

SEQ ID NO: 3149 - DNA, 51 bp, Artificial Sequence
  Synthetic polynucleotide
gggtagatggtatgtggtacaaacarattatgaccgttggaaacatccctt

SEQ ID NO: 3150 - DNA, 51 bp, Artificial Sequence
  Synthetic polynucleotide
ggtgactcccccatcccgcaggaccragttcctgagcgacaggtggatgct

SEQ ID NO: 3151 - DNA, 51 bp, Artificial Sequence
  Synthetic polynucleotide
ggcgttgttgttccggatccaggttrcctaatgggagtgcgagagctctgc

SEQ ID NO: 3152 - DNA, 51 bp, Artificial Sequence
  Synthetic polynucleotide
gataactgcactttcaacacctgccrgaaagctcttgggaaggatgatttt

SEQ ID NO: 3153 - DNA, 51 bp, Artificial Sequence
  Synthetic polynucleotide
gatttacaccaatcaagagaaaaccrggtgggtcctcccaacccccaatca

SEQ ID NO: 3154 - DNA, 51 bp, Artificial Sequence
  Synthetic polynucleotide
agtgcgaaggatctggtagagaacargttcctgctgcccagtgccaactcc

SEQ ID NO: 3155 - DNA, 51 bp, Artificial Sequence
  Synthetic polynucleotide
tttttattctacctctcctttgaacrgcatcctggtggggaagaagtttta

SEQ ID NO: 3156 - DNA, 51 bp, Artificial Sequence
  Synthetic polynucleotide
cgcttcaagctctggtacacgctggrcagagcccctgaaggtgagtgaggg

SEQ ID NO: 3157 - DNA, 51 bp, Artificial Sequence
  Synthetic polynucleotide
attattattgttattactattactgrtttttaaaaatgcttgttgatagaa

SEQ ID NO: 3158 - DNA, 51 bp, Artificial Sequence
  Synthetic polynucleotide
tggcccagaaaggccgcggtctcgtrgtccggtgagccggtcactctcccc

SEQ ID NO: 3159 - DNA, 51 bp, Artificial Sequence
  Synthetic polynucleotide
gagtgtaccaaaacgtgccagaactrtgacctggagtgcatgagcatgggc

SEQ ID NO: 3160 - DNA, 51 bp, Artificial Sequence
  Synthetic polynucleotide
acctgcggcctgtgtgggaattacartggcaaccagggcgacgacttcctt

SEQ ID NO: 3161 - DNA, 51 bp, Artificial Sequence
  Synthetic polynucleotide
actttcccagaagatggaggagagtrtatgtgtaaagcagtcaacaataaa

SEQ ID NO: 3162 - DNA, 51 bp, Artificial Sequence
  Synthetic polynucleotide
cgaaaggggcttgaagttaatgtcaraggtgaattattttgataatctagc

SEQ ID NO: 3163 - DNA, 51 bp, Artificial Sequence
  Synthetic polynucleotide
tctctttgtctttctcttttttaaaraattcaggctctgctggttcttcat

SEQ ID NO: 3164 - DNA, 51 bp, Artificial Sequence
  Synthetic polynucleotide
cctacagacctggagacaagaagctrtaagtatcttctcttgtccatggtg

SEQ ID NO: 3165 - DNA, 51 bp, Artificial Sequence
  Synthetic polynucleotide
aaaaacatgttattttccttcttcarctagattacagatctgcttgatgtt

SEQ ID NO: 3166 - DNA, 51 bp, Artificial Sequence
  Synthetic polynucleotide
taccatggccttctggggaacaggtrtgggatagggcagttgggcaatctc

SEQ ID NO: 3167 - DNA, 51 bp, Artificial Sequence
  Synthetic polynucleotide
ctggccaagcagccgtctttccgccrgtactccggctacctcaaaggctcc

SEQ ID NO: 3168 - DNA, 51 bp, Artificial Sequence
  Synthetic polynucleotide
ctttagaaataccagatcctattatrtaatggagatgtagacatggcctgc

SEQ ID NO: 3169 - DNA, 51 bp, Artificial Sequence
  Synthetic polynucleotide
ctcccacatcgcctttctcacgatcraggtagggactgggcctgctgagag

SEQ ID NO: 3170 - DNA, 51 bp, Artificial Sequence
  Synthetic polynucleotide
ttccaaacacagtagggtcccctttytatgggaggaaaacacaaaaggagc

SEQ ID NO: 3171 - DNA, 51 bp, Artificial Sequence
  Synthetic polynucleotide
taatctgctgtatgatcggggcacaragtttggcctcttcactccaggatc

SEQ ID NO: 3172 - DNA, 51 bp, Artificial Sequence
  Synthetic polynucleotide
aacaatccaaatggccatgggcacarttataaaggtgagagaaaaactgat

SEQ ID NO: 3173 - DNA, 51 bp, Artificial Sequence
  Synthetic polynucleotide
actgtttgggaaatgcaacaatccaratggccatgggcacaattataaagg

SEQ ID NO: 3174 - DNA, 51 bp, Artificial Sequence
  Synthetic polynucleotide
gaaaatgtagctgtttatatctgggrcaacctccagaaagttcttcctgta

SEQ ID NO: 3175 - DNA, 51 bp, Artificial Sequence
  Synthetic polynucleotide
ccccatttcccaggtatgatcgggtrcggcatggccaagggtgctgttcac

SEQ ID NO: 3176 - DNA, 51 bp, Artificial Sequence
  Synthetic polynucleotide
tctatttttctttatcatcccttcarctggcaatcagaaatgcacttaaac

SEQ ID NO: 3177 - DNA, 51 bp, Artificial Sequence
  Synthetic polynucleotide
ttcatcaatatctgtgaaaacagcaytgcaaccacattgtcaggtctgctt

SEQ ID NO: 3178 - DNA, 51 bp, Artificial Sequence
  Synthetic polynucleotide
gatcctctctctttttttcccatttrggtgtgaaatgtttctcttattcta

SEQ ID NO: 3179 - DNA, 51 bp, Artificial Sequence
  Synthetic polynucleotide
agggcctttaatgtggaactggctcrggctggtattaagataccttaaaat

SEQ ID NO: 3180 - DNA, 51 bp, Artificial Sequence
  Synthetic polynucleotide
actaaaacgattgtaacactgtagayaccttagagaacaatggatttccat

SEQ ID NO: 3181 - DNA, 51 bp, Artificial Sequence
  Synthetic polynucleotide
gagacctcactcccggggagccagcdtgtccactgcggtcctggaaaaccc

SEQ ID NO: 3182 - DNA, 51 bp, Artificial Sequence
  Synthetic polynucleotide
tccttgtataaaacccatgcttgctrtgagtacaatcacatttttccactt

SEQ ID NO: 3183 - DNA, 51 bp, Artificial Sequence
  Synthetic polynucleotide
atacctcggcccttctcagttcgctrcgacccatacacccaaaggattgag

SEQ ID NO: 3184 - DNA, 51 bp, Artificial Sequence
  Synthetic polynucleotide
cttgaaaagtactgtggcttccatgragataacattccccagctggaagac

SEQ ID NO: 3185 - DNA, 51 bp, Artificial Sequence
  Synthetic polynucleotide
ttctattttcccccaattacaggaarttggccttgcctctctgggtgcacc

SEQ ID NO: 3186 - DNA, 51 bp, Artificial Sequence
  Synthetic polynucleotide
ttccagcccctgtattacgtggcagrgagttttaatgatgccaaggagaaa

SEQ ID NO: 3187 - DNA, 51 bp, Artificial Sequence
  Synthetic polynucleotide
tgtcatcctttggtgaattacaggtvtgaccttcacaggaaccaaggatag

SEQ ID NO: 3188 - DNA, 51 bp, Artificial Sequence
  Synthetic polynucleotide
agaccttctcgtttaaagaaagatgvgtatgaatttttcacccatttggat

SEQ ID NO: 3189 - DNA, 51 bp, Artificial Sequence
  Synthetic polynucleotide
cattaaaaactgcccaaagaaaaccrggaatcttaagaaaataactcgtga

SEQ ID NO: 3190 - DNA, 51 bp, Artificial Sequence
  Synthetic polynucleotide
ggctctgcctgtcgggcttgggcctrctactcagctgtgaacccagtaggt

SEQ ID NO: 3191 - DNA, 51 bp, Artificial Sequence
  Synthetic polynucleotide
ttggtccccgcgcagccccagctcarcgtgtgcaactgggcggtcatggta

SEQ ID NO: 3192 - DNA, 51 bp, Artificial Sequence
  Synthetic polynucleotide
actctttttgaaactgatgaacgctrccgacatttaggattctctgttgat

SEQ ID NO: 3193 - DNA, 51 bp, Artificial Sequence
  Synthetic polynucleotide
taacttcttggcatccttgtagggcrtagacgagggccccgaggggctgaa

SEQ ID NO: 3194 - DNA, 51 bp, Artificial Sequence
  Synthetic polynucleotide
gtgcacggggccggtaatttggtcarcacttactatgacttttccaagggc

SEQ ID NO: 3195 - DNA, 51 bp, Artificial Sequence
  Synthetic polynucleotide
cattgaccacaaaaagagtgatgacrggacacttgtggaccgaatcttgga

SEQ ID NO: 3196 - DNA, 51 bp, Artificial Sequence
  Synthetic polynucleotide
agcaccgaggccattctccattccarcaacaccagggacatggagtccgac

SEQ ID NO: 3197 - DNA, 51 bp, Artificial Sequence
  Synthetic polynucleotide
tactatgacttttccaagggcattgrccacaaaaagagtgatgacaggaca

SEQ ID NO: 3198 - DNA, 51 bp, Artificial Sequence
  Synthetic polynucleotide
gttgcaacaggatataaaaatatgtrttcaacaaacatattcaccaaaagg

SEQ ID NO: 3199 - DNA, 51 bp, Artificial Sequence
  Synthetic polynucleotide
cgggaccctggggaagcgcggccagrtatcacccaccaggtaactccaggg

SEQ ID NO: 3200 - DNA, 51 bp, Artificial Sequence
  Synthetic polynucleotide
ctgctgctctggtcctaggctccgtrtgtggatgtgatctgtttgaacagc

SEQ ID NO: 3201 - DNA, 51 bp, Artificial Sequence
  Synthetic polynucleotide
ctggcgcccagctcagccactgaagracaggcaaatcaaagcttccttcaa

SEQ ID NO: 3202 - DNA, 51 bp, Artificial Sequence
  Synthetic polynucleotide
tcccccaggacctgagcactggcatvaggacttccccattgccaagggaga

SEQ ID NO: 3203 - DNA, 51 bp, Artificial Sequence
  Synthetic polynucleotide
tttataggtgggaccaattttgcctrttggaatggtaagagcactttaata

SEQ ID NO: 3204 - DNA, 51 bp, Artificial Sequence
  Synthetic polynucleotide
tttgcagggtttggtttctaacctgrctctcagttccaatatcctcacgga

SEQ ID NO: 3205 - DNA, 51 bp, Artificial Sequence
  Synthetic polynucleotide
gagagtcaggttagaaaccaaacccygcaaagcagaaacagagcacagtga

SEQ ID NO: 3206 - DNA, 51 bp, Artificial Sequence
  Synthetic polynucleotide
attaatggctttaaccttggccgctrttggccagcccggggccctcagttg

SEQ ID NO: 3207 - DNA, 51 bp, Artificial Sequence
  Synthetic polynucleotide
actctgagcgttagcagctttttcargcaggtatctcttcacattacagtg

SEQ ID NO: 3208 - DNA, 51 bp, Artificial Sequence
  Synthetic polynucleotide
tgccactgccatcggggaccctccaratgtcattattgtttccaaccaaga

SEQ ID NO: 3209 - DNA, 51 bp, Artificial Sequence
  Synthetic polynucleotide
atttccgtggcagccaactgcctctvtgcatatctccacatcccagcttct

SEQ ID NO: 3210 - DNA, 51 bp, Artificial Sequence
  Synthetic polynucleotide
actgttcatttttcttttaaatttarggtggtttgttggaaatgctccgac

SEQ ID NO: 3211 - DNA, 51 bp, Artificial Sequence
  Synthetic polynucleotide
tgtgacactttctgcctctctccgcrggaaacatggaccgtcaccactacg

SEQ ID NO: 3212 - DNA, 51 bp, Artificial Sequence
  Synthetic polynucleotide
ggcaggcagcccttctggacactgcrtgatcacaggagcagccctctggcc

SEQ ID NO: 3213 - DNA, 51 bp, Artificial Sequence
  Synthetic polynucleotide
ttttttttttttttttaaagaattcrgtagctttgttgtccggaccaacac

SEQ ID NO: 3214 - DNA, 51 bp, Artificial Sequence
  Synthetic polynucleotide
catcttttatttaacttaaatttcartcattttgcagtgatatggtttact

SEQ ID NO: 3215 - DNA, 51 bp, Artificial Sequence
  Synthetic polynucleotide
tctactgggtgaaggaatttatgccrgatacaattgtcgggatgctgtgtg

SEQ ID NO: 3216 - DNA, 51 bp, Artificial Sequence
  Synthetic polynucleotide
ttaagccgaaaccggggcaagacagrccgggtagcccggtattttgagtac

SEQ ID NO: 3217 - DNA, 51 bp, Artificial Sequence
  Synthetic polynucleotide
gctccagttttcttcagagaagaatrtatgctgaataatgctgttggtatg

SEQ ID NO: 3218 - DNA, 51 bp, Artificial Sequence
  Synthetic polynucleotide
ttttcttatttctgtattactagaaraccttcaagcttggttcagagagat

SEQ ID NO: 3219 - DNA, 51 bp, Artificial Sequence
  Synthetic polynucleotide
gagccctgccacttccccttccagtrccaccggcagctgtaccacaaatgt

SEQ ID NO: 3220 - DNA, 51 bp, Artificial Sequence
  Synthetic polynucleotide
ttcatccgccgggaaggcatccgccrgtacggcaagtgcctgcacgactgt

SEQ ID NO: 3221 - DNA, 51 bp, Artificial Sequence
  Synthetic polynucleotide
taaaagactggaaagacttgttcacraaggaaaaattgaccagtgctttaa

SEQ ID NO: 3222 - DNA, 51 bp, Artificial Sequence
  Synthetic polynucleotide
tgtcttaattttacctaatgtttgtrggttggaatacagatttggagaatt

SEQ ID NO: 3223 - DNA, 51 bp, Artificial Sequence
  Synthetic polynucleotide
catgagctccctgccctacatgaagrtgatctttcccctcatcatgatcgc

SEQ ID NO: 3224 - DNA, 51 bp, Artificial Sequence
  Synthetic polynucleotide
caggctgctcgtgttgctattgaacrcctggacaagatcagcgatagcgtc

SEQ ID NO: 3225 - DNA, 51 bp, Artificial Sequence
  Synthetic polynucleotide
cacctggccccagttgtaattgtgartatctcatacctatccctattggca

SEQ ID NO: 3226 - DNA, 51 bp, Artificial Sequence
  Synthetic polynucleotide
tattaaaacagttgtaactgtttatrggagacagaatcttccttggctgtt

SEQ ID NO: 3227 - DNA, 51 bp, Artificial Sequence
  Synthetic polynucleotide
tatcaggtttctttctcagtcacatdtgaaatggatcatggagaagcacat

SEQ ID NO: 3228 - DNA, 51 bp, Artificial Sequence
  Synthetic polynucleotide
gttgataatcatggttataacgttcragacatgacaacaacaagtattggt

SEQ ID NO: 3229 - DNA, 51 bp, Artificial Sequence
  Synthetic polynucleotide
tctggagttatgtggacactaatatrtgatactatttatgcccatcaggta

SEQ ID NO: 3230 - DNA, 51 bp, Artificial Sequence
  Synthetic polynucleotide
gcactgggtgttcttctgtgtctaarttactacaggtatattaaacgtttt

SEQ ID NO: 3231 - DNA, 51 bp, Artificial Sequence
  Synthetic polynucleotide
cacagcctactttccaagcggagccrtgtctggtaacggcaatgcggctgc

SEQ ID NO: 3232 - DNA, 51 bp, Artificial Sequence
  Synthetic polynucleotide
gagtaacaagctgacttacgggaccrtggtgtttgtcaggtccttccttgt

SEQ ID NO: 3233 - DNA, 51 bp, Artificial Sequence
  Synthetic polynucleotide
atccgatacagcgctgtgaggcaccrgtctgaaatcaagccagggtaagga

SEQ ID NO: 3234 - DNA, 51 bp, Artificial Sequence
  Synthetic polynucleotide
tgcttttttcccttttaaggcctcgrtccagctggacctaactttgagtat

SEQ ID NO: 3235 - DNA, 51 bp, Artificial Sequence
  Synthetic polynucleotide
tgcaacaatctgggctatgagatcartaaagtcagagccaaaagaagcagc

SEQ ID NO: 3236 - DNA, 51 bp, Artificial Sequence
  Synthetic polynucleotide
tacatcggccaattcttgcctggatrtgaggccccagcgttcatggacccc

SEQ ID NO: 3237 - DNA, 51 bp, Artificial Sequence
  Synthetic polynucleotide
cttcttgtcacaaatggcgctgacartgctcttagggtattatgattattg

SEQ ID NO: 3238 - DNA, 51 bp, Artificial Sequence
  Synthetic polynucleotide
ctcacaaacctggacttgagtatcarccagatagctcgtggattgtggatt

SEQ ID NO: 3239 - DNA, 51 bp, Artificial Sequence
  Synthetic polynucleotide
tgctggacgacccggagctccgacarggtcaggccagtgtgccgggcaggc

SEQ ID NO: 3240 - DNA, 51 bp, Artificial Sequence
  Synthetic polynucleotide
actggacataacagtggtgtcatacrtagtggaatttattataaacctgag

SEQ ID NO: 3241 - DNA, 51 bp, Artificial Sequence
  Synthetic polynucleotide
acatccagtggaggtgtcacaggcartgacgtcattatgcacttcacgctc

SEQ ID NO: 3242 - DNA, 51 bp, Artificial Sequence
  Synthetic polynucleotide
tttctttgtactgagccacatgacarggtaatatgcattttaaaatattgg

SEQ ID NO: 3243 - DNA, 51 bp, Artificial Sequence
  Synthetic polynucleotide
gccctggttcgggacgtggcgggggrattttacaagttcggactggaaggt

SEQ ID NO: 3244 - DNA, 51 bp, Artificial Sequence
  Synthetic polynucleotide
ttcatctgcaacacggccacagtctrtaagatctgtgcatggatgcagctg

SEQ ID NO: 3245 - DNA, 51 bp, Artificial Sequence
  Synthetic polynucleotide
ttcaaagaaatggagaacaggaggargaaacagctgctcagggatctctct

SEQ ID NO: 3246 - DNA, 51 bp, Artificial Sequence
  Synthetic polynucleotide
gttggaaaattatttcaagccttcartgcttgaagatccttgggctggcct

SEQ ID NO: 3247 - DNA, 51 bp, Artificial Sequence
  Synthetic polynucleotide
tgcccttgtccctccaggagatggtracctgcacctcaatgtgacggcgga

SEQ ID NO: 3248 - DNA, 51 bp, Artificial Sequence
  Synthetic polynucleotide
aacttgtgttttcatctctctctccrggtttccattctattatgaactaaa

SEQ ID NO: 3249 - DNA, 51 bp, Artificial Sequence
  Synthetic polynucleotide
acatgctttgatatattgttctttgrccctgccatcagagtcctcagagac

SEQ ID NO: 3250 - DNA, 51 bp, Artificial Sequence
  Synthetic polynucleotide
tgtggcctgtgcccaagtgcctaagdtaaccctcatcattgggggctccta

SEQ ID NO: 3251 - DNA, 51 bp, Artificial Sequence
  Synthetic polynucleotide
gcagatgtgtttccagatcgagaccrctttggccgtacattctataatcag

SEQ ID NO: 3252 - DNA, 51 bp, Artificial Sequence
  Synthetic polynucleotide
atcatccgactatatgaaatgccttrttttccaatgggattttggtcaaga

SEQ ID NO: 3253 - DNA, 51 bp, Artificial Sequence
  Synthetic polynucleotide
tgtgactagaaataaaatatcagggrtatgctcccccttgagactgaagga

SEQ ID NO: 3254 - DNA, 51 bp, Artificial Sequence
  Synthetic polynucleotide
ttcccaacccctttcttcccttcccrggggctgccgggaggctatcaaaag

SEQ ID NO: 3255 - DNA, 51 bp, Artificial Sequence
  Synthetic polynucleotide
atgaaggccaaagagggcgtggtgtdtgtggaggtgcggtacagtccgcac

SEQ ID NO: 3256 - DNA, 51 bp, Artificial Sequence
  Synthetic polynucleotide
tttagtaattgccccattgtccacartccccaactgggaaagggaattccg

SEQ ID NO: 3257 - DNA, 51 bp, Artificial Sequence
  Synthetic polynucleotide
tttgcctctttacagccatcccttcrtcatccttcaactaatcaaaatcaa

SEQ ID NO: 3258 - DNA, 51 bp, Artificial Sequence
  Synthetic polynucleotide
gtcccaggcaccggggtcaccacctrcgcagtgcacccaggcgtcgtccgc

SEQ ID NO: 3259 - DNA, 51 bp, Artificial Sequence
  Synthetic polynucleotide
tacccgatggtgctaaaaaagaaagragaatcgaaagaggaagacgagttg

SEQ ID NO: 3260 - DNA, 51 bp, Artificial Sequence
  Synthetic polynucleotide
gctttttttccccccttccctctagrtgatatgtttgttgaccttccattc

SEQ ID NO: 3261 - DNA, 51 bp, Artificial Sequence
  Synthetic polynucleotide
tattttcaggcctttttcttggtctrtgctctgggatgtttaagtatttac

SEQ ID NO: 3262 - DNA, 51 bp, Artificial Sequence
  Synthetic polynucleotide
aaaacagacgtgactatgctcttgtrtatagcagacaatctagcctgtttt

SEQ ID NO: 3263 - DNA, 51 bp, Artificial Sequence
  Synthetic polynucleotide
gtcatcttatctacttgctttcatcrgggaagtctgaccgtcccgctacag

SEQ ID NO: 3264 - DNA, 51 bp, Artificial Sequence
  Synthetic polynucleotide
cagctgttcgcgcgtcttctcctccrggtgtgcacgggagtgggaggcgtg

SEQ ID NO: 3265 - DNA, 51 bp, Artificial Sequence
  Synthetic polynucleotide
tatactctgaaagagcgatgcctccrggttgtccggagcctagtcaagcct

SEQ ID NO: 3266 - DNA, 51 bp, Artificial Sequence
  Synthetic polynucleotide
aattactatgttcgggccgtcctgcrtctcctgtgagtccccgtcccgcac

SEQ ID NO: 3267 - DNA, 51 bp, Artificial Sequence
  Synthetic polynucleotide
ttgtttgggctccaggtgcggcggcrgcacatggagcgttgtaccagcttc

SEQ ID NO: 3268 - DNA, 51 bp, Artificial Sequence
  Synthetic polynucleotide
gcagaagtcagatccacaaaagtgtyacatggaggtgctttgaattttatg

SEQ ID NO: 3269 - DNA, 51 bp, Artificial Sequence
  Synthetic polynucleotide
cagtccggcccgccctcctgcagccvtgtcccggcccctgtcagaccaaga

SEQ ID NO: 3270 - DNA, 51 bp, Artificial Sequence
  Synthetic polynucleotide
acttcacttctgttttatccctgtartgtttctgaagcatgcaggagaaag

SEQ ID NO: 3271 - DNA, 51 bp, Artificial Sequence
  Synthetic polynucleotide
ctgtgccagccttgtgccgtgcactrtgactttgtgggctcctatgagagg

SEQ ID NO: 3272 - DNA, 51 bp, Artificial Sequence
  Synthetic polynucleotide
aaaagttttgtattacgaattatacrgaagacaaatagcaactcagcctag

SEQ ID NO: 3273 - DNA, 51 bp, Artificial Sequence
  Synthetic polynucleotide
agcacgggaagcagcctgatgccccrgaagaaaaaccccgacagtttggag

SEQ ID NO: 3274 - DNA, 51 bp, Artificial Sequence
  Synthetic polynucleotide
caggctttcattactgctcagaatcrtggctatgccttggacaacaccctc

SEQ ID NO: 3275 - DNA, 51 bp, Artificial Sequence
  Synthetic polynucleotide
gaccatttccaacatggaggcagatrtgaatagactcctcaaggtgtggaa

SEQ ID NO: 3276 - DNA, 51 bp, Artificial Sequence
  Synthetic polynucleotide
catcacagggcagacatatacacgaraagtggatattgaagtactgtctgt

SEQ ID NO: 3277 - DNA, 51 bp, Artificial Sequence
  Synthetic polynucleotide
agccattgcttttctcattatccacrggccacttcttctgcagagccctgt

SEQ ID NO: 3278 - DNA, 51 bp, Artificial Sequence
  Synthetic polynucleotide
agcatgggagatgatttatctttcartctcaatggttaaggattgaggaag

SEQ ID NO: 3279 - DNA, 51 bp, Artificial Sequence
  Synthetic polynucleotide
gcacaagaaggaccacccggattacragtaccagccgcggcggaggaagtc

SEQ ID NO: 3280 - DNA, 51 bp, Artificial Sequence
  Synthetic polynucleotide
gtttactgccttcttaatgctttccrggaaccagatcctgaattgccagtg

SEQ ID NO: 3281 - DNA, 51 bp, Artificial Sequence
  Synthetic polynucleotide
gaatggctactgggtggtgataatgdtgaaggaaaatgagtaccaggcgtc

SEQ ID NO: 3282 - DNA, 51 bp, Artificial Sequence
  Synthetic polynucleotide
ggctactgggtggtgataatgatgadggaaaatgagtaccaggcgtccagc

SEQ ID NO: 3283 - DNA, 51 bp, Artificial Sequence
  Synthetic polynucleotide
gtgcacaaacagttctatttgttttrtaattttgaatattggtttttacct

SEQ ID NO: 3284 - DNA, 51 bp, Artificial Sequence
  Synthetic polynucleotide
tcaatgttccaggtctctggacactrtgggcacacgactcctcccagctct

SEQ ID NO: 3285 - DNA, 51 bp, Artificial Sequence
  Synthetic polynucleotide
tggccaactgtggatgcttcctattdtggtggtcgaggggttggaggaatt

SEQ ID NO: 3286 - DNA, 51 bp, Artificial Sequence
  Synthetic polynucleotide
tataaaattatagagaaagttgattrcccccgggatgaaaatggagaaatt

SEQ ID NO: 3287 - DNA, 51 bp, Artificial Sequence
  Synthetic polynucleotide
atctttggaggaacccatgggaatgrgctaaccggagtatttctggttaag

SEQ ID NO: 3288 - DNA, 51 bp, Artificial Sequence
  Synthetic polynucleotide
tggcattgtttctaagaacttcacaragaaaatccagtaagtaacctggag

SEQ ID NO: 3289 - DNA, 51 bp, Artificial Sequence
  Synthetic polynucleotide
cagtacctgatgagtgctggtgccarcatctccacctgggtctacagtagc

SEQ ID NO: 3290 - DNA, 51 bp, Artificial Sequence
  Synthetic polynucleotide
tgtccctcatgccggcctggattttytttttttttttttttgagggatggg

SEQ ID NO: 3291 - DNA, 51 bp, Artificial Sequence
  Synthetic polynucleotide
cgggtcacatggcccgcgggacaacrtggctgcgcccgcactagggctggt

SEQ ID NO: 3292 - DNA, 51 bp, Artificial Sequence
  Synthetic polynucleotide
ggccgcgggagccgcacgcggcgatrtggaagaggagggcaagaagggcaa

SEQ ID NO: 3293 - DNA, 51 bp, Artificial Sequence
  Synthetic polynucleotide
gactggattagtatcccactggtgtrtacacaggtgaggactaggctggtg

SEQ ID NO: 3294 - DNA, 51 bp, Artificial Sequence
  Synthetic polynucleotide
actcagtgtggacacctgtatgcctrcgactggattagtatcccactggtg

SEQ ID NO: 3295 - DNA, 51 bp, Artificial Sequence
  Synthetic polynucleotide
tgtaatgcaggtaatgaatttgggcrtcctgaatggttagacttcccaaga

SEQ ID NO: 3296 - DNA, 51 bp, Artificial Sequence
  Synthetic polynucleotide
ggtcttcttttcattttcaacttccrtccaagcaagagctacactgactac

SEQ ID NO: 3297 - DNA, 51 bp, Artificial Sequence
  Synthetic polynucleotide
cttctgccctgggccctgcttatcartgaatccaaatgggacctctggcta

SEQ ID NO: 3298 - DNA, 51 bp, Artificial Sequence
  Synthetic polynucleotide
gaagtgaaagaagcatacatgggtartgttctacaaggaggtgaaggacaa

SEQ ID NO: 3299 - DNA, 51 bp, Artificial Sequence
  Synthetic polynucleotide
catattacttcattgctggggcccartggagctgggaaaactactaccatg

SEQ ID NO: 3300 - DNA, 51 bp, Artificial Sequence
  Synthetic polynucleotide
aaggggcgtgccaagcgacgacgacrgcagcaggtgctgcccctggatccc

SEQ ID NO: 3301 - DNA, 51 bp, Artificial Sequence
  Synthetic polynucleotide
agtctgaacgctgtatccttggtcarcctggtgatggtgagtcctcataca

SEQ ID NO: 3302 - DNA, 51 bp, Artificial Sequence
  Synthetic polynucleotide
ccctccagtgtgttttatgtcttctrcgaacagtacctgaccatcattgac

SEQ ID NO: 3303 - DNA, 51 bp, Artificial Sequence
  Synthetic polynucleotide
ctccgcctcatctctctcaatatgartttttgttcccgtgagaacttctgg

SEQ ID NO: 3304 - DNA, 51 bp, Artificial Sequence
  Synthetic polynucleotide
tctgactgctaatgagaagagcaccrtgcaggaactcaattctcggctggc

SEQ ID NO: 3305 - DNA, 51 bp, Artificial Sequence
  Synthetic polynucleotide
gagaagagcaccatgcaggaactcadttctcggctggcctcttacttggat

SEQ ID NO: 3306 - DNA, 51 bp, Artificial Sequence
  Synthetic polynucleotide
acaggtctgacaacagagcccattcrtaaggaaagtggaccaggagaagaa

SEQ ID NO: 3307 - DNA, 51 bp, Artificial Sequence
  Synthetic polynucleotide
gaggaaatatatattctctgtaagartggccctagtaaattgccttaaaac

SEQ ID NO: 3308 - DNA, 51 bp, Artificial Sequence
  Synthetic polynucleotide
gctctcctgaaaagagccaaagaggragtaggtctccttagggaacataaa

SEQ ID NO: 3309 - DNA, 51 bp, Artificial Sequence
  Synthetic polynucleotide
tattaggtggaccacacaggagaatrtggaaatctggtgactatacagtca

SEQ ID NO: 3310 - DNA, 51 bp, Artificial Sequence
  Synthetic polynucleotide
gagggggtttgtgcctgataacgtartaacaccagtggagacttgcagatg

SEQ ID NO: 3311 - DNA, 51 bp, Artificial Sequence
  Synthetic polynucleotide
gccctggctggggccccactgcccartgtcaccttggatggctttgacctc

SEQ ID NO: 3312 - DNA, 51 bp, Artificial Sequence
  Synthetic polynucleotide
catcgtcctggtctgcctcatcttcrgcgtgctgtccaccatcgagcagta

SEQ ID NO: 3313 - DNA, 51 bp, Artificial Sequence
  Synthetic polynucleotide
gagttatcaagagatatgaatgcatrcatcaggccatctcctactagagga

SEQ ID NO: 3314 - DNA, 51 bp, Artificial Sequence
  Synthetic polynucleotide
agtctacacagcacaatgaccccccrtggacctgatgctgactgctttgag

SEQ ID NO: 3315 - DNA, 51 bp, Artificial Sequence
  Synthetic polynucleotide
agggggagggagtctacacagcacartgaccccccatggacctgatgctga

SEQ ID NO: 3316 - DNA, 51 bp, Artificial Sequence
  Synthetic polynucleotide
ctgagcttgaagatccaggagctcartggtcttgccctgccccagcatgag

SEQ ID NO: 3317 - DNA, 51 bp, Artificial Sequence
  Synthetic polynucleotide
gtaaaacttgatgtttttttcttctrtgaagaaactgatcacatgtggaat

SEQ ID NO: 3318 - DNA, 51 bp, Artificial Sequence
  Synthetic polynucleotide
gcttgagaagagcatggctgggaagyagtggtggaagtagaggacccggcc

SEQ ID NO: 3319 - DNA, 51 bp, Artificial Sequence
  Synthetic polynucleotide
ccaagtaacccctactgcgcctgctrcatgtctctcttccaggtgaacggc

SEQ ID NO: 3320 - DNA, 51 bp, Artificial Sequence
  Synthetic polynucleotide
cctggacttctggagggtgctgttcraggactacaacctggagcgctatgg

SEQ ID NO: 3321 - DNA, 51 bp, Artificial Sequence
  Synthetic polynucleotide
tcgtctgctagcgctcttcagatccrcgagcggactcacactggagagaag

SEQ ID NO: 3322 - DNA, 51 bp, Artificial Sequence
  Synthetic polynucleotide
cagttactggaggattctacctcagrtgaagataggagcagctccagttcc

SEQ ID NO: 3323 - DNA, 51 bp, Artificial Sequence
  Synthetic polynucleotide
ttccttgggctgcgagcttttcaccrccataggtaaatttttcaataaaag

SEQ ID NO: 3324 - DNA, 51 bp, Artificial Sequence
  Synthetic polynucleotide
cccaaagagttctaccacgaggtgcvcaggccctctcacttcctcaacttt

SEQ ID NO: 3325 - DNA, 51 bp, Artificial Sequence
  Synthetic polynucleotide
tctggccgcagcaatgccatgccacrtattaagacatatatgaggccttct

SEQ ID NO: 3326 - DNA, 51 bp, Artificial Sequence
  Synthetic polynucleotide
agccaggagaagatcttctgtggccrgatctggcctgtggatcagcagctc

SEQ ID NO: 3327 - DNA, 51 bp, Artificial Sequence
  Synthetic polynucleotide
accacaggtttgcctctctcctcacrgcccccagtccccagccagacctcc

SEQ ID NO: 3328 - DNA, 51 bp, Artificial Sequence
  Synthetic polynucleotide
cagtcagccaatgggcacctcgggcrccacttcaacaggtgagccactgct

SEQ ID NO: 3329 - DNA, 51 bp, Artificial Sequence
  Synthetic polynucleotide
tgtcagcgaaagttctcccggtccgrccacctgaagacccacaccaggact

SEQ ID NO: 3330 - DNA, 51 bp, Artificial Sequence
  Synthetic polynucleotide
ttgcagccacagcacagggtacgagrgcgataaccacacaacgcccatcct

SEQ ID NO: 3331 - DNA, 51 bp, Artificial Sequence
  Synthetic polynucleotide
ccaggcctccacttctacaccctcarccgcgagatggctaccacagaggtg

SEQ ID NO: 3332 - DNA, 51 bp, Artificial Sequence
  Synthetic polynucleotide
taactcattctagctagttcaacttycattgccatttcagccagcataaat

SEQ ID NO: 3333 - DNA, 51 bp, Artificial Sequence
  Synthetic polynucleotide
tattaatggtcagaagatgtggatarccaacggaggaaaagctaattggta

SEQ ID NO: 3334 - DNA, 51 bp, Artificial Sequence
  Synthetic polynucleotide
aggatcagaggctggggccaactggraccattggcagctgcacgctcatta

SEQ ID NO: 3335 - DNA, 51 bp, Artificial Sequence
  Synthetic polynucleotide
tgttctaacccccacccccactgccrggtaagggtgtcaggggctccagtg

SEQ ID NO: 3336 - DNA, 51 bp, Artificial Sequence
  Synthetic polynucleotide
gttgcacatcccggtgatggtgcggyatttgtcctgctccgggcaagtcac

SEQ ID NO: 3337 - DNA, 51 bp, Artificial Sequence
  Synthetic polynucleotide
ttggattttggggcaacgcgggaatrtgacagatccttcaccgacctctac

SEQ ID NO: 3338 - DNA, 51 bp, Artificial Sequence
  Synthetic polynucleotide
cacactggtgcagaacctggtcaacratggctacgtgcgggacgagactgt

SEQ ID NO: 3339 - DNA, 51 bp, Artificial Sequence
  Synthetic polynucleotide
ggctacttgcctgtggtcatcgatarcttccataatgccttccgtggtgag

SEQ ID NO: 3340 - DNA, 51 bp, Artificial Sequence
  Synthetic polynucleotide
ggcgagtcggtgcagaagcctctggrttattacagagttaacctgaccggg

SEQ ID NO: 3341 - DNA, 51 bp, Artificial Sequence
  Synthetic polynucleotide
aagggccacattgcagccttaaggargctgaaagaacagtgtggctgccgg

SEQ ID NO: 3342 - DNA, 51 bp, Artificial Sequence
  Synthetic polynucleotide
agcatcaactttgacaaccccgtctrtcagaagaccacagaggatgaggtc

SEQ ID NO: 3343 - DNA, 51 bp, Artificial Sequence
  Synthetic polynucleotide
attgcaccactcaacattgttttgtrtaatgtctttactcctcatggacct

SEQ ID NO: 3344 - DNA, 51 bp, Artificial Sequence
  Synthetic polynucleotide
tgaagattacgggggactcatttttrccagccccagagcagtggaagcagc

SEQ ID NO: 3345 - DNA, 51 bp, Artificial Sequence
  Synthetic polynucleotide
gaatgctgtccaccgtggagcggggrcaggagtccctgtggccagctttca

SEQ ID NO: 3346 - DNA, 51 bp, Artificial Sequence
  Synthetic polynucleotide
agaccttgtgaggactagaggaagartgctcctggctgttttgtactgcct

SEQ ID NO: 3347 - DNA, 51 bp, Artificial Sequence
  Synthetic polynucleotide
gtcgccatggtgggggatggggtcadtgactccccggccttggcccaggca

SEQ ID NO: 3348 - DNA, 51 bp, Artificial Sequence
  Synthetic polynucleotide
ctccgagaggggagaccagcgggccvtgacaagctccaggctttggttttc

SEQ ID NO: 3349 - DNA, 51 bp, Artificial Sequence
  Synthetic polynucleotide
aataaattgaacgtgttccactggcrtctggtagatgatccttccttccca

SEQ ID NO: 3350 - DNA, 51 bp, Artificial Sequence
  Synthetic polynucleotide
cagcccgtaacccttctggacatctrtacacactggcaacagtaagtggtg

SEQ ID NO: 3351 - DNA, 51 bp, Artificial Sequence
  Synthetic polynucleotide
atgctttttttccacctaatcccctrgagtggtgtcttaactgtcaaactg

SEQ ID NO: 3352 - DNA, 51 bp, Artificial Sequence
  Synthetic polynucleotide
gcctagcagctgtccaaagtacaccyggtggtcagcaggatgcaggcccag

SEQ ID NO: 3353 - DNA, 51 bp, Artificial Sequence
  Synthetic polynucleotide
taattctaatggaattaagcctgtcrtggaacaatatggtctcatccctga

SEQ ID NO: 3354 - DNA, 51 bp, Artificial Sequence
  Synthetic polynucleotide
acttcttaccaaacttaacggcaccrtaaccacccctggctggcccaagga

SEQ ID NO: 3355 - DNA, 51 bp, Artificial Sequence
  Synthetic polynucleotide
ggaaatgtatgccattggcttttgtratatcatcccttccttcttccactg

SEQ ID NO: 3356 - DNA, 51 bp, Artificial Sequence
  Synthetic polynucleotide
cctgtccacaatgcctgtcttgtacrtgatcgtgtccctcccaccatcttt

SEQ ID NO: 3357 - DNA, 51 bp, Artificial Sequence
  Synthetic polynucleotide
gaagcaaggtgtggacgtcaaggccrtgacctctaatgtggccagtgtgca

SEQ ID NO: 3358 - DNA, 51 bp, Artificial Sequence
  Synthetic polynucleotide
aacgttccgtttctaacttttattarcaaattggaccgaatgggctccaac

SEQ ID NO: 3359 - DNA, 51 bp, Artificial Sequence
  Synthetic polynucleotide
gtgggcgacacgcccgcctacctctrcgaggagcgctggacgcccccctgc

SEQ ID NO: 3360 - DNA, 51 bp, Artificial Sequence
  Synthetic polynucleotide
tgccggcttcgtggcgcaggcgcctracaactaccgccgcttcctggagct

SEQ ID NO: 3361 - DNA, 51 bp, Artificial Sequence
  Synthetic polynucleotide
tccttttcctctacagggctccgagragggtgcagtgaggcccacagcctt

SEQ ID NO: 3362 - DNA, 51 bp, Artificial Sequence
  Synthetic polynucleotide
ccagccgaccacatggtacaggaggbtctagggtaaggacaaaggcaaaga

SEQ ID NO: 3363 - DNA, 51 bp, Artificial Sequence
  Synthetic polynucleotide
acatcacccacttggctcaagaccartggagcggtgaatgggaaggggtca

SEQ ID NO: 3364 - DNA, 51 bp, Artificial Sequence
  Synthetic polynucleotide
aaatatgttcatggcattgctgtacrttggtacctggactttctggctcca

SEQ ID NO: 3365 - DNA, 51 bp, Artificial Sequence
  Synthetic polynucleotide
gtgaatttgtccaaagcaggtattgrgacaactgtcatgactgatgctgcc

SEQ ID NO: 3366 - DNA, 51 bp, Artificial Sequence
  Synthetic polynucleotide
ctacagaacgtcagaaaacacatccrttcctgtttcaccaacatttcctgt

SEQ ID NO: 3367 - DNA, 51 bp, Artificial Sequence
  Synthetic polynucleotide
gaagctattccgaggggtgaagaagrtgggtggggaagaatttagccggcg

SEQ ID NO: 3368 - DNA, 51 bp, Artificial Sequence
  Synthetic polynucleotide
ttctggtctgaccgtcgcaaccctcrtgaagtacaaccagcatatgctaca

SEQ ID NO: 3369 - DNA, 51 bp, Artificial Sequence
  Synthetic polynucleotide
gtcaccgcctccaccacccaggggtrtgtccgcttcgagggaggcgccggg

SEQ ID NO: 3370 - DNA, 51 bp, Artificial Sequence
  Synthetic polynucleotide
ctgcagatccagcccagccagctggrattgttctactgtttgtacgagatg

SEQ ID NO: 3371 - DNA, 51 bp, Artificial Sequence
  Synthetic polynucleotide
cttattgacgttactttttgctcctrgacaaagtggctacgagctataagc

SEQ ID NO: 3372 - DNA, 51 bp, Artificial Sequence
  Synthetic polynucleotide
gataaatacccaaaggcccgttaccrttggctggtcttaccgtggacctcc

SEQ ID NO: 3373 - DNA, 51 bp, Artificial Sequence
  Synthetic polynucleotide
catcccaatgtcaaagttgtgtccarttttatggattttgatgaaactgta

SEQ ID NO: 3374 - DNA, 51 bp, Artificial Sequence
  Synthetic polynucleotide
ccggcagccgccgccagccgcagccrtgggccgggcccggccgggccaacg

SEQ ID NO: 3375 - DNA, 51 bp, Artificial Sequence
  Synthetic polynucleotide
tcactctgctccttccctgttgccartgtctcgctgactaagggtggacgt

SEQ ID NO: 3376 - DNA, 51 bp, Artificial Sequence
  Synthetic polynucleotide
ggtatattttgaacccaaagacatcrctgctgaagaagaagaggaagaagt

SEQ ID NO: 3377 - DNA, 51 bp, Artificial Sequence
  Synthetic polynucleotide
tgccttggtgattcagaccatcatgrctgtgattgtagtagatcagagagg

SEQ ID NO: 3378 - DNA, 51 bp, Artificial Sequence
  Synthetic polynucleotide
tatcccatatttatctggaccagatraaaacctgaccagtgcagaggtaag

SEQ ID NO: 3379 - DNA, 51 bp, Artificial Sequence
  Synthetic polynucleotide
cagacagctgactgcctggttaatgytgagaagagaaacatcagattccag

SEQ ID NO: 3380 - DNA, 51 bp, Artificial Sequence
  Synthetic polynucleotide
tttatgagaaattcttttatgttttrgataaatgcctgtagtcattatggc

SEQ ID NO: 3381 - DNA, 51 bp, Artificial Sequence
  Synthetic polynucleotide
tgaccttcggtcctgggaagccgccvagttgtttgcacgaaaactgaaccc

SEQ ID NO: 3382 - DNA, 51 bp, Artificial Sequence
  Synthetic polynucleotide
acaatgcaacatgcagtctacgtctrtgacatttgtcatgtgatcatcgac

SEQ ID NO: 3383 - DNA, 51 bp, Artificial Sequence
  Synthetic polynucleotide
acctgcccccaggtctggttccagarccgcagagccaagtggcggaagcgc

SEQ ID NO: 3384 - DNA, 51 bp, Artificial Sequence
  Synthetic polynucleotide
ttccaggacagtgttcataaaaatcrtcgttacaaggtaagaaaatataac

SEQ ID NO: 3385 - DNA, 51 bp, Artificial Sequence
  Synthetic polynucleotide
ctagtcctgaacccatcagcaataarcgtgagttcacacgagcttcgcgca

SEQ ID NO: 3386 - DNA, 51 bp, Artificial Sequence
  Synthetic polynucleotide
cctggaataaacttgaagaaaatacrttatgatagcatcaaactttatgag

SEQ ID NO: 3387 - DNA, 51 bp, Artificial Sequence
  Synthetic polynucleotide
gcttacttgcagagcattacccctcrggggtactctgactcggaggagagg

SEQ ID NO: 3388 - DNA, 51 bp, Artificial Sequence
  Synthetic polynucleotide
gttgtcatccagtctcttccttaggrattcattgcctttgggatcagcaac

SEQ ID NO: 3389 - DNA, 51 bp, Artificial Sequence
  Synthetic polynucleotide
ttatgctattgcagtgtcagtaggaraagtatatgccaccaagtatgatta

SEQ ID NO: 3390 - DNA, 51 bp, Artificial Sequence
  Synthetic polynucleotide
aaggacacattctttttgacggtccrtgatgctatactctatctacagaac

SEQ ID NO: 3391 - DNA, 51 bp, Artificial Sequence
  Synthetic polynucleotide
tttttaacatcttttgttttatttcrgacgataattgctactgccatttca

SEQ ID NO: 3392 - DNA, 51 bp, Artificial Sequence
  Synthetic polynucleotide
gaccccatatgctgtctcgactgcartgacaaagtatctaaatacaaatgt

SEQ ID NO: 3393 - DNA, 51 bp, Artificial Sequence
  Synthetic polynucleotide
ttgttttgcttctttctgccagtcarcaatgtcggaatgcttccaaacctt

SEQ ID NO: 3394 - DNA, 51 bp, Artificial Sequence
  Synthetic polynucleotide
gttttgatcttagtgtttattacagraaatgaagccatatctcactaacta

SEQ ID NO: 3395 - DNA, 51 bp, Artificial Sequence
  Synthetic polynucleotide
ctaaataaacattttccttatcaggrttcagagaagatgtgcattgaaatt

SEQ ID NO: 3396 - DNA, 51 bp, Artificial Sequence
  Synthetic polynucleotide
ctgcatgcgctggtggccattgctgrcaacacccgtgagaacaccaagttt

SEQ ID NO: 3397 - DNA, 51 bp, Artificial Sequence
  Synthetic polynucleotide
ttaaaaaaagttgcagctactttgcragtgccagtaaatgatttaaatgca

SEQ ID NO: 3398 - DNA, 51 bp, Artificial Sequence
  Synthetic polynucleotide
tggcgcaccccatcagaccatctacrgtgagtagggcttcaggctgggaag

SEQ ID NO: 3399 - DNA, 51 bp, Artificial Sequence
  Synthetic polynucleotide
gggctgtatcgaattgtgggtgtcavctccagagtgcagaagttgctgagt

SEQ ID NO: 3400 - DNA, 51 bp, Artificial Sequence
  Synthetic polynucleotide
cgctcctacagccacgtggtgctcarggaggtgcgcttcttcaacctgcag

SEQ ID NO: 3401 - DNA, 51 bp, Artificial Sequence
  Synthetic polynucleotide
tgcgacatggacgtgtttgatgcctrtctgccttggcgccgcaacctgtcc

SEQ ID NO: 3402 - DNA, 51 bp, Artificial Sequence
  Synthetic polynucleotide
cttgaaactgaatggaagaataactrtcctcgcctgcgggaacttgaccgg

SEQ ID NO: 3403 - DNA, 51 bp, Artificial Sequence
  Synthetic polynucleotide
agtatcttcactcccagtccttgtaraattccacctccgacgagagtgggc

SEQ ID NO: 3404 - DNA, 51 bp, Artificial Sequence
  Synthetic polynucleotide
ccgcgccggggtgcaaatagccatcrtgaccttcaaaggtgcgaaagggcc

SEQ ID NO: 3405 - DNA, 51 bp, Artificial Sequence
  Synthetic polynucleotide
acaggccctccccttctctgcccacrgtacctggcgttgcctgacgtgtca

SEQ ID NO: 3406 - DNA, 51 bp, Artificial Sequence
  Synthetic polynucleotide
aggaactcctgcaataacttcatctrtggaggctgccggggcaataagaac

SEQ ID NO: 3407 - DNA, 51 bp, Artificial Sequence
  Synthetic polynucleotide
gggagggctggggtttctcagggtcrgggggtccccaaggagtagccaggg

SEQ ID NO: 3408 - DNA, 51 bp, Artificial Sequence
  Synthetic polynucleotide
aggggccaggcttggccaggagggasatcaggcctgggtcttgccttcact

SEQ ID NO: 3409 - DNA, 51 bp, Artificial Sequence
  Synthetic polynucleotide
gggcaggagagcacagacacggagcrggcccctggcaaggacactttctac

SEQ ID NO: 3410 - DNA, 51 bp, Artificial Sequence
  Synthetic polynucleotide
agcctggacattaccttccgctccgrctactccaacgagaagcygttcacg

SEQ ID NO: 3411 - DNA, 51 bp, Artificial Sequence
  Synthetic polynucleotide
gctctgcctcccatagaccccctggrtcaccgggatgctggagatctctgg

SEQ ID NO: 3412 - DNA, 51 bp, Artificial Sequence
  Synthetic polynucleotide
agcactacagagcagttggggtatgrtgggcatgttagccagccagcagaa

SEQ ID NO: 3413 - DNA, 51 bp, Artificial Sequence
  Synthetic polynucleotide
gtaatgtcacagcgacatatgatagrtggacgatggtgtgactgcaaactt

SEQ ID NO: 3414 - DNA, 51 bp, Artificial Sequence
  Synthetic polynucleotide
ggtatgatgggcatgttagccagccrgcagaaccagtcaggcccatcgggt

SEQ ID NO: 3415 - DNA, 51 bp, Artificial Sequence
  Synthetic polynucleotide
cgttcatatatccaatgccgaacctragcacaatagcaatagacagttaga

SEQ ID NO: 3416 - DNA, 51 bp, Artificial Sequence
  Synthetic polynucleotide
atcaacagtaacctgaaatttgcagrggttagtgatactcacctgtggtat

SEQ ID NO: 3417 - DNA, 51 bp, Artificial Sequence
  Synthetic polynucleotide
aatcaactctgggctggcctgggctrctattctcgtggccggcggctgcag

SEQ ID NO: 3418 - DNA, 51 bp, Artificial Sequence
  Synthetic polynucleotide
tccgtgacctgggagccctcagagcrgcttcagcgcaaggccctgctgcag

SEQ ID NO: 3419 - DNA, 51 bp, Artificial Sequence
  Synthetic polynucleotide
ttgaaaagaattgtaacatcatgctrtggcccctcaggtaggctgaagcag

SEQ ID NO: 3420 - DNA, 51 bp, Artificial Sequence
  Synthetic polynucleotide
tggctttggaggttacgtgtgtacarcctcacagtcctcagctctgctcag

SEQ ID NO: 3421 - DNA, 51 bp, Artificial Sequence
  Synthetic polynucleotide
gtgcagcccgtggtcaccctgtaccrctgggacctgccccagcgcctgcag

SEQ ID NO: 3422 - DNA, 51 bp, Artificial Sequence
  Synthetic polynucleotide
cttttcttttttttgccctgcctggrtacctaccacaaggttgaccttcgt

SEQ ID NO: 3423 - DNA, 51 bp, Artificial Sequence
  Synthetic polynucleotide
cacctcctgactaaagcgctccaccbaagaagataaggaaaatagatatat

SEQ ID NO: 3424 - DNA, 51 bp, Artificial Sequence
  Synthetic polynucleotide
gaagtatctttgttttcattcacccrggaatgcattcacagaggaggattc

SEQ ID NO: 3425 - DNA, 51 bp, Artificial Sequence
  Synthetic polynucleotide
gctactgcaatcacaatccaaagggrttggattgttgttgttgcaggagaa

SEQ ID NO: 3426 - DNA, 51 bp, Artificial Sequence
  Synthetic polynucleotide
cgtgaacacggcccggcccgacgagraggccataatgacctatgtgtccag

SEQ ID NO: 3427 - DNA, 51 bp, Artificial Sequence
  Synthetic polynucleotide
caaatggggtcatgaagccattgaartgcacagctcttatttccacattgc

SEQ ID NO: 3428 - DNA, 51 bp, Artificial Sequence
  Synthetic polynucleotide
gttttcctaccctgagcgccccatcrtatttctcagtatgtgctataatat

SEQ ID NO: 3429 - DNA, 51 bp, Artificial Sequence
  Synthetic polynucleotide
agtgtttttttccagagaaagctgaytgttaccagcaagacattcttctaa

SEQ ID NO: 3430 - DNA, 51 bp, Artificial Sequence
  Synthetic polynucleotide
cagggtgttacatttccagccatgcrtgccatgtggtcttcttgggctccc

SEQ ID NO: 3431 - DNA, 51 bp, Artificial Sequence
  Synthetic polynucleotide
atgggcctccactaggggaggccatdaggagcgccccacagtcatgctgtt

SEQ ID NO: 3432 - DNA, 51 bp, Artificial Sequence
  Synthetic polynucleotide
agagttgaacaaaaggcaggggtgaytgcacagttttttaagagctcctat

SEQ ID NO: 3433 - DNA, 51 bp, Artificial Sequence
  Synthetic polynucleotide
taagtgcctgacttttatgttttacrgaactaaaaccagaacaggtgaaga

SEQ ID NO: 3434 - DNA, 51 bp, Artificial Sequence
  Synthetic polynucleotide
agtcttatacttgtatttcctctagrtgaagttgatagccttttgtgtgaa

SEQ ID NO: 3435 - DNA, 51 bp, Artificial Sequence
  Synthetic polynucleotide
tgcaagtttaacttcaaaatacgtgrgtgctctgtttccaatattgtcgta

SEQ ID NO: 3436 - DNA, 51 bp, Artificial Sequence
  Synthetic polynucleotide
ctgttactctttggtccacctgggartgggaagacaatgctggtaagggtt

SEQ ID NO: 3437 - DNA, 51 bp, Artificial Sequence
  Synthetic polynucleotide
agaatcgaatgcaaccttctttaatrtaagtgctgcaagtttaacttcaaa

SEQ ID NO: 3438 - DNA, 51 bp, Artificial Sequence
  Synthetic polynucleotide
acacctggatgtggacaacgaccgarccacacccagcgacctggacagcac

SEQ ID NO: 3439 - DNA, 51 bp, Artificial Sequence
  Synthetic polynucleotide
tgcccaattttttactgcttacaagrtattatgcgagtctgtagtgaatcc

SEQ ID NO: 3440 - DNA, 51 bp, Artificial Sequence
  Synthetic polynucleotide
ccaggaaacatcgtgggaatcggccrgtgcctgctgcatggcatgacggtg

SEQ ID NO: 3441 - DNA, 51 bp, Artificial Sequence
  Synthetic polynucleotide
ggaggcctgatcactctctcttcttrcaacaaattccacaacaactgctac

SEQ ID NO: 3442 - DNA, 51 bp, Artificial Sequence
  Synthetic polynucleotide
gacactctaattgtcacctgcaccarcagtgccacaagcatctttgccggc

SEQ ID NO: 3443 - DNA, 51 bp, Artificial Sequence
  Synthetic polynucleotide
gcgttttacaatggactctgggcctrtgatggatggtgaggtgtcctgaga

SEQ ID NO: 3444 - DNA, 51 bp, Artificial Sequence
  Synthetic polynucleotide
gagcctgtgtgtgtcgggcagctgcrgggtaggcgtgtgtggacattggcg

SEQ ID NO: 3445 - DNA, 51 bp, Artificial Sequence
  Synthetic polynucleotide
tgtatttggagctacctctagtatcraaagtggtttagatttgaatacaag

SEQ ID NO: 3446 - DNA, 51 bp, Artificial Sequence
  Synthetic polynucleotide
tccttccctgaccccaggggcctctrccacttctgcctctactggaaccga

SEQ ID NO: 3447 - DNA, 51 bp, Artificial Sequence
  Synthetic polynucleotide
aggaactgagcccttctttaagcagraaagtctgcttctaaagcagaaaca

SEQ ID NO: 3448 - DNA, 51 bp, Artificial Sequence
  Synthetic polynucleotide
catctccttcctcatcgtggtcaacrtgtacatcgccatcatcctggagaa

SEQ ID NO: 3449 - DNA, 51 bp, Artificial Sequence
  Synthetic polynucleotide
cgccctcctaggcgccatcccctccrtcatgaatgtgctgcttgtctgcct

SEQ ID NO: 3450 - DNA, 51 bp, Artificial Sequence
  Synthetic polynucleotide
gttcagcatgttcatcatgatcaccrtcttgaccaactgcgtattcatgac

SEQ ID NO: 3451 - DNA, 51 bp, Artificial Sequence
  Synthetic polynucleotide
cctgactgccacaggtgtacaggaarcatttgtcttttgttgctggaaagc

SEQ ID NO: 3452 - DNA, 51 bp, Artificial Sequence
  Synthetic polynucleotide
cagtgcagagcagcacctgatatccrtgtgtgaggaccatgatcgcatcct

SEQ ID NO: 3453 - DNA, 51 bp, Artificial Sequence
  Synthetic polynucleotide
cctctctccggtccgtgcctccaagdtggtgagtcttcttgcgtggtgagg

SEQ ID NO: 3454 - DNA, 51 bp, Artificial Sequence
  Synthetic polynucleotide
tcaaactaagaagctctccacctccrgtaacaatgatgacaaaattaatgg

SEQ ID NO: 3455 - DNA, 51 bp, Artificial Sequence
  Synthetic polynucleotide
gatgaggaagaagaatgtccatcagrggaaacagacatcatctccaaagga

SEQ ID NO: 3456 - DNA, 51 bp, Artificial Sequence
  Synthetic polynucleotide
aaagtgtttatctcagtctgagcggrcgaccacgtctcccaaaaggctgct

SEQ ID NO: 3457 - DNA, 51 bp, Artificial Sequence
  Synthetic polynucleotide
tctggctcccccttctcctgcctgcrggtcagcatcacggtgatcgaggcc

SEQ ID NO: 3458 - DNA, 51 bp, Artificial Sequence
  Synthetic polynucleotide
gctcgagtgtttcgatcctctccccrgtttggtgttaccttggtcacttat

SEQ ID NO: 3459 - DNA, 51 bp, Artificial Sequence
  Synthetic polynucleotide
aatgccctacagttggcagtggccartgagcatctggaaattacagaactt

SEQ ID NO: 3460 - DNA, 51 bp, Artificial Sequence
  Synthetic polynucleotide
tttggaatttatccagtgatcaggtrttgtgcaaagagctagtgaaccttt

SEQ ID NO: 3461 - DNA, 51 bp, Artificial Sequence
  Synthetic polynucleotide
gggcaatttaggaaccttttttattrccaatgtgagaattgtgtggcatgc

SEQ ID NO: 3462 - DNA, 51 bp, Artificial Sequence
  Synthetic polynucleotide
ccacagtacccgtactcagcacctcrgtgtcgagacttcgtaccttcagca

SEQ ID NO: 3463 - DNA, 51 bp, Artificial Sequence
  Synthetic polynucleotide
ggcattccggcgccattacatgatcrcactggaagtccctgctcgagacag

SEQ ID NO: 3464 - DNA, 51 bp, Artificial Sequence
  Synthetic polynucleotide
tgccttttcctccacggacaaatgcrgaccctggaccaagtaagtaacaac

SEQ ID NO: 3465 - DNA, 51 bp, Artificial Sequence
  Synthetic polynucleotide
tgccacggggtgtcaggctcctgtgrggtaaagacgtgctggcgagccgtg

SEQ ID NO: 3466 - DNA, 51 bp, Artificial Sequence
  Synthetic polynucleotide
gctggcactgccgggcaaggcagagrgtgtggcgtcgctcaccagccagtg

SEQ ID NO: 3467 - DNA, 51 bp, Artificial Sequence
  Synthetic polynucleotide
tagggcacgaccaatcaaatacacargaaaaggcgttgtagttcctatctc

SEQ ID NO: 3468 - DNA, 51 bp, Artificial Sequence
  Synthetic polynucleotide
ggaagctggcaaacagctgcccttcrtctatggggacattcctcccggcat

SEQ ID NO: 3469 - DNA, 51 bp, Artificial Sequence
  Synthetic polynucleotide
gcaatgttgcctcccccaggacctcrgagctttgtccatttcacaaaacag

SEQ ID NO: 3470 - DNA, 51 bp, Artificial Sequence
  Synthetic polynucleotide
gcctgtggataatgcacgagaagccrtgcagcaggcagatgactggctggg

SEQ ID NO: 3471 - DNA, 51 bp, Artificial Sequence
  Synthetic polynucleotide
gtaggcatgggccagatctccaactrtgtggcagcatttgtcctgggtatg

SEQ ID NO: 3472 - DNA, 51 bp, Artificial Sequence
  Synthetic polynucleotide
ccgcagtacaacccaggggacaaagrtaccaaaattgccaagaggatggct

SEQ ID NO: 3473 - DNA, 51 bp, Artificial Sequence
  Synthetic polynucleotide
tctcttctctctgttggttgtaggargctgtacaacaatggctttacttca

SEQ ID NO: 3474 - DNA, 51 bp, Artificial Sequence
  Synthetic polynucleotide
ggagacactggcaccctatatccccrtggacggggaagacttccagctaag

SEQ ID NO: 3475 - DNA, 51 bp, Artificial Sequence
  Synthetic polynucleotide
gttcagcctcatcttcaagctcatcrttgagttcctcttcctctacctgct

SEQ ID NO: 3476 - DNA, 51 bp, Artificial Sequence
  Synthetic polynucleotide
atgccgcgcctggtgcagtgtgccadcgtggccccctgccccaacatcgtg

SEQ ID NO: 3477 - DNA, 51 bp, Artificial Sequence
  Synthetic polynucleotide
tgtttttttgcttttgtaggttgccrtgggtcaaggtcaagctgatttagc

SEQ ID NO: 3478 - DNA, 51 bp, Artificial Sequence
  Synthetic polynucleotide
cgcatgccacctgatgtaattagagrtattcttgaaggagttttaaggttg

SEQ ID NO: 3479 - DNA, 51 bp, Artificial Sequence
  Synthetic polynucleotide
gttgacccatctctgttcccttcacrggtaagggggcttacgtgtagaagc

SEQ ID NO: 3480 - DNA, 51 bp, Artificial Sequence
  Synthetic polynucleotide
tggtccaagtggtgctggaaaatcarcgctttggagaatgttaagggctgc

SEQ ID NO: 3481 - DNA, 51 bp, Artificial Sequence
  Synthetic polynucleotide
gtggcctttttgagactaaatcacarcaaactgtcagatgagggtctccca

SEQ ID NO: 3482 - DNA, 51 bp, Artificial Sequence
  Synthetic polynucleotide
tatccgcgccatgcctgtctacaaaraagctgagcacgtcacggaggtggt

SEQ ID NO: 3483 - DNA, 51 bp, Artificial Sequence
  Synthetic polynucleotide
cggatctgtgcttgcccaggaagagrcaggaaggcggatgaagatagcatc

SEQ ID NO: 3484 - DNA, 51 bp, Artificial Sequence
  Synthetic polynucleotide
gatctgtgcttgcccaggaagagacrggaaggcggatgaagatagcatcag

SEQ ID NO: 3485 - DNA, 51 bp, Artificial Sequence
  Synthetic polynucleotide
agaacagtggctgcttttggtggtgrgaaaagagaggttgaaaggttggtt

SEQ ID NO: 3486 - DNA, 51 bp, Artificial Sequence
  Synthetic polynucleotide
ggacctcacgtacccagtcacctccrtgttcactgggtctgcctttaaccg

SEQ ID NO: 3487 - DNA, 51 bp, Artificial Sequence
  Synthetic polynucleotide
gtacaccacggggacgatgggcaccygcaggcagggagacgcacagctgag

SEQ ID NO: 3488 - DNA, 51 bp, Artificial Sequence
  Synthetic polynucleotide
aagtctcggatctttcagaacctcarcggggctttaggtgaggaggaagac

SEQ ID NO: 3489 - DNA, 51 bp, Artificial Sequence
  Synthetic polynucleotide
gcatacttagactactacctcgatgrtattattgacttatttaattgtttg

SEQ ID NO: 3490 - DNA, 51 bp, Artificial Sequence
  Synthetic polynucleotide
gggccaggtgcaggagacatcaaggrtcctggatgaggtgagctgggcgtg

SEQ ID NO: 3491 - DNA, 51 bp, Artificial Sequence
  Synthetic polynucleotide
cttttttgtcttctctctggggcagrggctggcaggatcccaaacccacac

SEQ ID NO: 3492 - DNA, 51 bp, Artificial Sequence
  Synthetic polynucleotide
cagctcttaaccactccagccactcrctctggcacctctgttttttccctt

SEQ ID NO: 3493 - DNA, 51 bp, Artificial Sequence
  Synthetic polynucleotide
aacttgtcccctccctgtgtcttctrgctgtgcagcaagatcttggagaag

SEQ ID NO: 3494 - DNA, 51 bp, Artificial Sequence
  Synthetic polynucleotide
cgctgcggctggattcccatccagtrccccatcatttccgagtgcaagtgc

SEQ ID NO: 3495 - DNA, 51 bp, Artificial Sequence
  Synthetic polynucleotide
gatacaatttttttctttctcttttrggccttgaatgtcccatgcagttcc

SEQ ID NO: 3496 - DNA, 51 bp, Artificial Sequence
  Synthetic polynucleotide
aggggattatatgggagtccaccccrtgggtctcttctggtctctgaaacc

SEQ ID NO: 3497 - DNA, 51 bp, Artificial Sequence
  Synthetic polynucleotide
tttggctttcctgtgcactacacagrcgtgtccaacatgggccgtggtgcc

SEQ ID NO: 3498 - DNA, 51 bp, Artificial Sequence
  Synthetic polynucleotide
gctgcttctgtcttgcaggccatctrcgtgattgacttcttctggaacgaa

SEQ ID NO: 3499 - DNA, 51 bp, Artificial Sequence
  Synthetic polynucleotide
aaggttctctttcttgcagggcccartggctgcaaaatcgcaacccaacat

SEQ ID NO: 3500 - DNA, 51 bp, Artificial Sequence
  Synthetic polynucleotide
tatcatcagagcatgtcacagatctrtggactcattcatggtgacctgtaa

SEQ ID NO: 3501 - DNA, 51 bp, Artificial Sequence
  Synthetic polynucleotide
gtgctggacgaggcaaagaatatcarcaagtcactgtcagctctgggcaat

SEQ ID NO: 3502 - DNA, 51 bp, Artificial Sequence
  Synthetic polynucleotide
gtctccttcctcccccagaaaagctrtgttccatatcgtgacagcaaaatg

SEQ ID NO: 3503 - DNA, 51 bp, Artificial Sequence
  Synthetic polynucleotide
ttttgtccaggcttgagtcaccatgrgtagtagtttaggaaaagaaaaaga

SEQ ID NO: 3504 - DNA, 51 bp, Artificial Sequence
  Synthetic polynucleotide
tactccttgatcaaaaataaaatccrcagattgcccgttattgaccctatc

SEQ ID NO: 3505 - DNA, 51 bp, Artificial Sequence
  Synthetic polynucleotide
gtcctgcttttctctttgcaggtccrtcggctggtggtggtaaatgaagca

SEQ ID NO: 3506 - DNA, 51 bp, Artificial Sequence
  Synthetic polynucleotide
ttaaaatttgtatacgtgtaatgcarcattcagaggattgctgcatttaga

SEQ ID NO: 3507 - DNA, 51 bp, Artificial Sequence
  Synthetic polynucleotide
ggccttggacaagttgttactgactrtgttcatggggatgccttgcagaaa

SEQ ID NO: 3508 - DNA, 51 bp, Artificial Sequence
  Synthetic polynucleotide
gaatggtgtggagtgcagcacatacrcttgtcaccgagccaccattgtatg

SEQ ID NO: 3509 - DNA, 51 bp, Artificial Sequence
  Synthetic polynucleotide
atgaccttgagccctcaggaacgagdtggcggttctctggaggctgagtgc

SEQ ID NO: 3510 - DNA, 51 bp, Artificial Sequence
  Synthetic polynucleotide
tcagtaaaatattctggctttacaaytggacgtccacaaatgagtgcacat

SEQ ID NO: 3511 - DNA, 51 bp, Artificial Sequence
  Synthetic polynucleotide
ttcctgtacagctgggccaaacccarccctagggaggccactgtctcctaa

SEQ ID NO: 3512 - DNA, 51 bp, Artificial Sequence
  Synthetic polynucleotide
cttatacttttcctagaagaggatcrctacttagccccagacttttaccat

SEQ ID NO: 3513 - DNA, 51 bp, Artificial Sequence
  Synthetic polynucleotide
gaaaacttggaaatccacagagcacratatgggtctagccttgacccggaa

SEQ ID NO: 3514 - DNA, 51 bp, Artificial Sequence
  Synthetic polynucleotide
cagtccaatggcacgcatatcatgtrtaaaaacacactctggatcgaaagc

SEQ ID NO: 3515 - DNA, 51 bp, Artificial Sequence
  Synthetic polynucleotide
ggtattgtctttgcatgtatttcctrgggatgtcctttaactccattgcct

SEQ ID NO: 3516 - DNA, 51 bp, Artificial Sequence
  Synthetic polynucleotide
gagatttttctttccaaagcaattcrcaagtccttcctagaggttaatgaa

SEQ ID NO: 3517 - DNA, 51 bp, Artificial Sequence
  Synthetic polynucleotide
agacggttttcggaaggtggtgagcrtcgagcagggcggcctgcttaggcc

SEQ ID NO: 3518 - DNA, 51 bp, Artificial Sequence
  Synthetic polynucleotide
gtttactgttctgattttcatgctgraagagcagcgagagagaaaattcat

SEQ ID NO: 3519 - DNA, 51 bp, Artificial Sequence
  Synthetic polynucleotide
gtgattatcaccagcaccagttcgtrttatgtgttttacatttacgtggga

SEQ ID NO: 3520 - DNA, 51 bp, Artificial Sequence
  Synthetic polynucleotide
ctcaataagtcctggccagagggtgrgatttgaacactgcttgctttgtta

SEQ ID NO: 3521 - DNA, 51 bp, Artificial Sequence
  Synthetic polynucleotide
actgagtggaggtcaacgagcaagartttctttagcaaggtgaataactaa

SEQ ID NO: 3522 - DNA, 51 bp, Artificial Sequence
  Synthetic polynucleotide
ttactgggaagaatcatagcttcctrtgacccggataacaaggaggaacgc

SEQ ID NO: 3523 - DNA, 51 bp, Artificial Sequence
  Synthetic polynucleotide
tggaatctttttatatttaggggtarggatctcatttgtacattcattatg

SEQ ID NO: 3524 - DNA, 51 bp, Artificial Sequence
  Synthetic polynucleotide
ctgttccacaaagctctgaatttacrtactgccaactggttcttgtacctg

SEQ ID NO: 3525 - DNA, 51 bp, Artificial Sequence
  Synthetic polynucleotide
  misc_feature (26)..(26): n is a, c, g, t or u
catattagagaacatttccttctcantaagtcctggccagagggtgagatt

SEQ ID NO: 3526 - DNA, 51 bp, Artificial Sequence
  Synthetic polynucleotide
gcactcctcatggggctaatctgggrgttgttacaggcgtctgccttctgt

SEQ ID NO: 3527 - DNA, 51 bp, Artificial Sequence
  Synthetic polynucleotide
cctccaccctcaggagaaagagaagragtacatgctgcctctggacaacct

SEQ ID NO: 3528 - DNA, 51 bp, Artificial Sequence
  Synthetic polynucleotide
tctcagaccccaatcctaagccctcrggaggttgtgtcttgtagccagtat

SEQ ID NO: 3529 - DNA, 51 bp, Artificial Sequence
  Synthetic polynucleotide
aatcatgctgttctgcttgtgggctrtggcactgactcagcctctgggatg

SEQ ID NO: 3530 - DNA, 51 bp, Artificial Sequence
  Synthetic polynucleotide
cgttattactcctctgagtaccactrtgtaggaggtttctatggaggctgc

SEQ ID NO: 3531 - DNA, 51 bp, Artificial Sequence
  Synthetic polynucleotide
tccgacccctccaacctgcggccctrgagcgcccccgccgccccgggggaa

SEQ ID NO: 3532 - DNA, 51 bp, Artificial Sequence
  Synthetic polynucleotide
accaccattggctacggggacaagtrcccccagacctggaacggcaggctc

SEQ ID NO: 3533 - DNA, 51 bp, Artificial Sequence
  Synthetic polynucleotide
gccctgagctggggcctccgtgaagdctactcccggggcggctactgcatg

SEQ ID NO: 3534 - DNA, 51 bp, Artificial Sequence
  Synthetic polynucleotide
agaacgttattatccagagtataccyaaaggagaaaaagaatcccaaaata

SEQ ID NO: 3535 - DNA, 51 bp, Artificial Sequence
  Synthetic polynucleotide
ggagaaggagcagatcaagtccctcvacagcaggttcgcggccttcatcga

SEQ ID NO: 3536 - DNA, 51 bp, Artificial Sequence
  Synthetic polynucleotide
tctaatggcgaaaaaaaatttcaacrcaaatctgctggaatagatagaaaa

SEQ ID NO: 3537 - DNA, 51 bp, Artificial Sequence
  Synthetic polynucleotide
tttgatgtctttcctgatggatgggrcaagagatactgtctgcgacatgtg

SEQ ID NO: 3538 - DNA, 51 bp, Artificial Sequence
  Synthetic polynucleotide
tcttttgctttctaaacacttttcartgtttttaggtgtatagtgttgatt

SEQ ID NO: 3539 - DNA, 51 bp, Artificial Sequence
  Synthetic polynucleotide
ctcatcgtagccaccattgctgtcargtacactcagtctaactctgtgtgc

SEQ ID NO: 3540 - DNA, 51 bp, Artificial Sequence
  Synthetic polynucleotide
gatgacaatcatgttgcagcaattcrctgtaaagctggaaagggacgaact

SEQ ID NO: 3541 - DNA, 51 bp, Artificial Sequence
  Synthetic polynucleotide
gttgcacaatatccttttgaagaccrtaacccaccacagctagaacttatc

SEQ ID NO: 3542 - DNA, 51 bp, Artificial Sequence
  Synthetic polynucleotide
cctcagccgttacctgtgtgtggtgrtatcaaagtagagttcttccacaaa

SEQ ID NO: 3543 - DNA, 51 bp, Artificial Sequence
  Synthetic polynucleotide
tccttgtcccgagaatcttccttacrgtaccattcaggaatggggactgtg

SEQ ID NO: 3544 - DNA, 51 bp, Artificial Sequence
  Synthetic polynucleotide
agaaactatgcaaaatcttaatgatrgattagcttcctacctggataaggt

SEQ ID NO: 3545 - DNA, 51 bp, Artificial Sequence
  Synthetic polynucleotide
tgagagaataattcaaaggtttggargaaaagtggtgtatgttgttatagg

SEQ ID NO: 3546 - DNA, 51 bp, Artificial Sequence
  Synthetic polynucleotide
gtgtactcggggagcctctatttccrgggcgctgagtccagaactgtcata

SEQ ID NO: 3547 - DNA, 51 bp, Artificial Sequence
  Synthetic polynucleotide
acaaacctgggagacaaacatccgtragcagtcagtcgccaatgccttcat

SEQ ID NO: 3548 - DNA, 51 bp, Artificial Sequence
  Synthetic polynucleotide
gaccctcaagctggcggccaggtacrtcgacttcctctaccaggtcctcca

SEQ ID NO: 3549 - DNA, 51 bp, Artificial Sequence
  Synthetic polynucleotide
acagatcaccgtcctgctgggccacracggtgccgggaagaccaccaccct

SEQ ID NO: 3550 - DNA, 51 bp, Artificial Sequence
  Synthetic polynucleotide
attcctcagaggccatgtggccccarctggcagcgacagctgcagacgggc

SEQ ID NO: 3551 - DNA, 51 bp, Artificial Sequence
  Synthetic polynucleotide
aacgaacccacgtactgtctgtgcarccaggtctcctatggggagatgatc

SEQ ID NO: 3552 - DNA, 51 bp, Artificial Sequence
  Synthetic polynucleotide
gattttgaacgaactcttaaaggacrtacagactctgtacaggacatttca

SEQ ID NO: 3553 - DNA, 51 bp, Artificial Sequence
  Synthetic polynucleotide
tacggggagagtggagaaaaaggggrcacagggttaatgtgaagtccagga

SEQ ID NO: 3554 - DNA, 51 bp, Artificial Sequence
  Synthetic polynucleotide
actttacgacctacacaggagtttcrgtaacgtgaagtatgtcatgttgga

SEQ ID NO: 3555 - DNA, 51 bp, Artificial Sequence
  Synthetic polynucleotide
tctgctgctgcaataagataaaaaayccactaacacaactagcccggatta

SEQ ID NO: 3556 - DNA, 51 bp, Artificial Sequence
  Synthetic polynucleotide
atctgggacggcgaggagaccagctrctgcttcaaggagaagtcgaggggt

SEQ ID NO: 3557 - DNA, 51 bp, Artificial Sequence
  Synthetic polynucleotide
agaagacgcacacataacttttgctrtattggatgcagtaaatggaaatat

SEQ ID NO: 3558 - DNA, 51 bp, Artificial Sequence
  Synthetic polynucleotide
ccgcccagctgctgcgtgcccaccarattgactcccatcagcattctatac

SEQ ID NO: 3559 - DNA, 51 bp, Artificial Sequence
  Synthetic polynucleotide
accccccatcacaccccacgagtacvtgctctcgctgtacaggacgctgtc

SEQ ID NO: 3560 - DNA, 51 bp, Artificial Sequence
  Synthetic polynucleotide
cgagagaagctgaccatcatcccccrggtgagctctagaacttactcgggc

SEQ ID NO: 3561 - DNA, 51 bp, Artificial Sequence
  Synthetic polynucleotide
acctggccagcttccccaagatgtgrctccagccagccaaatccatcctgc

SEQ ID NO: 3562 - DNA, 51 bp, Artificial Sequence
  Synthetic polynucleotide
aacgtcttcaacatcctcatcgtctrcatgctattcatgttcatcttcgcc

SEQ ID NO: 3563 - DNA, 51 bp, Artificial Sequence
  Synthetic polynucleotide
caagagaaggaaagaaacatatttgrccagcgtgccatagagaatgagcta

SEQ ID NO: 3564 - DNA, 51 bp, Artificial Sequence
  Synthetic polynucleotide
acgctcaaccgcttagcaggcaaacrgatgatccaagtcgtgaagtgggca

SEQ ID NO: 3565 - DNA, 51 bp, Artificial Sequence
  Synthetic polynucleotide
atcagcgaccagctgcccaaggtggrgtcggggaacgccaagccgctctac

SEQ ID NO: 3566 - DNA, 51 bp, Artificial Sequence
  Synthetic polynucleotide
ccaggtagaggtatcacacccaactrtgaagatcagcatcctgctcatgtt

SEQ ID NO: 3567 - DNA, 51 bp, Artificial Sequence
  Synthetic polynucleotide
caaggcaaagaggaaagaaattatcrtatcttttataggttgtgtgctggt

SEQ ID NO: 3568 - DNA, 51 bp, Artificial Sequence
  Synthetic polynucleotide
cgccagcaacaagtacggcctggccrcagagggcacacggcatacgctgac

SEQ ID NO: 3569 - DNA, 51 bp, Artificial Sequence
  Synthetic polynucleotide
tggagtatgaacttcaatacaaagargtaaatgaaactaaatggaaaatgg

SEQ ID NO: 3570 - DNA, 51 bp, Artificial Sequence
  Synthetic polynucleotide
atcatgcttggctgcatcttcatgargactgcccaagcccaccgcagggct

SEQ ID NO: 3571 - DNA, 51 bp, Artificial Sequence
  Synthetic polynucleotide
ctggtggccccgctgatcatctaccrtgtcattgatgccaacagcccactc

SEQ ID NO: 3572 - DNA, 51 bp, Artificial Sequence
  Synthetic polynucleotide
gaaaaaaactgcaaattaaatgagayacctttgaattgggagagttaattc

SEQ ID NO: 3573 - DNA, 51 bp, Artificial Sequence
  Synthetic polynucleotide
ggcaaggcattcagccagagctccarcctcatcacccacagccgcaaacac

SEQ ID NO: 3574 - DNA, 51 bp, Artificial Sequence
  Synthetic polynucleotide
cccttcggctgcgacctctgtgggargggtttccagaggaaggtggacctc

SEQ ID NO: 3575 - DNA, 51 bp, Artificial Sequence
  Synthetic polynucleotide
tgccatcaagcttgaatgtgtcaaarccaaacaccctcagctccacattga

SEQ ID NO: 3576 - DNA, 51 bp, Artificial Sequence
  Synthetic polynucleotide
aaacagaaaggacattgctcaggaartgctcatgaaccaaaccaaagccac

SEQ ID NO: 3577 - DNA, 51 bp, Artificial Sequence
  Synthetic polynucleotide
tgaaacaacccatccttatttcaacrgaaagaggacttgccagacccacgc

SEQ ID NO: 3578 - DNA, 51 bp, Artificial Sequence
  Synthetic polynucleotide
tgctatgggcgcagatatggccccaragggatcgggtatggacaaggcgct

SEQ ID NO: 3579 - DNA, 51 bp, Artificial Sequence
  Synthetic polynucleotide
gtgaactatcaagatggcaacctcarcatttcaattccagtgtttagtatt

SEQ ID NO: 3580 - DNA, 51 bp, Artificial Sequence
  Synthetic polynucleotide
ttggaatctcagaatgcacaaaaagraagtgacgcatgtggccctgaaccc

SEQ ID NO: 3581 - DNA, 51 bp, Artificial Sequence
  Synthetic polynucleotide
aaggagacaatcgaagactgttgggrccaggatgcagaggctcggcttact

SEQ ID NO: 3582 - DNA, 51 bp, Artificial Sequence
  Synthetic polynucleotide
acagagaaggcacttccttcggccarccctggaactgaattcggtgagttt

SEQ ID NO: 3583 - DNA, 51 bp, Artificial Sequence
  Synthetic polynucleotide
ctacctcatcatgatcagtgcgctcrtggccctagtgttcatcaagtacct

SEQ ID NO: 3584 - DNA, 51 bp, Artificial Sequence
  Synthetic polynucleotide
ccagacatcatcttcaaggacgaggrgaacacaggcgccgaccgcctcatg

SEQ ID NO: 3585 - DNA, 51 bp, Artificial Sequence
  Synthetic polynucleotide
acttctctctggcttcttttttaggrcgtggagaacagcttcttcttgaat

SEQ ID NO: 3586 - DNA, 51 bp, Artificial Sequence
  Synthetic polynucleotide
gcgaccaatcgggcccaagccaaccraggcagggaaagataagtctaaagc

SEQ ID NO: 3587 - DNA, 51 bp, Artificial Sequence
  Synthetic polynucleotide
tctccccctccaccaggtggtggtartcttggaatgaacagtaggaaacca

SEQ ID NO: 3588 - DNA, 51 bp, Artificial Sequence
  Synthetic polynucleotide
tacctggtcaatgcgtatcccctggrtatgtcccagtattttcggcttttc

SEQ ID NO: 3589 - DNA, 51 bp, Artificial Sequence
  Synthetic polynucleotide
tttttaggaccctggtttgatatgtrcctatctgctcgagactccgttgtt

SEQ ID NO: 3590 - DNA, 51 bp, Artificial Sequence
  Synthetic polynucleotide
tcgccgggcccatgaagcgggagachgtaagcgacaaacgcacagcgtcgg

SEQ ID NO: 3591 - DNA, 51 bp, Artificial Sequence
  Synthetic polynucleotide
aacttcgtgaacttcggcgtcggggrcttgaatgcggttcagagccccggg

SEQ ID NO: 3592 - DNA, 51 bp, Artificial Sequence
  Synthetic polynucleotide
gctgaaactcacgtccacgcaggtcragatctggttccagaaccggcgcta

SEQ ID NO: 3593 - DNA, 51 bp, Artificial Sequence
  Synthetic polynucleotide
gtgcgccgcgcccaggacttcgtgtrccacctgcactgctttgcctgcgtc

SEQ ID NO: 3594 - DNA, 51 bp, Artificial Sequence
  Synthetic polynucleotide
cttgtactttttttcccctttaactrggaattgtggtgcttggaataaaca

SEQ ID NO: 3595 - DNA, 51 bp, Artificial Sequence
  Synthetic polynucleotide
acatatttaatattttgtttttcttrgaccattccaacaaaagacagactt

SEQ ID NO: 3596 - DNA, 51 bp, Artificial Sequence
  Synthetic polynucleotide
atgtgtgtttcacgtaggtggtttgrcaagtcgttcacgtttgttgtcttc

SEQ ID NO: 3597 - DNA, 51 bp, Artificial Sequence
  Synthetic polynucleotide
cggctgctgaagccccgggagatggrgcagcagatgcagaggatcctggac

SEQ ID NO: 3598 - DNA, 51 bp, Artificial Sequence
  Synthetic polynucleotide
tccattgacagcctccagctgggctrtgcggaggatgggcactgcaaaggc

SEQ ID NO: 3599 - DNA, 51 bp, Artificial Sequence
  Synthetic polynucleotide
caccctgcgctcacgcctctccatcrtcctgcaggaccccgtcctcttcag

SEQ ID NO: 3600 - DNA, 51 bp, Artificial Sequence
  Synthetic polynucleotide
acatggcttcatttccctgggcacarcctgcggtggatcctgaccttcatg

SEQ ID NO: 3601 - DNA, 51 bp, Artificial Sequence
  Synthetic polynucleotide
tctcagaaagaacttgccatcatccrtggacctcctggcactgggaaaacc

SEQ ID NO: 3602 - DNA, 51 bp, Artificial Sequence
  Synthetic polynucleotide
gaagcacgtgcaggtcctggccaacragcgcatcaacgccatggcagagga

SEQ ID NO: 3603 - DNA, 51 bp, Artificial Sequence
  Synthetic polynucleotide
tcccgggacgtgtacagcactgactrctacagggtgagtagctgtgcagat

SEQ ID NO: 3604 - DNA, 51 bp, Artificial Sequence
  Synthetic polynucleotide
tcagaagcatttttctccctctttcrggctgttatcaaagaacagcttcaa

SEQ ID NO: 3605 - DNA, 51 bp, Artificial Sequence
  Synthetic polynucleotide
aagctccgctggtacttcaagctctrtgatgtagatggcaacggctgcatt

SEQ ID NO: 3606 - DNA, 51 bp, Artificial Sequence
  Synthetic polynucleotide
ttaatttcatggtacatgagtggctrtcatactggctattatatggtaagt

SEQ ID NO: 3607 - DNA, 51 bp, Artificial Sequence
  Synthetic polynucleotide
tcttgatgatgctgatgctttgggargtatgttaatttcatggtacatgag

SEQ ID NO: 3608 - DNA, 51 bp, Artificial Sequence
  Synthetic polynucleotide
cgggacaactgtcccacggtgcctarcagtgcccaggaggactcagaccac

SEQ ID NO: 3609 - DNA, 51 bp, Artificial Sequence
  Synthetic polynucleotide
ggtgatgcctgcgacgacgacgacgrcaatgacggagtccctgacagtcgg

SEQ ID NO: 3610 - DNA, 51 bp, Artificial Sequence
  Synthetic polynucleotide
gatattgtagaccgagcaaaaatggragataccctgaagaggaggtttttc

SEQ ID NO: 3611 - DNA, 51 bp, Artificial Sequence
  Synthetic polynucleotide
ggcatagataccaccaatgcctgctrcggtggtactgcctccctcttcaat

SEQ ID NO: 3612 - DNA, 51 bp, Artificial Sequence
  Synthetic polynucleotide
cgaggtgtacagaaaatgaacagcaraactgtgaccagcacaatgttgggt

SEQ ID NO: 3613 - DNA, 51 bp, Artificial Sequence
  Synthetic polynucleotide
atctgcaggcaagagtttcaccttgrccataaccgtcttcacaaatcctcc

SEQ ID NO: 3614 - DNA, 51 bp, Artificial Sequence
  Synthetic polynucleotide
agagcgtgagcagatcaaaactctcdacaacaaatttgcctccttcattga

SEQ ID NO: 3615 - DNA, 51 bp, Artificial Sequence
  Synthetic polynucleotide
gatgccagcacccaagtcctgctgtrcaggattcggtaggaagtgcccccc

SEQ ID NO: 3616 - DNA, 51 bp, Artificial Sequence
  Synthetic polynucleotide
ctctgtccacttgaggtggtggtcartgccctggtgggcgccatcccgtcc

SEQ ID NO: 3617 - DNA, 51 bp, Artificial Sequence
  Synthetic polynucleotide
agtgaggacgacttcgatatgttctrtgagatctgggagaaatttgaccca

SEQ ID NO: 3618 - DNA, 51 bp, Artificial Sequence
  Synthetic polynucleotide
aaggactttctgcacaaggaccgggrtgacgtcaatgtggagatcgttttt

SEQ ID NO: 3619 - DNA, 51 bp, Artificial Sequence
  Synthetic polynucleotide
tataatcgcaagacatcccgagtctrtaagttttgcagtaagcttgcagag

SEQ ID NO: 3620 - DNA, 51 bp, Artificial Sequence
  Synthetic polynucleotide
ggccccctgctgccataccaagccgrgttcctggtgcgcagccacgatgcg

SEQ ID NO: 3621 - DNA, 51 bp, Artificial Sequence
  Synthetic polynucleotide
ggagaaaaagaagaaaatgttaaaargaacagatacaaggacatactgcca

SEQ ID NO: 3622 - DNA, 51 bp, Artificial Sequence
  Synthetic polynucleotide
ggggagctgtctgaggactccagcartgtggtccaactcattaagaatgct

SEQ ID NO: 3623 - DNA, 51 bp, Artificial Sequence
  Synthetic polynucleotide
gtctgggggggcttcgcctacttgcrggatgtggtggagcaggcaatcatc

SEQ ID NO: 3624 - DNA, 51 bp, Artificial Sequence
  Synthetic polynucleotide
cagatcacctccttcctgggccacartggagcggggaagacgaccaccatg

SEQ ID NO: 3625 - DNA, 51 bp, Artificial Sequence
  Synthetic polynucleotide
ctcggagctggtaaaaagaggcctarcccctgtctttagatttacagtcca

SEQ ID NO: 3626 - DNA, 51 bp, Artificial Sequence
  Synthetic polynucleotide
aagaacccgtatacataaaatctagvcaaaaaaggaaggaatcgaaccccc

SEQ ID NO: 3627 - DNA, 51 bp, Artificial Sequence
  Synthetic polynucleotide
accttttaagttaaagattaagagarccaacacctctttacagtgaaatgc

SEQ ID NO: 3628 - DNA, 51 bp, Artificial Sequence
  Synthetic polynucleotide
accccctctaccccctctagagcccrctgtaaagctaacttagcattaacc

SEQ ID NO: 3629 - DNA, 51 bp, Artificial Sequence
  Synthetic polynucleotide
tcttaggccccaaaaattttggtgcractccaaataaaagtaataaccatg

SEQ ID NO: 3630 - DNA, 51 bp, Artificial Sequence
  Synthetic polynucleotide
agaacagggtttgttaagatggcagrgcccggtaatcgcataaaacttaaa

SEQ ID NO: 3631 - DNA, 51 bp, Artificial Sequence
  Synthetic polynucleotide
tttgttaagatggcagagcccggtartcgcataaaacttaaaactttacag

SEQ ID NO: 3632 - DNA, 51 bp, Artificial Sequence
  Synthetic polynucleotide
gtttgttaagatggcagagcccggtratcgcataaaacttaaaactttaca

SEQ ID NO: 3633 - DNA, 51 bp, Artificial Sequence
  Synthetic polynucleotide
gatggcagagcccggtaatcgcataraacttaaaactttacagtcagaggt

SEQ ID NO: 3634 - DNA, 51 bp, Artificial Sequence
  Synthetic polynucleotide
gtaatcgcataaaacttaaaactttrcagtcagaggttcaattcctcttct

SEQ ID NO: 3635 - DNA, 51 bp, Artificial Sequence
  Synthetic polynucleotide
gatagagtaaataataggagcttaarcccccttatttctaggactatgaga

SEQ ID NO: 3636 - DNA, 51 bp, Artificial Sequence
  Synthetic polynucleotide
gcattccccctcaaacctaagaaatrtgtctgataaaagagttactttgat

SEQ ID NO: 3637 - DNA, 51 bp, Artificial Sequence
  Synthetic polynucleotide
tgtctgataaaagagttactttgatrgagtaaataataggagcttaaaccc

SEQ ID NO: 3638 - DNA, 51 bp, Artificial Sequence
  Synthetic polynucleotide
gataaaagagttactttgatagagtraataataggagcttaaaccccctta

SEQ ID NO: 3639 - DNA, 51 bp, Artificial Sequence
  Synthetic polynucleotide
cttccaattaactagttttgacaacrttcaaaaaagagtaataaacttcgc

SEQ ID NO: 3640 - DNA, 51 bp, Artificial Sequence
  Synthetic polynucleotide
tccatgactttttcaaaaaggtattrgaaaaaccatttcataactttgtca

SEQ ID NO: 3641 - DNA, 51 bp, Artificial Sequence
  Synthetic polynucleotide
agtttaaacaaaacgaatgatttcgrctcattaaattatgataatcatatt

SEQ ID NO: 3642 - DNA, 51 bp, Artificial Sequence
  Synthetic polynucleotide
acccctacgcatttatatagaggagrcaagtcgtaacatggtaagtgtact

SEQ ID NO: 3643 - DNA, 51 bp, Artificial Sequence
  Synthetic polynucleotide
  misc_feature (26)..(26): n is a, c, g, t or u
cacccccacgggaaacagcagtgatnarcctttagcaataaacgaaagttt

SEQ ID NO: 3644 - DNA, 51 bp, Artificial Sequence
  Synthetic polynucleotide
cccgaatgatatttcctattcgcctrcacaattctccgatccgtccctaac

SEQ ID NO: 3645 - DNA, 51 bp, Artificial Sequence
  Synthetic polynucleotide
tccaaagacaaccatcattccccctraataaattaaaaaaactattaaacc

SEQ ID NO: 3646 - DNA, 51 bp, Artificial Sequence
  Synthetic polynucleotide
ctattccaactgttcatcggctgagrgggcgtaggaattatatccttcttg

SEQ ID NO: 3647 - DNA, 51 bp, Artificial Sequence
  Synthetic polynucleotide
ctccctacaaatctccttaattatarcattcacagccacagaactaatcat

SEQ ID NO: 3648 - DNA, 51 bp, Artificial Sequence
  Synthetic polynucleotide
taccgaacgaaaaattctaggctatrtacaactacgcaaaggccccaacgt

SEQ ID NO: 3649 - DNA, 51 bp, Artificial Sequence
  Synthetic polynucleotide
ctgttcttatgaattcgaacagcatrcccccgattccgctacgaccaactc

SEQ ID NO: 3650 - DNA, 51 bp, Artificial Sequence
  Synthetic polynucleotide
  misc_feature (26)..(26): n is a, c, g, t or u
ccgtttactcaatcctctgatcaggntgagcatcaaactcaaactacgccc

SEQ ID NO: 3651 - DNA, 51 bp, Artificial Sequence
  Synthetic polynucleotide
aataagtggctcctttaacctctccdcccttatcacaacacaagaacacct

SEQ ID NO: 3652 - DNA, 51 bp, Artificial Sequence
  Synthetic polynucleotide
  misc_feature (26)..(26): n is a, c, g, t or u
acccccttgaccttgccgaaggggantccgaactagtctcaggcttcaaca

SEQ ID NO: 3653 - DNA, 51 bp, Artificial Sequence
  Synthetic polynucleotide
  misc_feature (26)..(26): n is a, c, g, t or u
cgaatacgccgcaggccccttcgccntattcttcatagccgaatacacaaa

SEQ ID NO: 3654 - DNA, 51 bp, Artificial Sequence
  Synthetic polynucleotide
  misc_feature (26)..(26): n is a, c, g, t or u
attttgtcaccaagaccctacttctnacctccctgttcttatgaattcgaa

SEQ ID NO: 3655 - DNA, 51 bp, Artificial Sequence
  Synthetic polynucleotide
aatgaatccacatatccgggtgacargccaccagaaccgtgtgggtcctga

SEQ ID NO: 3656 - DNA, 51 bp, Artificial Sequence
  Synthetic polynucleotide
gatcaaaaggatttgcccactgggcytaaaatacaaagaaaagagaggtgt

SEQ ID NO: 3657 - DNA, 51 bp, Artificial Sequence
  Synthetic polynucleotide
accaatgtcaactccaggatgctctrcttcgcccctgatctggttttcaat

SEQ ID NO: 3658 - DNA, 51 bp, Artificial Sequence
  Synthetic polynucleotide
ccggatgtacagccagtgtgtccgartgaggcacctctctcaagagtttgg

SEQ ID NO: 3659 - DNA, 51 bp, Artificial Sequence
  Synthetic polynucleotide
gattgcgagagagctgcatcagttcrcttttgacctgctaatcaagtcaca

SEQ ID NO: 3660 - DNA, 51 bp, Artificial Sequence
  Synthetic polynucleotide
atgatggcagagatcatctctgtgcragtgcccaagatcctttctgggaaa

SEQ ID NO: 3661 - DNA, 51 bp, Artificial Sequence
  Synthetic polynucleotide
ccaatctcagccaagcttgttgcaartatgctatctgtagcaggtgcagat

SEQ ID NO: 3662 - DNA, 51 bp, Artificial Sequence
  Synthetic polynucleotide
cttgactataatgaatacttcagggrtttgaatgtaagtaattgcttcttt

SEQ ID NO: 3663 - DNA, 51 bp, Artificial Sequence
  Synthetic polynucleotide
tgtaggactgaacgtcttgctcgagrtgtgatgaaggagatgggaggccat

SEQ ID NO: 3664 - DNA, 51 bp, Artificial Sequence
  Synthetic polynucleotide
cctgaagtgcactcaatattcctcgraggtcacacatttcttgtgaggaac

SEQ ID NO: 3665 - DNA, 51 bp, Artificial Sequence
  Synthetic polynucleotide
gctgcagtggagaggctctgggattrtgggatgagtagctccccacatgtt

SEQ ID NO: 3666 - DNA, 51 bp, Artificial Sequence
  Synthetic polynucleotide
ttctctgtgtccttctccagcaatcratggctacataatggatacactacc

SEQ ID NO: 3667 - DNA, 51 bp, Artificial Sequence
  Synthetic polynucleotide
tacagtggtcattacacttaagaacrtggcttcccatcctgtcagtcttca

SEQ ID NO: 3668 - DNA, 51 bp, Artificial Sequence
  Synthetic polynucleotide
tttcttcctgctataggagctgaatrtgatgatcagaccagtcaaagggag

SEQ ID NO: 3669 - DNA, 51 bp, Artificial Sequence
  Synthetic polynucleotide
cctgctataggagctgaatatgatgrtcagaccagtcaaagggagaaagaa

SEQ ID NO: 3670 - DNA, 51 bp, Artificial Sequence
  Synthetic polynucleotide
ggaaatctcgccaataactttccttrctgctcaaacactcttgatggacct

SEQ ID NO: 3671 - DNA, 51 bp, Artificial Sequence
  Synthetic polynucleotide
tgggtacattacattgctgctgaagrggaggactgggactatgctccctta

SEQ ID NO: 3672 - DNA, 51 bp, Artificial Sequence
  Synthetic polynucleotide
cagcggattggtaggaagtacaaaaragtccgatttatggcatacacagat

SEQ ID NO: 3673 - DNA, 51 bp, Artificial Sequence
  Synthetic polynucleotide
tcaggaatcttgggacctttactttrtggggaagttggagacacactgttg

SEQ ID NO: 3674 - DNA, 51 bp, Artificial Sequence
  Synthetic polynucleotide
tcggtgcctgacccgctattactctrgtttcgttaatatggagagagatct

SEQ ID NO: 3675 - DNA, 51 bp, Artificial Sequence
  Synthetic polynucleotide
tctagtttcgttaatatggagagagrtctagcttcaggactcattggccct

SEQ ID NO: 3676 - DNA, 51 bp, Artificial Sequence
  Synthetic polynucleotide
gaggatccagagttccaagcctccarcatcatgcacagtgagtaaagcagc

SEQ ID NO: 3677 - DNA, 51 bp, Artificial Sequence
  Synthetic polynucleotide
ttccctccctaggaaaaagatgtgcrctcaggcctgattggaccccttctg

SEQ ID NO: 3678 - DNA, 51 bp, Artificial Sequence
  Synthetic polynucleotide
tctctgtgtccttctccagcaatcartggctacataatggatacactacct

SEQ ID NO: 3679 - DNA, 51 bp, Artificial Sequence
  Synthetic polynucleotide
agcacactttttctggtgtacagcartagtgagtagcaatgtgggcagagg

SEQ ID NO: 3680 - DNA, 51 bp, Artificial Sequence
  Synthetic polynucleotide
aagtgttattttaattggtaggtggrtctgttggcaccaatgattattcac

SEQ ID NO: 3681 - DNA, 51 bp, Artificial Sequence
  Synthetic polynucleotide
tacatctctcagtttatcatcatgtrtagtcttgatgggaagaagtggcag

SEQ ID NO: 3682 - DNA, 51 bp, Artificial Sequence
  Synthetic polynucleotide
atgaaagtcacaggagtaactactcrgggagtaaaatctctgcttaccagc

SEQ ID NO: 3683 - DNA, 51 bp, Artificial Sequence
  Synthetic polynucleotide
ggtgcagtggaactgtcatgggactrtatgcaaagtgatctcggtgagctg

SEQ ID NO: 3684 - DNA, 51 bp, Artificial Sequence
  Synthetic polynucleotide
caactcctatgtggctggccagtacratgatgcagcctcctaccagcgcct

SEQ ID NO: 3685 - DNA, 51 bp, Artificial Sequence
  Synthetic polynucleotide
gctccgggctcccagcagaggctggraccgcatcatcgtggagaagccctt

SEQ ID NO: 3686 - DNA, 51 bp, Artificial Sequence
  Synthetic polynucleotide
acagccactccactgtggcggagggrcaggacaggccactacctatgcaac

SEQ ID NO: 3687 - DNA, 51 bp, Artificial Sequence
  Synthetic polynucleotide
cagcctggctgcaacagcgtttgctrtgaccaattcttccccatctcccat

SEQ ID NO: 3688 - DNA, 51 bp, Artificial Sequence
  Synthetic polynucleotide
gcctctggcatctgcatcatcctcartgtggccgaggtggtgtacctcatc

SEQ ID NO: 3689 - DNA, 51 bp, Artificial Sequence
  Synthetic polynucleotide
ccgtcctgtacactttgagctcatgrgtgagtgggaacgttcctacttcgg

SEQ ID NO: 3690 - DNA, 51 bp, Artificial Sequence
  Synthetic polynucleotide
ggctatgtgaccatgtcggtgggaaragtctttcaccctggtactgctcca

SEQ ID NO: 3691 - DNA, 51 bp, Artificial Sequence
  Synthetic polynucleotide
tatggatgctgtcgcttccttcgagrtggttataaaactccaagagaggtt

SEQ ID NO: 3692 - DNA, 51 bp, Artificial Sequence
  Synthetic polynucleotide
ttatggaatgtgggagcgtggagatragactaatcagggcatcccggaatt

SEQ ID NO: 3693 - DNA, 51 bp, Artificial Sequence
  Synthetic polynucleotide
cgctccgatcatgagtttctcttccrttactgcaacgcctacttaaatgct

SEQ ID NO: 3694 - DNA, 51 bp, Artificial Sequence
  Synthetic polynucleotide
ttcaatttcttaacctatctcaaagrtggagatcagtgtgagtccaatcca

SEQ ID NO: 3695 - DNA, 51 bp, Artificial Sequence
  Synthetic polynucleotide
tgtttaaatggcggcagttgcaaggrtgacattaattcctatgaatgttgg

SEQ ID NO: 3696 - DNA, 51 bp, Artificial Sequence
  Synthetic polynucleotide
cgaattattcctcaccacaactacartgcagctattaataagtacaaccat

SEQ ID NO: 3697 - DNA, 51 bp, Artificial Sequence
  Synthetic polynucleotide
tacaaagttcaccatctataacaacrtgttctgtgctggcttccatgaagg

SEQ ID NO: 3698 - DNA, 51 bp, Artificial Sequence
  Synthetic polynucleotide
aggtagagattcatgtcaaggagatrgtgggggaccccatgttactgaagt

SEQ ID NO: 3699 - DNA, 51 bp, Artificial Sequence
  Synthetic polynucleotide
cctcgacgctgcatgaggcaccactrtgtggattctatcagtcacccattg

SEQ ID NO: 3700 - DNA, 51 bp, Artificial Sequence
  Synthetic polynucleotide
tctagagaagtttttccttacaacartgagaaaacatgtactagctgcatc

SEQ ID NO: 3701 - DNA, 51 bp, Artificial Sequence
  Synthetic polynucleotide
tcggaccctcgacgctgcatgaggcrccactatgtggattctatcagtcac

SEQ ID NO: 3702 - DNA, 51 bp, Artificial Sequence
  Synthetic polynucleotide
ggctatcatggctgctcctttattcrtgtctaatgacctccgacacatcag

SEQ ID NO: 3703 - DNA, 51 bp, Artificial Sequence
  Synthetic polynucleotide
atccctggggctagagcactggacartggattggcaaggacgcctaccatg

SEQ ID NO: 3704 - DNA, 51 bp, Artificial Sequence
  Synthetic polynucleotide
gagtcatatctgttttcacagcccarttatacagaaatccgacagtactgc

SEQ ID NO: 3705 - DNA, 51 bp, Artificial Sequence
  Synthetic polynucleotide
aaggttaagaagtcacataaatcccrcaggcactgttttgcttcagctaga

SEQ ID NO: 3706 - DNA, 51 bp, Artificial Sequence
  Synthetic polynucleotide
tctttttctcagttagtgattggcarctttggcctcagctggaatcagcaa

SEQ ID NO: 3707 - DNA, 51 bp, Artificial Sequence
  Synthetic polynucleotide
agaagataaagagaaaaaagaaacaraagagaaatctcatttatccacctc

SEQ ID NO: 3708 - DNA, 51 bp, Artificial Sequence
  Synthetic polynucleotide
gcagaaactggcccccttcctcaagrtgtatggtgagtatgtgaagaactt

SEQ ID NO: 3709 - DNA, 51 bp, Artificial Sequence
  Synthetic polynucleotide
gcggagccctggggccgtcgcacctrtgtcacctggattgccctgatggtg

SEQ ID NO: 3710 - DNA, 51 bp, Artificial Sequence
  Synthetic polynucleotide
atgacgctagtgattgtggtcgtctrtgtgctgtgctgggcacccttcttc

SEQ ID NO: 3711 - DNA, 51 bp, Artificial Sequence
  Synthetic polynucleotide
atcaagttcatccccacttataagtrtgactctaaaacagaccggtgggat

SEQ ID NO: 3712 - DNA, 51 bp, Artificial Sequence
  Synthetic polynucleotide
caactggacaggaatctcacctttcrtaaaatggtggcatggatgattgca

SEQ ID NO: 3713 - DNA, 51 bp, Artificial Sequence
  Synthetic polynucleotide
gctgtgcaccatgatgaggagaaagrtgtgatcacaggcctgaaacaaaag

SEQ ID NO: 3714 - DNA, 51 bp, Artificial Sequence
  Synthetic polynucleotide
tggaacaggatgtttcttactatgtratacaggccataaggttggtttttt

SEQ ID NO: 3715 - DNA, 51 bp, Artificial Sequence
  Synthetic polynucleotide
cggccccacagcgggctcccttactrctggaatgcagacacagaccttgta

SEQ ID NO: 3716 - DNA, 51 bp, Artificial Sequence
  Synthetic polynucleotide
ctgaacctgattgtactttgtttgcrgtcccatcccccagaggatgaagat

SEQ ID NO: 3717 - DNA, 51 bp, Artificial Sequence
  Synthetic polynucleotide
caccattggagaataacttttattartaagtgctatgagctctgtgacact

SEQ ID NO: 3718 - DNA, 51 bp, Artificial Sequence
  Synthetic polynucleotide
gccatgctgatgttggatagcttctrtaggagcattgaagggttcgaaata

SEQ ID NO: 3719 - DNA, 51 bp, Artificial Sequence
  Synthetic polynucleotide
taattaaaacaaattatcttcatcartttattcagcgaataggtcatggtg

SEQ ID NO: 3720 - DNA, 51 bp, Artificial Sequence
  Synthetic polynucleotide
aggaaaactgcatatatttaatgccragaaggcagctgcccattataagtg

SEQ ID NO: 3721 - DNA, 51 bp, Artificial Sequence
  Synthetic polynucleotide
gaaaatgaagcacgaggaaaactgcrtatatttaatgccaagaaggcagct

SEQ ID NO: 3722 - DNA, 51 bp, Artificial Sequence
  Synthetic polynucleotide
cacagtccagctcacaacaacatcargagcagaatttggagactttgatat

SEQ ID NO: 3723 - DNA, 51 bp, Artificial Sequence
  Synthetic polynucleotide
gcctccgcctgagcccgcacccgccrtggacaactacgcagatctttcgga

SEQ ID NO: 3724 - DNA, 51 bp, Artificial Sequence
  Synthetic polynucleotide
ggccatagagcgagaaaaagctgagragttcagaaaactgcaagatgccag

SEQ ID NO: 3725 - DNA, 51 bp, Artificial Sequence
  Synthetic polynucleotide
tctacgaaagcaggctgaggaggtcratactgagtgggaaaaattgaacct

SEQ ID NO: 3726 - DNA, 51 bp, Artificial Sequence
  Synthetic polynucleotide
actgagtgggaaaaattgaacctgcrctccgctgactggcagagaaaaata

SEQ ID NO: 3727 - DNA, 51 bp, Artificial Sequence
  Synthetic polynucleotide
tcccccaaacccttctctgcagatcrcggtcagtctagcacagggatatga

SEQ ID NO: 3728 - DNA, 51 bp, Artificial Sequence
  Synthetic polynucleotide
tcgatcgcacttcagttatgataaaytgaccttgttatgtgatcaataatc

SEQ ID NO: 3729 - DNA, 51 bp, Artificial Sequence
  Synthetic polynucleotide
atcgccctccctgctaccttcgtcarcagtgccatccgttacctggagggc

SEQ ID NO: 3730 - DNA, 51 bp, Artificial Sequence
  Synthetic polynucleotide
tttgatttctttttttttcattggcrgatcatgatcaggagcatttttttg

SEQ ID NO: 3731 - DNA, 51 bp, Artificial Sequence
  Synthetic polynucleotide
gagaggccagtacgacgtggccatcragatgatcaaagaaggctccatgtc

SEQ ID NO: 3732 - DNA, 51 bp, Artificial Sequence
  Synthetic polynucleotide
agcaccatccctgagctcattaactrccatcagcacaactctgcaggtgag

SEQ ID NO: 3733 - DNA, 51 bp, Artificial Sequence
  Synthetic polynucleotide
ggggaaagaaggaggtttcattgtcrgagactccagcaaagctggcaaata

SEQ ID NO: 3734 - DNA, 51 bp, Artificial Sequence
  Synthetic polynucleotide
caccttctaggggttttgatgtgggraatttactccctggggaagatgcca

SEQ ID NO: 3735 - DNA, 51 bp, Artificial Sequence
  Synthetic polynucleotide
ctacacgcacccgagctccctgcgcraacacatgaaggtaattacctcttt

SEQ ID NO: 3736 - DNA, 51 bp, Artificial Sequence
  Synthetic polynucleotide
gccatcatcgagaacccattcctcartggagaggtcatccggctggatggg

SEQ ID NO: 3737 - DNA, 51 bp, Artificial Sequence
  Synthetic polynucleotide
caagtgccagtatcaggcccctgatrtggacaccctgcagatacatgtcat

SEQ ID NO: 3738 - DNA, 51 bp, Artificial Sequence
  Synthetic polynucleotide
atacatgtcatggagtgcattgagtrgggccggccagtgcaaggccactgc

SEQ ID NO: 3739 - DNA, 51 bp, Artificial Sequence
  Synthetic polynucleotide
ttggacattgccttcttgttactctrtttcaatgatactcataaaagcatt

SEQ ID NO: 3740 - DNA, 51 bp, Artificial Sequence
  Synthetic polynucleotide
aaggtgaagaacaccatctactgcarcgtggagccatcggaatcaaatatg

SEQ ID NO: 3741 - DNA, 51 bp, Artificial Sequence
  Synthetic polynucleotide
ggcaagaaaaagaagcagtacaaagrtaaatatttggcaaagcacaatgca

SEQ ID NO: 3742 - DNA, 51 bp, Artificial Sequence
  Synthetic polynucleotide
acttcgggtggagaagacagggcacrgtggtactctggatcccaaggtgac

SEQ ID NO: 3743 - DNA, 51 bp, Artificial Sequence
  Synthetic polynucleotide
attaatgaccacagcggtcatctctrcctgcgaccatggtatagtagccaa

SEQ ID NO: 3744 - DNA, 51 bp, Artificial Sequence
  Synthetic polynucleotide
gttctgtaatcgaagacaaaaagagraaagaatgactccgccaggggatca

SEQ ID NO: 3745 - DNA, 51 bp, Artificial Sequence
  Synthetic polynucleotide
gggcggtgtgtgccgcacacgcaccrtgaagatcatcatgaaggttgggca

SEQ ID NO: 3746 - DNA, 51 bp, Artificial Sequence
  Synthetic polynucleotide
ttcttataggtggtaagttttcttcrtacagttcttttgtgtgacaaactg

SEQ ID NO: 3747 - DNA, 51 bp, Artificial Sequence
  Synthetic polynucleotide
ttcttttgatcaggtgtgggcaatavtagtgaaggtggaagaggaaaggca

SEQ ID NO: 3748 - DNA, 51 bp, Artificial Sequence
  Synthetic polynucleotide
ggacaaactaagcctgtttatgtatrtaggttcttagctcaggtaggttta

SEQ ID NO: 3749 - DNA, 51 bp, Artificial Sequence
  Synthetic polynucleotide
agaagaagagttgactgaagaagaargaaaagcagcttgggctgagtatga

SEQ ID NO: 3750 - DNA, 51 bp, Artificial Sequence
  Synthetic polynucleotide
gtagcaatggtgggagatggaatcartgactccccagctctggcaatggct

SEQ ID NO: 3751 - DNA, 51 bp, Artificial Sequence
  Synthetic polynucleotide
ggaaaagcctttcgctctaaagtggrgttgattgcgtacttcgaaaaggta

SEQ ID NO: 3752 - DNA, 51 bp, Artificial Sequence
  Synthetic polynucleotide
catagacctggggaatggtcagaccrggaagtttctgctggacggggatga

SEQ ID NO: 3753 - DNA, 51 bp, Artificial Sequence
  Synthetic polynucleotide
ccctttgctgtgcccaacccgaagcrggtaagcacattctctgcaggaagc

SEQ ID NO: 3754 - DNA, 51 bp, Artificial Sequence
  Synthetic polynucleotide
gctgccccctttgatgatgatgacargatcgttgggggctacaactgtgag

SEQ ID NO: 3755 - DNA, 51 bp, Artificial Sequence
  Synthetic polynucleotide
cacttctgtggtggctccctcatcarcgaacagtgggtggtatcagcaggc

SEQ ID NO: 3756 - DNA, 51 bp, Artificial Sequence
  Synthetic polynucleotide
aaccaatcaaattccaatgcttattrgaaggaaagaaacaaaggattatgg

SEQ ID NO: 3757 - DNA, 51 bp, Artificial Sequence
  Synthetic polynucleotide
atgaatgtgagctggtcagctgatcrcagagttattgatggtgctacaatg

SEQ ID NO: 3758 - DNA, 51 bp, Artificial Sequence
  Synthetic polynucleotide
ttggttgtagacagtctgcattgagraaaatgaaacacttggtggaacatg

SEQ ID NO: 3759 - DNA, 51 bp, Artificial Sequence
  Synthetic polynucleotide
cttgcagaccttatcagaagcttttrgagaagcaaatcttgctgcgtcatt

SEQ ID NO: 3760 - DNA, 51 bp, Artificial Sequence
  Synthetic polynucleotide
cattggtgatgtagttgctggtccartgctggctcacaaagcagaggatga

SEQ ID NO: 3761 - DNA, 51 bp, Artificial Sequence
  Synthetic polynucleotide
cgcaggacaccgctctatgacttccrcctggcccacggcgggaaaatggtg

SEQ ID NO: 3762 - DNA, 51 bp, Artificial Sequence
  Synthetic polynucleotide
ggctcaacctcgtctttaagtggtargaaccatatagagaggagatcagca

SEQ ID NO: 3763 - DNA, 51 bp, Artificial Sequence
  Synthetic polynucleotide
cagcatttggatctgttttaggcctrtggaggtgcctatgatgtcatgagc

SEQ ID NO: 3764 - DNA, 51 bp, Artificial Sequence
  Synthetic polynucleotide
ccagatgtgctcaagtctcgattccrgactggtgagtggaaggtagtgggg

SEQ ID NO: 3765 - DNA, 51 bp, Artificial Sequence
  Synthetic polynucleotide
tctgctcgtgtttgactatgaaggargcggttccgaagctgctagtctgag

SEQ ID NO: 3766 - DNA, 51 bp, Artificial Sequence
  Synthetic polynucleotide
gtcgatctctctgcagagtttccctdcgtataccctggtggttcaagctgc

SEQ ID NO: 3767 - DNA, 51 bp, Artificial Sequence
  Synthetic polynucleotide
tgccacgccctggccacatgtgtcartgtggtgggcagctacttgtgcgta

SEQ ID NO: 3768 - DNA, 51 bp, Artificial Sequence
  Synthetic polynucleotide
gctgatgctttgggcaaaatccctcrgacagtaagaagattctataccatg

SEQ ID NO: 3769 - DNA, 51 bp, Artificial Sequence
  Synthetic polynucleotide
tgacatcctccctattttgcatctcrggtcacccgatgacccgtgccttta

SEQ ID NO: 3770 - DNA, 51 bp, Artificial Sequence
  Synthetic polynucleotide
acgatacttgttaagtggctaccccraaacgatctgcttggtatgttgggc

SEQ ID NO: 3771 - DNA, 51 bp, Artificial Sequence
  Synthetic polynucleotide
gcccttgtttggtgatcagatggacvatgcaaagcgcatggagactaaggg

SEQ ID NO: 3772 - DNA, 51 bp, Artificial Sequence
  Synthetic polynucleotide
tctctccccgcaggaatcctgtactrtgtctacatggggctgctggcagtg

SEQ ID NO: 3773 - DNA, 51 bp, Artificial Sequence
  Synthetic polynucleotide
cccacccacgtcaacaacggcaactrcacgctgctggctgccaaccccttc

SEQ ID NO: 3774 - DNA, 51 bp, Artificial Sequence
  Synthetic polynucleotide
ctgcaccgagggccgccccctgctcrtggtctttgagtatatgcggcacgg

SEQ ID NO: 3775 - DNA, 51 bp, Artificial Sequence
  Synthetic polynucleotide
ctccaggaaaaccgggaggtgggagrctggcgcaagaacatcgatgcactg

SEQ ID NO: 3776 - DNA, 51 bp, Artificial Sequence
  Synthetic polynucleotide
gcgggcccacctcaagcaggtgaagraggaggacaccgagaaggtgagtgt

SEQ ID NO: 3777 - DNA, 51 bp, Artificial Sequence
  Synthetic polynucleotide
attgagagcgacctggaacgtgcagdggagcgggctgagctctcagaaggg

SEQ ID NO: 3778 - DNA, 51 bp, Artificial Sequence
  Synthetic polynucleotide
cctggcctatgagcctgtgtgggccrttggtactggcaagactgcaacacc

SEQ ID NO: 3779 - DNA, 51 bp, Artificial Sequence
  Synthetic polynucleotide
aatggcctggtctacatgaagtacgrcacgcctttcatttttgctgaggtg

SEQ ID NO: 3780 - DNA, 51 bp, Artificial Sequence
  Synthetic polynucleotide
ccctgtgtttgctggctttcttcacrgaagtaaaagattatgagcctccat

SEQ ID NO: 3781 - DNA, 51 bp, Artificial Sequence
  Synthetic polynucleotide
gctataggtgggaactgcaagatacrtggctccagaagtcctagaatccag

SEQ ID NO: 3782 - DNA, 51 bp, Artificial Sequence
  Synthetic polynucleotide
cattttgaatccttcaaacgtgctgrcatctatgcaatgggcttagtattc

SEQ ID NO: 3783 - DNA, 51 bp, Artificial Sequence
  Synthetic polynucleotide
ctgccatgccagccgcttcctgcacrtgaaggtggaatgccccacagaact

SEQ ID NO: 3784 - DNA, 51 bp, Artificial Sequence
  Synthetic polynucleotide
ccatgccagccgcttcctgcacatgraggtggaatgccccacagaactctt

SEQ ID NO: 3785 - DNA, 51 bp, Artificial Sequence
  Synthetic polynucleotide
aaccttgaatggggaaatggcagtgrcacggggccagctgaaaaatggggg

SEQ ID NO: 3786 - DNA, 51 bp, Artificial Sequence
  Synthetic polynucleotide
aggcctgctgaaaatgactgaatatraacttgtggtagttggagctggtgg

SEQ ID NO: 3787 - DNA, 51 bp, Artificial Sequence
  Synthetic polynucleotide
gtgcccatggtgctggtggggaacargtgtgacctggctgcacgcactgtg

SEQ ID NO: 3788 - DNA, 51 bp, Artificial Sequence
  Synthetic polynucleotide
gacctgctgtttaaggactctgcccrcgggtttttaaaagtcccccccagg

SEQ ID NO: 3789 - DNA, 51 bp, Artificial Sequence
  Synthetic polynucleotide
cttttgtttgttccggtcggaaaccraggaccttctgttcagagatgacac

SEQ ID NO: 3790 - DNA, 51 bp, Artificial Sequence
  Synthetic polynucleotide
atgagttcttcattattttagaggtraagaactcagaatttaatacttgaa

SEQ ID NO: 3791 - DNA, 51 bp, Artificial Sequence
  Synthetic polynucleotide
gtgtgtttttttctcgcagagaaccrtggagtctggcagtaccgccgccag

SEQ ID NO: 3792 - DNA, 51 bp, Artificial Sequence
  Synthetic polynucleotide
gcctgcatccggcagaagggcggctrctgcagctggtaccgaggatgggcc

SEQ ID NO: 3793 - DNA, 51 bp, Artificial Sequence
  Synthetic polynucleotide
  misc_feature (26)..(26): n is a, c, g, t or u
gattacaggtgtgagccaccgcaccnagccaattttgagtatttttaaaag

SEQ ID NO: 3794 - DNA, 51 bp, Artificial Sequence
  Synthetic polynucleotide
taacatgttactctttcttgtttcargtaaaatatgcaatatacrtygtct

SEQ ID NO: 3795 - DNA, 51 bp, Artificial Sequence
  Synthetic polynucleotide
aggttgatgcttttgaagaacgacakaaaagttggggaattgactgtcttt

SEQ ID NO: 3796 - DNA, 51 bp, Artificial Sequence
  Synthetic polynucleotide
tctaccttgacagacctccagccgtrcatgcgacagttcgtggctcacctg

SEQ ID NO: 3797 - DNA, 51 bp, Artificial Sequence
  Synthetic polynucleotide
cttttgccggaggacagagactgacrtggaacaggggaagggcctggctgt

SEQ ID NO: 3798 - DNA, 51 bp, Artificial Sequence
  Synthetic polynucleotide
atctgcaggaatcgtgtgactaatartgtaaaagacgtcactaaattggta

SEQ ID NO: 3799 - DNA, 51 bp, Artificial Sequence
  Synthetic polynucleotide
gcggagctgctaagagcctgctgacrtgacatcggccacagagtttgaaaa

SEQ ID NO: 3800 - DNA, 51 bp, Artificial Sequence
  Synthetic polynucleotide
gagcgggtcgctgagaggggtcagargcttgaggattcctatcacttacaa

SEQ ID NO: 3801 - DNA, 51 bp, Artificial Sequence
  Synthetic polynucleotide
tttacagtaccggagtacactggaarggatgcttgatgtaacaatgctaca

SEQ ID NO: 3802 - DNA, 51 bp, Artificial Sequence
  Synthetic polynucleotide
gacccgagctgggcccgtgtggtcarcctcaatgccctgctcatgatggca

SEQ ID NO: 3803 - DNA, 51 bp, Artificial Sequence
  Synthetic polynucleotide
cacgagctcattcgcaatgcagccgrtatctccatcatcgttatctacttc

SEQ ID NO: 3804 - DNA, 51 bp, Artificial Sequence
  Synthetic polynucleotide
tctctaccaggtgtgcctgaccctgrcagccaagcgcatggcacggaagaa

SEQ ID NO: 3805 - DNA, 51 bp, Artificial Sequence
  Synthetic polynucleotide
cttcccggacagtcctggcctcaacrgaaccgtggttaacatctcgtccct

SEQ ID NO: 3806 - DNA, 51 bp, Artificial Sequence
  Synthetic polynucleotide
ctcaccaacctcatccacaccaagtrcccgcagcttctgccaggtgagcag

SEQ ID NO: 3807 - DNA, 51 bp, Artificial Sequence
  Synthetic polynucleotide
tgcgaggacaccatctttgaaatgcrgctggcggctcagatctcggagtcg

SEQ ID NO: 3808 - DNA, 51 bp, Artificial Sequence
  Synthetic polynucleotide
cagtccttcctgtacctgggctggtrtatggtgatgtccctcttgggacac

SEQ ID NO: 3809 - DNA, 51 bp, Artificial Sequence
  Synthetic polynucleotide
ctctgtctcaaaaaaaaaaaaaaacrtatgtaaagttgttcccaaatgcca

SEQ ID NO: 3810 - DNA, 51 bp, Artificial Sequence
  Synthetic polynucleotide
ggtgtactacttcctggaggaaagcrcaggctacatggaacccgccctgcg

SEQ ID NO: 3811 - DNA, 51 bp, Artificial Sequence
  Synthetic polynucleotide
tctccctacctgcctgtcctcaggtrcatccccgagggcctgcagtgctcg

SEQ ID NO: 3812 - DNA, 51 bp, Artificial Sequence
  Synthetic polynucleotide
ggcctgcagtgctcgtgtggaatcgrctactacacgctcaagccggaggtc

SEQ ID NO: 3813 - DNA, 51 bp, Artificial Sequence
  Synthetic polynucleotide
catgaccatcccagcgttctttgccragagcgccgccatctacaaccctgt

SEQ ID NO: 3814 - DNA, 51 bp, Artificial Sequence
  Synthetic polynucleotide
cctaacttctacgtgcccttctccartgcgacgggtgtggtacgcagcccc

SEQ ID NO: 3815 - DNA, 51 bp, Artificial Sequence
  Synthetic polynucleotide
aagggtgctgtggatcagggaaatgrtgagtatgaagctgttttaaattct

SEQ ID NO: 3816 - DNA, 51 bp, Artificial Sequence
  Synthetic polynucleotide
ctttggacaaaaaggctggcccaaargatcctgccccactggagttttcca

SEQ ID NO: 3817 - DNA, 51 bp, Artificial Sequence
  Synthetic polynucleotide
gagtgcccagaatccctctgccagtrcagtttcaattcacagcgttttgct

SEQ ID NO: 3818 - DNA, 51 bp, Artificial Sequence
  Synthetic polynucleotide
tttgctgacaaagaagaaggtggagrtgtgaagtccgtgtgcatgaccttg

SEQ ID NO: 3819 - DNA, 51 bp, Artificial Sequence
  Synthetic polynucleotide
ataaactcagctgccaagacctactrcatgtctggtggccttcagcctgtg

SEQ ID NO: 3820 - DNA, 51 bp, Artificial Sequence
  Synthetic polynucleotide
gcaaattcttgctgtcagaacatagrtcaaagttttccaggcttccatgga

SEQ ID NO: 3821 - DNA, 51 bp, Artificial Sequence
  Synthetic polynucleotide
actggaacatcatctttacatgtttdtgatggcaagtttctggctcgggtt

SEQ ID NO: 3822 - DNA, 51 bp, Artificial Sequence
  Synthetic polynucleotide
ctgaagcagaagaggcggaccctgaraaaccgcggctatgcccagtcctgc

SEQ ID NO: 3823 - DNA, 51 bp, Artificial Sequence
  Synthetic polynucleotide
tccctcctctacgggcttgtgcaccrgggcatgaaatgctcctgtgagtga

SEQ ID NO: 3824 - DNA, 51 bp, Artificial Sequence
  Synthetic polynucleotide
cttcctcatggttctaggaaaaggcrgttttgggaaggttggattcctggg

SEQ ID NO: 3825 - DNA, 51 bp, Artificial Sequence
  Synthetic polynucleotide
acggacaaagagattgaggttctctrtattcggaatgtaacttttgaggac

SEQ ID NO: 3826 - DNA, 51 bp, Artificial Sequence
  Synthetic polynucleotide
aaggagattacagcttccccagactrcctggagatagccatttactgcata

SEQ ID NO: 3827 - DNA, 51 bp, Artificial Sequence
  Synthetic polynucleotide
tgcccagccccacatccagtggatcragcacgtggaaaagaacggcagtaa

SEQ ID NO: 3828 - DNA, 51 bp, Artificial Sequence
  Synthetic polynucleotide
actgttcatagatgatgccacagagraagacctttctgatctggtgtcaga

SEQ ID NO: 3829 - DNA, 51 bp, Artificial Sequence
  Synthetic polynucleotide
aacatgtgtgctcagctttgtgtcarttaccctggaggttacacttgctat

SEQ ID NO: 3830 - DNA, 51 bp, Artificial Sequence
  Synthetic polynucleotide
aaatggttttgttatgctttcaaatragaaagattgtaaaggtaagagcag

SEQ ID NO: 3831 - DNA, 51 bp, Artificial Sequence
  Synthetic polynucleotide
gcctgtttcagattacatcaatgcaratatcatcatggtaagctttgcttt

SEQ ID NO: 3832 - DNA, 51 bp, Artificial Sequence
  Synthetic polynucleotide
cctgtttcagattacatcaatgcaavtatcatcatggtaagctttgctttt

SEQ ID NO: 3833 - DNA, 51 bp, Artificial Sequence
  Synthetic polynucleotide
caagaaaacaaaaacaaaaatagatvtaaaaacatcctgccctgtaagtat

SEQ ID NO: 3834 - DNA, 51 bp, Artificial Sequence
  Synthetic polynucleotide
  misc_feature (26)..(26): n is a, c, g, t or u
cacatcaagattcagaacactggtgnttactatgacctgtatggaggggag

SEQ ID NO: 3835 - DNA, 51 bp, Artificial Sequence
  Synthetic polynucleotide
aagattcagaacactggtgattactrtgacctgtatggaggggagaaattt

SEQ ID NO: 3836 - DNA, 51 bp, Artificial Sequence
  Synthetic polynucleotide
  misc_feature (26)..(26): n is a, c, g, t or u
ggggagaaatttgccactttggctgngttggtccagtattacatggaacat

SEQ ID NO: 3837 - DNA, 51 bp, Artificial Sequence
  Synthetic polynucleotide
tttgccactttggctgagttggtccrgtattacatggaacatcacgggcaa

SEQ ID NO: 3838 - DNA, 51 bp, Artificial Sequence
  Synthetic polynucleotide
tcagggatggtccagacagaagcacvgtaccgatttatctatatggcggtc

SEQ ID NO: 3839 - DNA, 51 bp, Artificial Sequence
  Synthetic polynucleotide
aactctccgtacatcgtgggcttctrtggtgcgttctacagcgatggcgag

SEQ ID NO: 3840 - DNA, 51 bp, Artificial Sequence
  Synthetic polynucleotide
ccagcgctcccgggactactcggccrtgatcaagcacctgagaacgcacaa

SEQ ID NO: 3841 - DNA, 51 bp, Artificial Sequence
  Synthetic polynucleotide
agtggtggggggccttggcggctacrtgctgggaagtgccatgagcaggcc

SEQ ID NO: 3842 - DNA, 51 bp, Artificial Sequence
  Synthetic polynucleotide
gtggttgagcagatgtgtatcacccrgtacgagagggaatctcaggcctat

SEQ ID NO: 3843 - DNA, 51 bp, Artificial Sequence
  Synthetic polynucleotide
ctttgtgcacgactgcgtcaatatcrcaatcaagcagcacacggtcaccac

SEQ ID NO: 3844 - DNA, 51 bp, Artificial Sequence
  Synthetic polynucleotide
tgcgtcaatatcacaatcaagcagcrcacggtcaccacaaccaccaagggg

SEQ ID NO: 3845 - DNA, 51 bp, Artificial Sequence
  Synthetic polynucleotide
accattgccgccctgctgagcccctrctcctattccaccacggctgtcgtc

SEQ ID NO: 3846 - DNA, 51 bp, Artificial Sequence
  Synthetic polynucleotide
gtctggagagctgcatgggctcacarctgaggaggaatttgtagaagggat

SEQ ID NO: 3847 - DNA, 51 bp, Artificial Sequence
  Synthetic polynucleotide
agaaaggctgctgatgacacctgggrgccatttgcctctgggtaagttgcc

SEQ ID NO: 3848 - DNA, 51 bp, Artificial Sequence
  Synthetic polynucleotide
ccagactttcacaccttataggaaarccagtgagtctggagagctgcatgg

SEQ ID NO: 3849 - DNA, 51 bp, Artificial Sequence
  Synthetic polynucleotide
cgactccggcccccgccgctacaccrttgccgccctgctgagcccctactc

SEQ ID NO: 3850 - DNA, 51 bp, Artificial Sequence
  Synthetic polynucleotide
tgtcctctgatggtcaaagttctagrtgctgtccgaggcagtcctgccatc

SEQ ID NO: 3851 - DNA, 51 bp, Artificial Sequence
  Synthetic polynucleotide
cacagaccccttcttcatcgtggaarcgctgtgtatcatctggttctcctt

SEQ ID NO: 3852 - DNA, 51 bp, Artificial Sequence
  Synthetic polynucleotide
gacggacttcttcaaaaacatcatgracttcatagacattgtggccatcat

SEQ ID NO: 3853 - DNA, 51 bp, Artificial Sequence
  Synthetic polynucleotide
aaaatcttcaactacggccgcatctrtggtgctgggcagccctttgctgag

SEQ ID NO: 3854 - DNA, 51 bp, Artificial Sequence
  Synthetic polynucleotide
gagcccacatggctcaccgccagcartgcccgggtatgtgacctctgtacc

SEQ ID NO: 3855 - DNA, 51 bp, Artificial Sequence
  Synthetic polynucleotide
acccgccaccttctgctggccaacarcagccttcagtccgtgcccccggga

SEQ ID NO: 3856 - DNA, 51 bp, Artificial Sequence
  Synthetic polynucleotide
ctggaaaccatggggctgtgggtggrctgcaggggccacggactcacggcc

SEQ ID NO: 3857 - DNA, 51 bp, Artificial Sequence
  Synthetic polynucleotide
cctggtcatttatagaaaccgaggtrtgaaattcgctggagggtcattgaa

SEQ ID NO: 3858 - DNA, 51 bp, Artificial Sequence
  Synthetic polynucleotide
gggggcttcactgttcagtgtcactragaagcagctgggagcaggaagtat

SEQ ID NO: 3859 - DNA, 51 bp, Artificial Sequence
  Synthetic polynucleotide
gtttcatgagttatctctctcacccrggcgaattgatgatgacaagggaag

SEQ ID NO: 3860 - DNA, 51 bp, Artificial Sequence
  Synthetic polynucleotide
acacacgccatgctgccctatgaccrgtacctgcaccgctttgctgcgtac

SEQ ID NO: 3861 - DNA, 51 bp, Artificial Sequence
  Synthetic polynucleotide
caaagccattggtgggatcattctgrcagccagtcacaacccagggggccc

SEQ ID NO: 3862 - DNA, 51 bp, Artificial Sequence
  Synthetic polynucleotide
ttcatgaaacaaatgaatgatgcacdtcatggtggctggacaacaaaaatg

SEQ ID NO: 3863 - DNA, 51 bp, Artificial Sequence
  Synthetic polynucleotide
cgagatcctctctctgaaatcactgvgcaggagaaagattttctatggagt

SEQ ID NO: 3864 - DNA, 51 bp, Artificial Sequence
  Synthetic polynucleotide
cccttcactgccatcctgtatggcartgggcctggctacaaggtggtgggc

SEQ ID NO: 3865 - DNA, 51 bp, Artificial Sequence
  Synthetic polynucleotide
agaaataaacaggtataagatgtgarttcagtcctcaaataaacctactat

SEQ ID NO: 3866 - DNA, 51 bp, Artificial Sequence
  Synthetic polynucleotide
ttctatatgaaagtgtgacattaacratgtacctactctgttagccgcgya

SEQ ID NO: 3867 - DNA, 51 bp, Artificial Sequence
  Synthetic polynucleotide
tttcctgtcgtagaatagcatgaaaraacttctgcctaattttcctgatct

SEQ ID NO: 3868 - DNA, 51 bp, Artificial Sequence
  Synthetic polynucleotide
ctggccctggaagggctcacggacarcgaggtggaggactgcctgactgtc

SEQ ID NO: 3869 - DNA, 51 bp, Artificial Sequence
  Synthetic polynucleotide
ttccttctttttgcaggaggcattgraattttcagcagagaccttccaagg

SEQ ID NO: 3870 - DNA, 51 bp, Artificial Sequence
  Synthetic polynucleotide
ctgcactgcacgcgcaactacatccrcatgcacctgttcctgtccttcatg

SEQ ID NO: 3871 - DNA, 51 bp, Artificial Sequence
  Synthetic polynucleotide
ttccatttttaggccaaatgttacartgaacttaatggatgcaccaagata

SEQ ID NO: 3872 - DNA, 51 bp, Artificial Sequence
  Synthetic polynucleotide
cgtggtgaaacacatccggacctacragcagagagaccccggcatcttcgc

SEQ ID NO: 3873 - DNA, 51 bp, Artificial Sequence
  Synthetic polynucleotide
cgacatctctcgccagctccgcgtcrgccatggctgcgtcagcaagatcct

SEQ ID NO: 3874 - DNA, 51 bp, Artificial Sequence
  Synthetic polynucleotide
gatgggctccacattccaactatgtraaatatgtgctgaaaatgataagga

SEQ ID NO: 3875 - DNA, 51 bp, Artificial Sequence
  Synthetic polynucleotide
ggtctagccagagacatcaagaatgrttctaattatgtggttaaaggaaac

SEQ ID NO: 3876 - DNA, 51 bp, Artificial Sequence
  Synthetic polynucleotide
gtgtattcacagagacttggcagccrgaaatatcctccttactcatggtcg

SEQ ID NO: 3877 - DNA, 51 bp, Artificial Sequence
  Synthetic polynucleotide
acgggaagccctcatgtctgaactcraagtcctgagttaccttggtaatca

SEQ ID NO: 3878 - DNA, 51 bp, Artificial Sequence
  Synthetic polynucleotide
cggaacgtgctggtcaagagtcccarccatgtcaaaattacagacttcggg

SEQ ID NO: 3879 - DNA, 51 bp, Artificial Sequence
  Synthetic polynucleotide
gattttggtcttgccagagacatgtrtgataaagaatactatagtgtacac

SEQ ID NO: 3880 - DNA, 51 bp, Artificial Sequence
  Synthetic polynucleotide
acagggcattttggttgtgtatatcvtgggactttgttggacaatgatggc

SEQ ID NO: 3881 - DNA, 51 bp, Artificial Sequence
  Synthetic polynucleotide
agtgtacacaacaaaacaggtgcaargctgccagtgaagtggatggctttg

SEQ ID NO: 3882 - DNA, 51 bp, Artificial Sequence
  Synthetic polynucleotide
  misc_feature (26)..(26): n is a, c, g, t or u
ttggacatactggatacagctggacnagaagagtacagtgccatgagagac

SEQ ID NO: 3883 - DNA, 51 bp, Artificial Sequence
  Synthetic polynucleotide
aggtgattttggtctagctacagtgvaatctcgatggagtgggtcccatca

SEQ ID NO: 3884 - DNA, 51 bp, Artificial Sequence
  Synthetic polynucleotide
gaagacctcacagtaaaaataggtgdttttggtctagctacagtgaaatct

SEQ ID NO: 3885 - DNA, 51 bp, Artificial Sequence
  Synthetic polynucleotide
gacttttgtcgaaagctgcttttccrgggtttccgctgtcaaacatgtggt

SEQ ID NO: 3886 - DNA, 51 bp, Artificial Sequence
  Synthetic polynucleotide
tacacctcagcagttacaagccttcraaaatgaagtaggagtactcaggtg

SEQ ID NO: 3887 - DNA, 51 bp, Artificial Sequence
  Synthetic polynucleotide
  misc_feature (26)..(26): n is a, c, g, t or u
cagcagttacaagccttcaaaaatgnagtaggagtactcaggtgagcttgt

SEQ ID NO: 3888 - DNA, 51 bp, Artificial Sequence
  Synthetic polynucleotide
catccacagagacctcaagagtaatvgtatccttcctgaaatttgtctgcg

SEQ ID NO: 3889 - DNA, 51 bp, Artificial Sequence
  Synthetic polynucleotide
ctgaaccccaagtttgaggttggagrtatcatgctgatccgtgaccatatc

SEQ ID NO: 3890 - DNA, 51 bp, Artificial Sequence
  Synthetic polynucleotide
caacgtgagctacaggaaggcacctrtgtgatggtggcaggccccagcttt

SEQ ID NO: 3891 - DNA, 51 bp, Artificial Sequence
  Synthetic polynucleotide
cgacaaggagggcaatggcactgtcrtgggtgctgagcttcgccacgtgct

SEQ ID NO: 3892 - DNA, 51 bp, Artificial Sequence
  Synthetic polynucleotide
ctggggctgctggaggaaatgagggrcgagaggctgagccgcatcatcacg

SEQ ID NO: 3893 - DNA, 51 bp, Artificial Sequence
  Synthetic polynucleotide
ctggcagatgctgaggagcgctgtgrtcagctgatcaaaaacaagattcag

SEQ ID NO: 3894 - DNA, 51 bp, Artificial Sequence
  Synthetic polynucleotide
agacaacacttcattggtgttttggrcattgcaggctttgaaatctttgag

SEQ ID NO: 3895 - DNA, 51 bp, Artificial Sequence
  Synthetic polynucleotide
ctacattgacgaggtggggaccttcraagagcgcatccagtgggtagggga

SEQ ID NO: 3896 - DNA, 51 bp, Artificial Sequence
  Synthetic polynucleotide
tcccctcattcctcatagatcttccrctatgccaagggacaaccctacatt

SEQ ID NO: 3897 - DNA, 51 bp, Artificial Sequence
  Synthetic polynucleotide
gaaaagaaagtcttctggaaagtgayagctgtctgcctcccacttctgctc

SEQ ID NO: 3898 - DNA, 51 bp, Artificial Sequence
  Synthetic polynucleotide
tgttcctcccctttccgcctaggggraagtccccggacctcgggcagagag

SEQ ID NO: 3899 - DNA, 51 bp, Artificial Sequence
  Synthetic polynucleotide
tttctcagaaagacagaatccattgrtgtaatggatgcggttggaagtaat

SEQ ID NO: 3900 - DNA, 51 bp, Artificial Sequence
  Synthetic polynucleotide
gacagttaagcgggttgggatcatcrtaagttgtatctgggcagcttgcac

SEQ ID NO: 3901 - DNA, 51 bp, Artificial Sequence
  Synthetic polynucleotide
atattctacatctcttgtcctcagartccatattgtgtgtgcttcatgtct

SEQ ID NO: 3902 - DNA, 51 bp, Artificial Sequence
  Synthetic polynucleotide
ggctgatatgctggtgagcgtttcaratggatcagaaaccattgtcatcac

SEQ ID NO: 3903 - DNA, 51 bp, Artificial Sequence
  Synthetic polynucleotide
ctgggtgtcatcagcttgttggagartatcttagtgattgtggcaatagcc

SEQ ID NO: 3904 - DNA, 51 bp, Artificial Sequence
  Synthetic polynucleotide
aagattccatgctttcatgtgattchgaaattaaaaaaaaaagattcatta

SEQ ID NO: 3905 - DNA, 51 bp, Artificial Sequence
  Synthetic polynucleotide
agcgtgggccaggcaaccacagtggrgatcttcctgacgctccagttcgtg

SEQ ID NO: 3906 - DNA, 51 bp, Artificial Sequence
  Synthetic polynucleotide
aaaatggcaatcctcatcttcaccgrtttcacctgcatggcacctatctct

SEQ ID NO: 3907 - DNA, 51 bp, Artificial Sequence
  Synthetic polynucleotide
ccagaattaatggctaccaataaagrtacaaagattgctaagaaaatggca

SEQ ID NO: 3908 - DNA, 51 bp, Artificial Sequence
  Synthetic polynucleotide
caggcggtcctgccgcccctgcctcrggtggtgtgcacctaccgtgatgtg

SEQ ID NO: 3909 - DNA, 51 bp, Artificial Sequence
  Synthetic polynucleotide
catgttcattgtggacatcctcatcracttccgcaccacctacgtcaatgc

SEQ ID NO: 3910 - DNA, 51 bp, Artificial Sequence
  Synthetic polynucleotide
gctgcctacgcactggcgctgcaacragaccctgcccatcgctttcaaggt

SEQ ID NO: 3911 - DNA, 51 bp, Artificial Sequence
  Synthetic polynucleotide
aacaggctgcagaccatgaaggaggdactggacttccagaagaacatctac

SEQ ID NO: 3912 - DNA, 51 bp, Artificial Sequence
  Synthetic polynucleotide
tgaataccaacaactcctggatattdagatccgactggagaatgaaattca

SEQ ID NO: 3913 - DNA, 51 bp, Artificial Sequence
  Synthetic polynucleotide
ccgccgcgtccgccgcctccggaacyaaacggggtgaggtcacattcggtt

SEQ ID NO: 3914 - DNA, 51 bp, Artificial Sequence
  Synthetic polynucleotide
tgagaaggccaccatgcagaacctcvatgaccgcctggcctcctacctgga

SEQ ID NO: 3915 - DNA, 51 bp, Artificial Sequence
  Synthetic polynucleotide
gagaaggccaccatgcagaacctcartgaccgcctggcctcctacctggac

SEQ ID NO: 3916 - DNA, 51 bp, Artificial Sequence
  Synthetic polynucleotide
gagaaggtgaccatgcagaacctcartgaccgcctggcctcctacctggac

SEQ ID NO: 3917 - DNA, 51 bp, Artificial Sequence; identical to SEQ ID NO: 3916
  Synthetic polynucleotide

SEQ ID NO: 3918 - DNA, 51 bp, Artificial Sequence
  Synthetic polynucleotide
atcgccacttaccgcaagctgctggrgggcgaggaatgcaggtgagtagac

SEQ ID NO: 3919 - DNA, 51 bp, Artificial Sequence
  Synthetic polynucleotide
  misc_feature (26)..(26): n is a, c, g, t or u
ctgtgtctgcagagcccacacgtgtntccctgagaacaacggaggcgcggg

SEQ ID NO: 3920 - DNA, 51 bp, Artificial Sequence
  Synthetic polynucleotide
ccaggagagaaacgacattgccctgragaccaatggggaccaggcatcctg

SEQ ID NO: 3921 - DNA, 51 bp, Artificial Sequence
  Synthetic polynucleotide
tgcaccgccgaaggcctctgttgccrcagcgagtgcctgggcaactgttct

SEQ ID NO: 3922 - DNA, 51 bp, Artificial Sequence
  Synthetic polynucleotide
agaaacgacattgccctgaagaccartggggaccaggcatcctgtaagtca

SEQ ID NO: 3923 - DNA, 51 bp, Artificial Sequence
  Synthetic polynucleotide
cttctagctcagctgccagattgtcyaaggaaaggagagaatatccagtgg

SEQ ID NO: 3924 - DNA, 51 bp, Artificial Sequence
  Synthetic polynucleotide
tcaggggaaactcttcttccactatraccccaaactctgcttgtcagaaat

SEQ ID NO: 3925 - DNA, 51 bp, Artificial Sequence
  Synthetic polynucleotide
attaaaggactgactgaaggcctgcrtggattccatgttcatgagtttgga

SEQ ID NO: 3926 - DNA, 51 bp, Artificial Sequence
  Synthetic polynucleotide
gatggtgtggccgatgtgtctattgragattctgtgatctcactctcagga

SEQ ID NO: 3927 - DNA, 51 bp, Artificial Sequence
  Synthetic polynucleotide
ctgactgaaggcctgcatggattccrtgttcatgagtttggagataataca

SEQ ID NO: 3928 - DNA, 51 bp, Artificial Sequence
  Synthetic polynucleotide
atctgatgctttttcattattaggcrtgttggagacttgggcaatgtgact

SEQ ID NO: 3929 - DNA, 51 bp, Artificial Sequence
  Synthetic polynucleotide
gcacaggatgaaggactcctttctgrtgtggtacccttcaaagtaccaggt

SEQ ID NO: 3930 - DNA, 51 bp, Artificial Sequence
  Synthetic polynucleotide
gagagacaagtgaccatttggtttcrgaaccgaagagtgaaggacaagaaa

SEQ ID NO: 3931 - DNA, 51 bp, Artificial Sequence
  Synthetic polynucleotide
cgtgtggcgaagatggtcaagtcctrcctgcagcagcacaacatcccacag

SEQ ID NO: 3932 - DNA, 51 bp, Artificial Sequence
  Synthetic polynucleotide
ctggagcagggaggacaggaccagcrtaaaaggcagggcagagtcgactgt

SEQ ID NO: 3933 - DNA, 51 bp, Artificial Sequence
  Synthetic polynucleotide
ccctaaggtgaaggctcatggcaagraagtgctcggtgcctttagtgatgg

SEQ ID NO: 3934 - DNA, 51 bp, Artificial Sequence
  Synthetic polynucleotide
gttactgccctgtggggcaaggtgarcgtggatgaagttggtggtgaggcc

SEQ ID NO: 3935 - DNA, 51 bp, Artificial Sequence
  Synthetic polynucleotide
gggagggcaggagccagggctgggcvtaaaagtcagggcagagccatctat

SEQ ID NO: 3936 - DNA, 51 bp, Artificial Sequence
  Synthetic polynucleotide
gagggcaggagccagggctgggcatraaagtcagggcagagccatctattg

SEQ ID NO: 3937 - DNA, 51 bp, Artificial Sequence
  Synthetic polynucleotide
agggcaggagccagggctgggcatavaagtcagggcagagccatctattgc

SEQ ID NO: 3938 - DNA, 51 bp, Artificial Sequence
  Synthetic polynucleotide
tgagcatctggattctgcctaataaraaacatttattttcattgcaatgat

SEQ ID NO: 3939 - DNA, 51 bp, Artificial Sequence
  Synthetic polynucleotide
ttgagcatctggattctgcctaatadaaaacatttattttcattgcaatga

SEQ ID NO: 3940 - DNA, 51 bp, Artificial Sequence
  Synthetic polynucleotide
cttgagcatctggattctgcctaatraaaaacatttattttcattgcaatg

SEQ ID NO: 3941 - DNA, 51 bp, Artificial Sequence
  Synthetic polynucleotide
  misc_feature (26)..(26): n is a, c, g, t or u
gtgaacgtggatgaagttggtggtgnggccctgggcaggttggtatcaagg

SEQ ID NO: 3942 - DNA, 51 bp, Artificial Sequence
  Synthetic polynucleotide
tggcctggctcacctggacaacctcvagggcacctttgccacactgagtga

SEQ ID NO: 3943 - DNA, 51 bp, Artificial Sequence
  Synthetic polynucleotide
cccacagactcagagagaacccaccrtggtgctgtctcctgccgacaagac

SEQ ID NO: 3944 - DNA, 51 bp, Artificial Sequence
  Synthetic polynucleotide
caccggcccttcctggtctttgaatraagtctgagtgggcagcagcctgtg

SEQ ID NO: 3945 - DNA, 51 bp, Artificial Sequence
  Synthetic polynucleotide
cacccctcactctgcttctccccgcrggatgttcctgtccttccccaccac

SEQ ID NO: 3946 - DNA, 51 bp, Artificial Sequence
  Synthetic polynucleotide
gccctggatctggagattgccacctrcaggaccctcctggagggagaagaa

SEQ ID NO: 3947 - DNA, 51 bp, Artificial Sequence
  Synthetic polynucleotide
gcgccccgccgccgccgccgccgccrtgggctgcctcgggaacagtaagac

SEQ ID NO: 3948 - DNA, 51 bp, Artificial Sequence
  Synthetic polynucleotide
accagcatgtttgacgtgggtggccdgcgcgatgaacgccgcaagtggatc

SEQ ID NO: 3949 - DNA, 51 bp, Artificial Sequence
  Synthetic polynucleotide
ggcgcctctgacagcaacgtctatgrcctcctaaaggacctagaggaaggc

SEQ ID NO: 3950 - DNA, 51 bp, Artificial Sequence
  Synthetic polynucleotide
ttgtctttcctgcaggcgtctctccragtcgacacttttcctgatcccact

SEQ ID NO: 3951 - DNA, 51 bp, Artificial Sequence
  Synthetic polynucleotide
gaccaatgaaaatattcagcgatttraaatatgtccaacgccaaacaatca

SEQ ID NO: 3952 - DNA, 51 bp, Artificial Sequence
  Synthetic polynucleotide
caatgaaaatattcagcgatttaaartatgtccaacgccaaacaatcagtt

SEQ ID NO: 3953 - DNA, 51 bp, Artificial Sequence
  Synthetic polynucleotide
gatgggatgtggaacattacagtccratggtatgctggagagttactctgc

SEQ ID NO: 3954 - DNA, 51 bp, Artificial Sequence
  Synthetic polynucleotide
tttactgtctgctggactccctactrtgtcctaggaatttggtattggttt

SEQ ID NO: 3955 - DNA, 51 bp, Artificial Sequence
  Synthetic polynucleotide
gccggccgccccgagcgtgcgccctdccgcgacctgcgttgcgtggcgccc

SEQ ID NO: 3956 - DNA, 51 bp, Artificial Sequence
  Synthetic polynucleotide
tttgaagttgcttgggaagtgaccartaaaggtttgtactgctcctgaagg

SEQ ID NO: 3957 - DNA, 51 bp, Artificial Sequence
  Synthetic polynucleotide
cctccacccccactctaggtgtcctvtgtgaaagccattgacatttggatg

SEQ ID NO: 3958 - DNA, 51 bp, Artificial Sequence
  Synthetic polynucleotide
ctccggctctcgagcatctctgcccraggtaagtcccattgcccaagagca

SEQ ID NO: 3959 - DNA, 51 bp, Artificial Sequence
  Synthetic polynucleotide
ccccatggacttgaagaatttccccrtggatgtccagacatgtatcatgca

SEQ ID NO: 3960 - DNA, 51 bp, Artificial Sequence
  Synthetic polynucleotide
acggtggccacgatgatctcctgctrctacgaagaccatcagtgcgaggtc

SEQ ID NO: 3961 - DNA, 51 bp, Artificial Sequence
  Synthetic polynucleotide
aggctgtgatgctgctggctttttcrctgtctttgccagtgagctgtcagt

SEQ ID NO: 3962 - DNA, 51 bp, Artificial Sequence
  Synthetic polynucleotide
cgcctccccgcaccccagtgcatccrcagagacctggctgctcggaacatt

SEQ ID NO: 3963 - DNA, 51 bp, Artificial Sequence
  Synthetic polynucleotide
ccggcagtgatgacctcgcccctgtrcctggagatcatcatctattgcaca

SEQ ID NO: 3964 - DNA, 51 bp, Artificial Sequence
  Synthetic polynucleotide
agcatttacaaatcagtcttttccarctcttccaaagagatgatgtgtttc

SEQ ID NO: 3965 - DNA, 51 bp, Artificial Sequence
  Synthetic polynucleotide
aagcctaacgtgaaggaattcacagrgacctcggccatttttgaggatggg

SEQ ID NO: 3966 - DNA, 51 bp, Artificial Sequence
  Synthetic polynucleotide
accgggctgtcccctggggtcacctrttacttcaaagtctttgcagtgagc

SEQ ID NO: 3967 - DNA, 51 bp, Artificial Sequence
  Synthetic polynucleotide
cgtgcacaacctcgactactacaagvagacaaccaacgtgagcccggccct

SEQ ID NO: 3968 - DNA, 51 bp, Artificial Sequence
  Synthetic polynucleotide
gaggctgacgaggcgggcagtgtgtrtgcaggcatcctcagctacggggtg

SEQ ID NO: 3969 - DNA, 51 bp, Artificial Sequence
  Synthetic polynucleotide
gtgcaggcgcccagcaggttgatgaygtttttgtgtttcccgatcatcttc

SEQ ID NO: 3970 - DNA, 51 bp, Artificial Sequence
  Synthetic polynucleotide
gccctgcgtgcaggcgcccagcaggbtgatgatgtttttgtgtttcccgat

SEQ ID NO: 3971 - DNA, 51 bp, Artificial Sequence
  Synthetic polynucleotide
gacgtggagttccactgcaaggtgtrcagtgacgcacagccccacatccag

SEQ ID NO: 3972 - DNA, 51 bp, Artificial Sequence
  Synthetic polynucleotide
gtctgtaaacatggacagtgcatcartacagatggttcctatcgctgcgag

SEQ ID NO: 3973 - DNA, 51 bp, Artificial Sequence
  Synthetic polynucleotide
atacccagcctctgcacccacggcargtgcagaaacaccattggcagcttt

SEQ ID NO: 3974 - DNA, 51 bp, Artificial Sequence
  Synthetic polynucleotide
tataaatgtatatgcaattcaggatrtgaagtggattcaactgggaaaaac

SEQ ID NO: 3975 - DNA, 51 bp, Artificial Sequence
  Synthetic polynucleotide
ccgcgggtctgtctcttgcttcaacrgtgtttggacggaacagatccgggg

SEQ ID NO: 3976 - DNA, 51 bp, Artificial Sequence
  Synthetic polynucleotide
ttttcagatgttgacttgagtaaatrtatcaccactattgctggagtcatg

SEQ ID NO: 3977 - DNA, 51 bp, Artificial Sequence
  Synthetic polynucleotide
aggctttgttcgaaagaatggtgtcratgaagccaaaatagatgagatcaa

SEQ ID NO: 3978 - DNA, 51 bp, Artificial Sequence
  Synthetic polynucleotide
tttctaggcttagaagtggaaataarctgcacccggacccagaataccaag

SEQ ID NO: 3979 - DNA, 51 bp, Artificial Sequence
  Synthetic polynucleotide
ctcgttggatcctgggacaatatctrtgcctatggcgtccccccatcggcc

SEQ ID NO: 3980 - DNA, 51 bp, Artificial Sequence
  Synthetic polynucleotide
ggcttatccgatggcccctactccarcccttatgagaacagccttatccca

SEQ ID NO: 3981 - DNA, 51 bp, Artificial Sequence
  Synthetic polynucleotide
gacaaggagtgtgtctactattgccrcctggacatcatttggatcaacact

SEQ ID NO: 3982 - DNA, 51 bp, Artificial Sequence
  Synthetic polynucleotide
cagagcggacagcccctccacgagtytcttactgagaatggaggctttggg

SEQ ID NO: 3983 - DNA, 51 bp, Artificial Sequence
  Synthetic polynucleotide
gtagagtttgacttcctcgggaaggrctccatcagatactataacaaggtc

SEQ ID NO: 3984 - DNA, 51 bp, Artificial Sequence
  Synthetic polynucleotide
gttcagattcgtattttggatgtcartgacaatatacctgtagtagaaaat

SEQ ID NO: 3985 - DNA, 51 bp, Artificial Sequence
  Synthetic polynucleotide
tctgtgttcaattttgtgtctgtacrgtggtaccacttttactgctgatgt

SEQ ID NO: 3986 - DNA, 51 bp, Artificial Sequence
  Synthetic polynucleotide
tttctccttattttactctcttcacrgataattgcctttgcaacaactcca

SEQ ID NO: 3987 - DNA, 51 bp, Artificial Sequence
  Synthetic polynucleotide
ccaggatggtctcgatctcctgaccytatgatccgcccgccttggcctccc

SEQ ID NO: 3988 - DNA, 51 bp, Artificial Sequence
  Synthetic polynucleotide
gaggcctggcacgtcccccctcctcrctttcagagcgattaactagtcttg

SEQ ID NO: 3989 - DNA, 51 bp, Artificial Sequence
  Synthetic polynucleotide
cgccgctcggatgaggactacctgtrccgggaggagctggcgcagttccac

SEQ ID NO: 3990 - DNA, 51 bp, Artificial Sequence
  Synthetic polynucleotide
ctaacagtttcatgatcaacatgggrgactcccacgtggacaccagctcca

SEQ ID NO: 3991 - DNA, 51 bp, Artificial Sequence
  Synthetic polynucleotide
tggtttcatctccagggagttccacrggaaataccggatcccagctgatgt

SEQ ID NO: 3992 - DNA, 51 bp, Artificial Sequence
  Synthetic polynucleotide
aacacccagcagccgggctgcgagarcgtctgctacgacagggccttcccc

SEQ ID NO: 3993 - DNA, 51 bp, Artificial Sequence
  Synthetic polynucleotide
tacgatcactacttccccatctcccrcatccggctatgggccctgcagctg

SEQ ID NO: 3994 - DNA, 51 bp, Artificial Sequence
  Synthetic polynucleotide
cgtctaccccctcacccaatctaccytgatgggatatggaatcccaggctt

SEQ ID NO: 3995 - DNA, 51 bp, Artificial Sequence
  Synthetic polynucleotide
ctcaaaagcagcgtggacgcggtcargtactttgggaagggcacctacacc

SEQ ID NO: 3996 - DNA, 51 bp, Artificial Sequence
  Synthetic polynucleotide
ttttcatgagcgtctcttcttttccrgggtgacatccagcagctgctcttt

SEQ ID NO: 3997 - DNA, 51 bp, Artificial Sequence
  Synthetic polynucleotide
tataattttttttttttacttctctrgaactttgctgctcagtatgatgga

SEQ ID NO: 3998 - DNA, 51 bp, Artificial Sequence
  Synthetic polynucleotide
gagtgggtacattctgaaaagtaatrtaagtgtctcaattcactttctagt

SEQ ID NO: 3999 - DNA, 51 bp, Artificial Sequence
  Synthetic polynucleotide
acggaaggctcccagaacatcacctrccactgcaagaacagcattgcctat

SEQ ID NO: 4000 - DNA, 51 bp, Artificial Sequence
  Synthetic polynucleotide
cggtctgcctgggcaacgtggtgagrgaggattccctggcttgcctggccc

SEQ ID NO: 4001 - DNA, 51 bp, Artificial Sequence
  Synthetic polynucleotide
tttacttgtcagataccaggaatatrctatttttcataccacgtgcatgtg

SEQ ID NO: 4002 - DNA, 51 bp, Artificial Sequence
  Synthetic polynucleotide
gtattgtgaaaactctgtttttttcdggtcgaatgagtgatttgagtgtaa

SEQ ID NO: 4003 - DNA, 51 bp, Artificial Sequence
  Synthetic polynucleotide
cgtcagcgagctccccgccccccggvggctgcggtggaaatgctccccgga

SEQ ID NO: 4004 - DNA, 51 bp, Artificial Sequence
  Synthetic polynucleotide
aacagcaaaggcgtgagcctcttcgrcatcatcaaccctgagattatcact

SEQ ID NO: 4005 - DNA, 51 bp, Artificial Sequence
  Synthetic polynucleotide
gtgatttgcttcgaattaacgggtcdgattgctcacatcctgcccatgatg

SEQ ID NO: 4006 - DNA, 51 bp, Artificial Sequence
  Synthetic polynucleotide
ctttctggtgcttctgggactgctgrtggctctggtcagctggagcatgga

SEQ ID NO: 4007 - DNA, 51 bp, Artificial Sequence
  Synthetic polynucleotide
catctcactcgggcttatgccaaagrtgtaaaatttggtgcagatgcccga

SEQ ID NO: 4008 - DNA, 51 bp, Artificial Sequence
  Synthetic polynucleotide
  misc_feature (26)..(26): n is a, c, g, t or u
cactggcagcaacagtcttacctggnctctggaatccattctggtgccact

SEQ ID NO: 4009 - DNA, 51 bp, Artificial Sequence
  Synthetic polynucleotide
  misc_feature (26)..(26): n is a, c, g, t or u
ctctggaatccattctggtgccactnccacagctccttctctgagtggtaa

SEQ ID NO: 4010 - DNA, 51 bp, Artificial Sequence
  Synthetic polynucleotide
tttatgtaagaatgatataaccaaarggtatataatttggtaatgatgcta

SEQ ID NO: 4011 - DNA, 51 bp, Artificial Sequence
  Synthetic polynucleotide
gatctttaccggcttcagtctggggrggaggaggaagagcagatccacagc

SEQ ID NO: 4012 - DNA, 51 bp, Artificial Sequence
  Synthetic polynucleotide
caccacatcacacccgggtacccacraggtgaggaccccagcctcctccgt

SEQ ID NO: 4013 - DNA, 51 bp, Artificial Sequence
  Synthetic polynucleotide
gaagacctggcgcatgcacttattcrcgggcatccagatcatctgcctggc

SEQ ID NO: 4014 - DNA, 51 bp, Artificial Sequence
  Synthetic polynucleotide
ttcatccgctacctcatctcgtccarcgtcggggaagttgtctggtaggtc

SEQ ID NO: 4015 - DNA, 51 bp, Artificial Sequence
  Synthetic polynucleotide
ggccacataagcggggcccacatcavccctgccgtgactgtggcctgcctg

SEQ ID NO: 4016 - DNA, 51 bp, Artificial Sequence
  Synthetic polynucleotide
gacaccctcccgccctctcggccgcrgggcgctgatggacgagaccatgaa

SEQ ID NO: 4017 - DNA, 51 bp, Artificial Sequence
  Synthetic polynucleotide
cgcctcccacctgcgcaagctgcgtvagcggctcctccgcgatgccgatga

SEQ ID NO: 4018 - DNA, 51 bp, Artificial Sequence
  Synthetic polynucleotide
ttgggattacctgcgctgggtgcagrcactgtctgagcaggtgcaggagga

SEQ ID NO: 4019 - DNA, 51 bp, Artificial Sequence
  Synthetic polynucleotide
ggatttggaccctgaggtcagaccarcttcagccgtggctgcctgagacct

SEQ ID NO: 4020 - DNA, 51 bp, Artificial Sequence
  Synthetic polynucleotide
cctgaaagactactggagcaccgttraggacaagttctctgagttctggga

SEQ ID NO: 4021 - DNA, 51 bp, Artificial Sequence
  Synthetic polynucleotide
gtcgctgctgggcggagtgctccggvggtgaggcccggcacggccccgccc

SEQ ID NO: 4022 - DNA, 51 bp, Artificial Sequence
  Synthetic polynucleotide
tgcagagcaatccagagcggccatcracaaatgggtgtccaataagaccga

SEQ ID NO: 4023 - DNA, 51 bp, Artificial Sequence
  Synthetic polynucleotide
tacagacacccagaacatcttcttcrtgagcaaagtcaccaatcccaagca

SEQ ID NO: 4024 - DNA, 51 bp, Artificial Sequence
  Synthetic polynucleotide
tgcatggcatcttggggcggaaaggratcagagtcagatcaagaacaggag

SEQ ID NO: 4025 - DNA, 51 bp, Artificial Sequence
  Synthetic polynucleotide
cttcctgacccagcactatgatgccraaccacagggccgggatgacagata

SEQ ID NO: 4026 - DNA, 51 bp, Artificial Sequence
  Synthetic polynucleotide
accctgcaaagacatcaacacatttrttcatggcaacaagcgcagcatcaa

SEQ ID NO: 4027 - DNA, 51 bp, Artificial Sequence
  Synthetic polynucleotide
gggcggtgttgtcatagcgacagtgrtcgtcatcaccttggtgatgctgaa

SEQ ID NO: 4028 - DNA, 51 bp, Artificial Sequence
  Synthetic polynucleotide
tttgttttcaaggtgttctttgcagragatgtgggttcaaacaaaggtgca

SEQ ID NO: 4029 - DNA, 51 bp, Artificial Sequence
  Synthetic polynucleotide
catggtgggcggtgttgtcatagcgrcagtgatcgtcatcaccttggtgat

SEQ ID NO: 4030 - DNA, 51 bp, Artificial Sequence
  Synthetic polynucleotide
aaatgctttcttttctaggtcatccrtgcctggcttattatatcatctcta

SEQ ID NO: 4031 - DNA, 51 bp, Artificial Sequence
  Synthetic polynucleotide
gcactcaattctgaatgctgccatcrtgatcagtgtcattgttgtcatgac

SEQ ID NO: 4032 - DNA, 51 bp, Artificial Sequence
  Synthetic polynucleotide
  misc_feature (26)..(26): n is a, c, g, t or u
catcatgatcagtgtcattgttgtcntgactatcctcctggtggttctgta

SEQ ID NO: 4033 - DNA, 51 bp, Artificial Sequence
  Synthetic polynucleotide
gttgaaacagctcaggagagaaatgvaacgctttttccagctctcatttac

SEQ ID NO: 4034 - DNA, 51 bp, Artificial Sequence
  Synthetic polynucleotide
caagacactgttgcagagaatgatgrtggcgggttcagtgaggaatgggaa

SEQ ID NO: 4035 - DNA, 51 bp, Artificial Sequence
  Synthetic polynucleotide
ccccttcctcttctcttagggttggrtgggctgtctgagcgctgtgcccag

SEQ ID NO: 4036 - DNA, 51 bp, Artificial Sequence
  Synthetic polynucleotide
cattttgattggcgattttctttttdgggcagtagctcgcctgagccagag

SEQ ID NO: 4037 - DNA, 51 bp, Artificial Sequence
  Synthetic polynucleotide
aagcagctcttcttagggggtgtggrtcggcataagcagttctggcgctac

SEQ ID NO: 4038 - DNA, 51 bp, Artificial Sequence
  Synthetic polynucleotide
gtggcagtgagagacttcggcggacrtggctcccagcgtgccagcggcaga

SEQ ID NO: 4039 - DNA, 51 bp, Artificial Sequence
  Synthetic polynucleotide
aaccctccaaaagagcccatgaaagrtgacgtatgtaaactcaggacaaaa

SEQ ID NO: 4040 - DNA, 51 bp, Artificial Sequence
  Synthetic polynucleotide
gccacagaacccgtcatcgccttctrtgagaaacgtggcattgtgcgcaag

SEQ ID NO: 4041 - DNA, 51 bp, Artificial Sequence
  Synthetic polynucleotide
gaggcccccctcaatcccaaggccarccgcgagaagatgacccagatcatg

SEQ ID NO: 4042 - DNA, 51 bp, Artificial Sequence
  Synthetic polynucleotide
atgaaccagatagagcccggcgtgcrgtacaactacgtgtacgacgaggat

SEQ ID NO: 4043 - DNA, 51 bp, Artificial Sequence
  Synthetic polynucleotide
cagcaaatgtggattagcaagcaagrgtacgatgaggcaggcccatccatt

SEQ ID NO: 4044 - DNA, 51 bp, Artificial Sequence
  Synthetic polynucleotide
caaccgggagaagatgactcagatcrtgtttgagaccttcaatgtccctgc

SEQ ID NO: 4045 - DNA, 51 bp, Artificial Sequence
  Synthetic polynucleotide
tgattcttctcctctgtacattcagratccatttgaaacttctctcaacat

SEQ ID NO: 4046 - DNA, 51 bp, Artificial Sequence
  Synthetic polynucleotide
ttattgtcacttggatcaaatggctrtaagaagctactaaaagaaagaaag

SEQ ID NO: 4047 - DNA, 51 bp, Artificial Sequence
  Synthetic polynucleotide
gatcttcagcctgtactcgctggtcracgcctttcagtggatccagtacag

SEQ ID NO: 4048 - DNA, 51 bp, Artificial Sequence
  Synthetic polynucleotide
atatctcattatgattagtgccctcdtggccctggtgtttatcaagtacct

SEQ ID NO: 4049 - DNA, 51 bp, Artificial Sequence
  Synthetic polynucleotide
tgctccctctaccagctggagaactrctgcaactagacgcagcccgcaggc

SEQ ID NO: 4050 - DNA, 51 bp, Artificial Sequence
  Synthetic polynucleotide
gaagcaggccttcgacatcaccatcrtgatcctcatctgcctcaacatggt

SEQ ID NO: 4051 - DNA, 51 bp, Artificial Sequence
  Synthetic polynucleotide
cctcatctgcctcaacatggtcaccrtgatggtggagacagacaaccagag

SEQ ID NO: 4052 - DNA, 51 bp, Artificial Sequence
  Synthetic polynucleotide
ttcatacctcttatcttcctcccacvgctcctgggcaacgtgctggtctgt

SEQ ID NO: 4053 - DNA, 51 bp, Artificial Sequence
  Synthetic polynucleotide
gtggcccacaagaacatccgggagcrgggccgcttcctgcaggacgtgttc

SEQ ID NO: 4054 - DNA, 51 bp, Artificial Sequence
  Synthetic polynucleotide
agcccaccgcagggctgagaccctcrtcttcagcaagcatgcggtgatcgc

SEQ ID NO: 4055 - DNA, 51 bp, Artificial Sequence
  Synthetic polynucleotide
ggaaggcgtggtggaaaccacgggcvtcaccacccaggcccgcacctccta

SEQ ID NO: 4056 - DNA, 51 bp, Artificial Sequence
  Synthetic polynucleotide
gaggacggacgttactctgtggactrctccaagtttggcaacaccgtcaaa

SEQ ID NO: 4057 - DNA, 51 bp, Artificial Sequence
  Synthetic polynucleotide
cccatctgtggacccttttctgcccrgcacatccgggcaacgtttgatcct

SEQ ID NO: 4058 - DNA, 51 bp, Artificial Sequence
  Synthetic polynucleotide
atttatttcaggcaagtccaactcarggtccatgcctctggaatgggaaga

SEQ ID NO: 4059 - DNA, 51 bp, Artificial Sequence
  Synthetic polynucleotide
cccggggctgctgctgatggacacgrccttcagggacgcccaccagtcact

SEQ ID NO: 4060 - DNA, 51 bp, Artificial Sequence
  Synthetic polynucleotide
aatgggtttctttttttaccccccarttataggacgctggtcagaaacatt

SEQ ID NO: 4061 - DNA, 51 bp, Artificial Sequence
  Synthetic polynucleotide
attaaatcatcttttcttctcttttrggaattgcttcatgtttggctgttt

SEQ ID NO: 4062 - DNA, 51 bp, Artificial Sequence
  Synthetic polynucleotide
gagagagccaaaaaggccatgggctvccagccactagtgaccatggatgat

SEQ ID NO: 4063 - DNA, 51 bp, Artificial Sequence
  Synthetic polynucleotide
agaggcccaggggcaattcctcttcrttgtaggagaaggtgataagactat

SEQ ID NO: 4064 - DNA, 51 bp, Artificial Sequence
  Synthetic polynucleotide
attcagcatgctcatcatgtgcactrttctgacaaactgcatatttatgac

SEQ ID NO: 4065 - DNA, 51 bp, Artificial Sequence
  Synthetic polynucleotide
ctatgtcatgtacgacggcttctccrtgcagcggctggtgaagtgcaacgc

SEQ ID NO: 4066 - DNA, 51 bp, Artificial Sequence
  Synthetic polynucleotide
gaaccaaagcctgttggcttaaacartaaagagcgtttccgcacggccttc

SEQ ID NO: 4067 - DNA, 51 bp, Artificial Sequence
  Synthetic polynucleotide
agagatgattatgtgttcggccccartggggggtcgagctggatgagggag

SEQ ID NO: 4068 - DNA, 51 bp, Artificial Sequence
  Synthetic polynucleotide
aaagaggagtttgagacctatgcagrtgccctgtggtggggcctggtgagt

SEQ ID NO: 4069 - DNA, 51 bp, Artificial Sequence
  Synthetic polynucleotide
tgtaactctctctttttccccccacrgaaagcggtcctcatgatgttcata

SEQ ID NO: 4070 - DNA, 51 bp, Artificial Sequence
  Synthetic polynucleotide
cagaaccagtcaggcccatcgggtartaaccaaaaccaaggcaacatgcag

SEQ ID NO: 4071 - DNA, 51 bp, Artificial Sequence
  Synthetic polynucleotide
aatgccgaacctaagcacaatagcartagacagttagaaagaagtggaaga

SEQ ID NO: 4072 - DNA, 51 bp, Artificial Sequence
  Synthetic polynucleotide
atatgttgccagcaaaataggggggdaaatgctgctaggatttgggatcct

SEQ ID NO: 4073 - DNA, 51 bp, Artificial Sequence
  Synthetic polynucleotide
agactgtgttcaactcttgtcttccrgctaccactgccacgtgtaccccta

SEQ ID NO: 4074 - DNA, 51 bp, Artificial Sequence
  Synthetic polynucleotide
gttacgaggtacacagagggctatartcagagatcgagcagctttagagaa

SEQ ID NO: 4075 - DNA, 51 bp, Artificial Sequence
  Synthetic polynucleotide
agcaaaattataatattggaatatartatctggaacttatttctttatagg

SEQ ID NO: 4076 - DNA, 51 bp, Artificial Sequence
  Synthetic polynucleotide
attctgaaaaacaccagtgatctgcrtaagattttcaattccctctggaac

SEQ ID NO: 4077 - DNA, 51 bp, Artificial Sequence
  Synthetic polynucleotide
gtcagcctctgggacccttctccacrgccatgcaccgggccttccagacag

SEQ ID NO: 4078 - DNA, 51 bp, Artificial Sequence
  Synthetic polynucleotide
tgctgcccctgcatcctccaccttcrgggccatgagaagttgctgaggaca

SEQ ID NO: 4079 - DNA, 51 bp, Artificial Sequence
  Synthetic polynucleotide
cccggggcgcctcccgccaggcaccrtggtgcagaagtcgcgcaacggcgg

SEQ ID NO: 4080 - DNA, 51 bp, Artificial Sequence
  Synthetic polynucleotide
gtgttttccaccatcaaggagtatgrgaagagctcggagggggccctctac

SEQ ID NO: 4081 - DNA, 51 bp, Artificial Sequence
  Synthetic polynucleotide
cctgcgcttcctgcagattctgcggrtgatccgcatggaccggcggggagg

SEQ ID NO: 4082 - DNA, 51 bp, Artificial Sequence
  Synthetic polynucleotide
cagattctgcggatgatccgcatggrccggcggggaggcacctggaagctg

SEQ ID NO: 4083 - DNA, 51 bp, Artificial Sequence
  Synthetic polynucleotide
gtgtacttggcagagaagggggagarcgaccactttgacacctacgcggat

SEQ ID NO: 4084 - DNA, 51 bp, Artificial Sequence
  Synthetic polynucleotide
atgctttggggtctctgttcccggtrgagtggaccagatcgtggggcgggg

SEQ ID NO: 4085 - DNA, 51 bp, Artificial Sequence
  Synthetic polynucleotide
aaggagctgcgggagccggagaagartgaaactgcgtggagtcagcctggc

SEQ ID NO: 4086 - DNA, 51 bp, Artificial Sequence
  Synthetic polynucleotide
agaacttccattgatggcttcttttrgggtgaaccaggtagtataattatg

SEQ ID NO: 4087 - DNA, 51 bp, Artificial Sequence
  Synthetic polynucleotide
tcattttctttactcactttataacrgggcctacctggtcccactggtata

SEQ ID NO: 4088 - DNA, 51 bp, Artificial Sequence
  Synthetic polynucleotide
attttctcttttgtcttctcttcttrgggccctcctggtccaccaggactt

SEQ ID NO: 4089 - DNA, 51 bp, Artificial Sequence
  Synthetic polynucleotide
gccctatcatttctttgtatcctatrgggtaaaccaggcaaagatggagaa

SEQ ID NO: 4090 - DNA, 51 bp, Artificial Sequence
  Synthetic polynucleotide
ttgctatcctttctttatcttactcrggtgatgagatatgtgaaccaggcc

SEQ ID NO: 4091 - DNA, 51 bp, Artificial Sequence
  Synthetic polynucleotide
ttctttgaacgttttcctttcaatarctgctgtttctccataggtgaccct

SEQ ID NO: 4092 - DNA, 51 bp, Artificial Sequence
  Synthetic polynucleotide
gttaaaaaatgacttatcattttacrggctttcctggaattccaggacctc

SEQ ID NO: 4093 - DNA, 51 bp, Artificial Sequence
  Synthetic polynucleotide
gcttagatgggctccctggaccaaarggtatggaggctgtcactgcatctc

SEQ ID NO: 4094 - DNA, 51 bp, Artificial Sequence
  Synthetic polynucleotide
cagatacatcttttaaaactgcttcrgtacttattaatattgatattgtat

SEQ ID NO: 4095 - DNA, 51 bp, Artificial Sequence
  Synthetic polynucleotide
attcttcaaaggtaccaaaggtgaartgggtatgatgggacctccaggccc

SEQ ID NO: 4096 - DNA, 51 bp, Artificial Sequence
  Synthetic polynucleotide
aggacctttgggaattcctggcaggrgtggtgtacctggtcttaaaggtaa

SEQ ID NO: 4097 - DNA, 51 bp, Artificial Sequence
  Synthetic polynucleotide
atattatatatcacatattttcaacrgggcctcagggtgtggaagggcctc

SEQ ID NO: 4098 - DNA, 51 bp, Artificial Sequence
  Synthetic polynucleotide
aactgggtgtaacctgctgtactcarttttttaggtggtggaggtcatcct

SEQ ID NO: 4099 - DNA, 51 bp, Artificial Sequence
  Synthetic polynucleotide
tcttctaattatactttactttcatrggccaaaagggtgatggaggattac

SEQ ID NO: 4100 - DNA, 51 bp, Artificial Sequence
  Synthetic polynucleotide
gtaacattaatgattttatttattcrgggtaatcctggccggccgggtctc

SEQ ID NO: 4101 - DNA, 51 bp, Artificial Sequence
  Synthetic polynucleotide
ataaaactgtatgtaccttctgtgcdggcatgaaaggacccagtggagtac

SEQ ID NO: 4102 - DNA, 51 bp, Artificial Sequence
  Synthetic polynucleotide
ggatgggattctctgtggattggttrttccttcatgatggtattttacact

SEQ ID NO: 4103 - DNA, 51 bp, Artificial Sequence
  Synthetic polynucleotide
ctgattgtcttatttcttatttcccrgtaaacctcagtcagaaacgctgaa

SEQ ID NO: 4104 - DNA, 51 bp, Artificial Sequence
  Synthetic polynucleotide
tttcatttgttttcccctttaaacarttaagatctctcaggattaacactg

SEQ ID NO: 4105 - DNA, 51 bp, Artificial Sequence
  Synthetic polynucleotide
tattggtgttccattgcttactttgraatggatgttcaggtaggagagaca

SEQ ID NO: 4106 - DNA, 51 bp, Artificial Sequence
  Synthetic polynucleotide
ccactgctaccacaagtttgcccacvagccacccatctcctcagctgagat

SEQ ID NO: 4107 - DNA, 51 bp, Artificial Sequence
  Synthetic polynucleotide
ctgtcagagttcaacgtcctgaagcrggtcaaccacccacatgtcatcaaa

SEQ ID NO: 4108 - DNA, 51 bp, Artificial Sequence
  Synthetic polynucleotide
tattatgtggctgccgtgtatgagcrtccatccatcctgagtctgaaccct

SEQ ID NO: 4109 - DNA, 51 bp, Artificial Sequence
  Synthetic polynucleotide
ctcatgaaccagaaccttgacatctrtgaacagcaagtgatgactgcagcc

SEQ ID NO: 4110 - DNA, 51 bp, Artificial Sequence
  Synthetic polynucleotide
ccagaagatggcattcatggattcarctttacaagaacatccatttatcca

SEQ ID NO: 4111 - DNA, 51 bp, Artificial Sequence
  Synthetic polynucleotide
tggcattcatggattcaactttacargaacatccatttatccatttttgga

SEQ ID NO: 4112 - DNA, 51 bp, Artificial Sequence
  Synthetic polynucleotide
aggggagatatgttcttggtggccartcttgggacaaaggagccttgtcat

SEQ ID NO: 4113 - DNA, 51 bp, Artificial Sequence
  Synthetic polynucleotide
cccaaaagatgggagataccagttcracacaaatgtcgtgttcagcaataa

SEQ ID NO: 4114 - DNA, 51 bp, Artificial Sequence
  Synthetic polynucleotide
ccaaaagatgggagataccagttcarcacaaatgtcgtgttcagcaataat

SEQ ID NO: 4115 - DNA, 51 bp, Artificial Sequence
  Synthetic polynucleotide
cttgttgaccgctaccgtaaacacarcctctactttgaggcagcattcgat

SEQ ID NO: 4116 - DNA, 51 bp, Artificial Sequence
  Synthetic polynucleotide
gaaagcttttgctgttgcctttggcrtcaacgttctggcagctaatgtcca

SEQ ID NO: 4117 - DNA, 51 bp, Artificial Sequence
  Synthetic polynucleotide
tttcactctgagatgatgtatgacartttcaccctggtccctgtctgggga

SEQ ID NO: 4118 - DNA, 51 bp, Artificial Sequence
  Synthetic polynucleotide
aggcccaccttatccaaagagctgtrtgccctgggggtctttgatgggctt

SEQ ID NO: 4119 - DNA, 51 bp, Artificial Sequence
  Synthetic polynucleotide
acggcggctctctatgggcgcttgtrtgagagggactaggaaaagtgtgtg

SEQ ID NO: 4120 - DNA, 51 bp, Artificial Sequence
  Synthetic polynucleotide
ttccagcggatcccccggtggcctcrtgtcgcgcagtggaaccgatcctca

SEQ ID NO: 4121 - DNA, 51 bp, Artificial Sequence
  Synthetic polynucleotide
gtcagaggcggacgccgcagcagcarccttccgggcaaacggtaactgcac

SEQ ID NO: 4122 - DNA, 51 bp, Artificial Sequence
  Synthetic polynucleotide
gtgcttctagcctatccttgtcggtrggtgaatccccagtacgatagcacc

SEQ ID NO: 4123 - DNA, 51 bp, Artificial Sequence
  Synthetic polynucleotide
tacgatagcaccttcctgtttgacarcgacttcccagctctgcagcctgat

SEQ ID NO: 4124 - DNA, 51 bp, Artificial Sequence
  Synthetic polynucleotide
tttgacaacgacttcccagctctgcrgcctgatgcccccagtccaggtaac

SEQ ID NO: 4125 - DNA, 51 bp, Artificial Sequence
  Synthetic polynucleotide
atcttttctcccgtcaccacccagtraggtcatgtgcttccacccctggtc

SEQ ID NO: 4126 - DNA, 51 bp, Artificial Sequence
  Synthetic polynucleotide
ctggtcggatgtaacgctgccactcrtgtcggtccctgagatccgggctgt

SEQ ID NO: 4127 - DNA, 51 bp, Artificial Sequence
  Synthetic polynucleotide
ttcttctctgcttttgccccttgacrggtatgggccagcagtttcctgcca

SEQ ID NO: 4128 - DNA, 51 bp, Artificial Sequence
  Synthetic polynucleotide
ttttgccccttgacaggtatgggccrgcagtttcctgccagatattgccca

SEQ ID NO: 4129 - DNA, 51 bp, Artificial Sequence
  Synthetic polynucleotide
cgtgaggagcgatctcagcaggcctvtaagagtcagcatggagagcccctg

SEQ ID NO: 4130 - DNA, 51 bp, Artificial Sequence
  Synthetic polynucleotide
gtccccttctgggcaacatggccctvccagacactgctgctgcccgtcggc

SEQ ID NO: 4131 - DNA, 51 bp, Artificial Sequence
  Synthetic polynucleotide
cggctacctgagctgacccctgctgrgcgtgatggtcagtctcccaagtag

SEQ ID NO: 4132 - DNA, 51 bp, Artificial Sequence
  Synthetic polynucleotide
aggctgagagtcaggctctgattccrgatctagcctccatcatgaagaagc

SEQ ID NO: 4133 - DNA, 51 bp, Artificial Sequence
  Synthetic polynucleotide
tccatcatgaagaagctcttgaccargtatgacaacctctttgagacgtcc

SEQ ID NO: 4134 - DNA, 51 bp, Artificial Sequence
  Synthetic polynucleotide
cattggcagctgcacgctcattactrccctccgctcctgcgctctgccact

SEQ ID NO: 4135 - DNA, 51 bp, Artificial Sequence
  Synthetic polynucleotide
ctcctgcgctctgccactgtccggarattcatggttggctacgaaatgctt

SEQ ID NO: 4136 - DNA, 51 bp, Artificial Sequence
  Synthetic polynucleotide
gcttgctcaggctcagagggacctcrcccctgagcaggtcaggactcagaa

SEQ ID NO: 4137 - DNA, 51 bp, Artificial Sequence
  Synthetic polynucleotide
gcagaaggacagggagacagcaaccrtcgcctgaccacgccgaccacaggg

SEQ ID NO: 4138 - DNA, 51 bp, Artificial Sequence
  Synthetic polynucleotide
gttgcttgaaaataaagcagttaaaraggcaggtgtaggaattgaaggaga

SEQ ID NO: 4139 - DNA, 51 bp, Artificial Sequence
  Synthetic polynucleotide
cttacccagacacactccatcgcctygtcgattttggaatgtctgggctca

SEQ ID NO: 4140 - DNA, 51 bp, Artificial Sequence
  Synthetic polynucleotide
acagcgggggagagcgagagccaccrcacatcactgctggtgccctggccc

SEQ ID NO: 4141 - DNA, 51 bp, Artificial Sequence
  Synthetic polynucleotide
caaattgcggcacatgtcataagtgrggccagcagtaaaacaacatctggt

SEQ ID NO: 4142 - DNA, 51 bp, Artificial Sequence
  Synthetic polynucleotide
cccacccaggtggccatccagctgartgacactcaccctgcactcgcgatc

SEQ ID NO: 4143 - DNA, 51 bp, Artificial Sequence
  Synthetic polynucleotide
ccccttggggagggctgcttcggccrggtggtcatggcggaggccatcggc

SEQ ID NO: 4144 - DNA, 51 bp, Artificial Sequence
  Synthetic polynucleotide
tgatatcgccgcgctcgtcgtcgacvacggctccggcatgtgcaaggccgg

SEQ ID NO: 4145 - DNA, 51 bp, Artificial Sequence
  Synthetic polynucleotide
tgggggaagagactgaccttcgtggyggaagctcctcacggtgttggcccg

SEQ ID NO: 4146 - DNA, 51 bp, Artificial Sequence
  Synthetic polynucleotide
cagctggcccgacctggtgtccccarggtgatccctacccctaccatgcct

SEQ ID NO: 4147 - DNA, 51 bp, Artificial Sequence
  Synthetic polynucleotide
agaagaagtttgtgctacagaaactrctatgctgacaaccagacctgtgat

SEQ ID NO: 4148 - DNA, 51 bp, Artificial Sequence
  Synthetic polynucleotide
ctagatatgagaagaagtttgtgctrcagaaactactatgctgacaaccag

SEQ ID NO: 4149 - DNA, 51 bp, Artificial Sequence
  Synthetic polynucleotide
agaagtttgtgctacagaaactactrtgctgacaaccagacctgtgatgga

SEQ ID NO: 4150 - DNA, 51 bp, Artificial Sequence
  Synthetic polynucleotide
ttacttaaactaccatgttcctcgarcgagacgagaaatcctggagaccct

SEQ ID NO: 4151 - DNA, 51 bp, Artificial Sequence
  Synthetic polynucleotide
ctggaggctgagtttcatttcacacrcctcattatgaccttcaaggtgcct

SEQ ID NO: 4152 - DNA, 51 bp, Artificial Sequence
  Synthetic polynucleotide
gacttaagggacctgtgtgcgtggcrggtaagaccctcggagctggagcct

SEQ ID NO: 4153 - DNA, 51 bp, Artificial Sequence
  Synthetic polynucleotide
ggggcgccccggcgccgcaagctctrctgcgccacgaagtaccacctccag

SEQ ID NO: 4154 - DNA, 51 bp, Artificial Sequence
  Synthetic polynucleotide
gccatgaacaagaggggacgactctrtgcttcggtgagtccaggctgtcac

SEQ ID NO: 4155 - DNA, 51 bp, Artificial Sequence
  Synthetic polynucleotide
taatcaaaggaacaatatgaattatrctgtgagatgggctccacattccaa

SEQ ID NO: 4156 - DNA, 51 bp, Artificial Sequence
  Synthetic polynucleotide
tgtgaatgccccgaaggctacagatrtaatctcaaatcaaagtcttgtgaa

SEQ ID NO: 4157 - DNA, 51 bp, Artificial Sequence
  Synthetic polynucleotide
taccagaagtattgtgggaaaccttrcacatatgcgtatggacttggcttg

SEQ ID NO: 4158 - DNA, 51 bp, Artificial Sequence
  Synthetic polynucleotide
tgaatcttttcattggtgtcatcatrgataacttcaaccaacagaaaaaga

SEQ ID NO: 4159 - DNA, 51 bp, Artificial Sequence
  Synthetic polynucleotide
gtcagtgaagaagctttctgatgtcrtgatcttgactgtgttctgtctaag

SEQ ID NO: 4160 - DNA, 51 bp, Artificial Sequence
  Synthetic polynucleotide
ttctgccacctctgtacaaaagacarttttacttgtgtgacagatgggctc

SEQ ID NO: 4161 - DNA, 51 bp, Artificial Sequence
  Synthetic polynucleotide
tttgatcaattagatcttgtcacatrtgaagaagtagtaaaactgccagca

SEQ ID NO: 4162 - DNA, 51 bp, Artificial Sequence
  Synthetic polynucleotide
ggtggcagtgtacttttggctgccartgtgaccctgggactctggatggtt

SEQ ID NO: 4163 - DNA, 51 bp, Artificial Sequence
  Synthetic polynucleotide
acgaatgatttcgactcattaaattrtgataatcatatttaccaaatgccc

SEQ ID NO: 4164 - DNA, 51 bp, Artificial Sequence
  Synthetic polynucleotide
gaatttgcaattcaatatgaaaatcrcctcggagctggtaaaaagaggcct

SEQ ID NO: 4165 - DNA, 51 bp, Artificial Sequence
  Synthetic polynucleotide
gtagcttacctcctcaaagcaatacrctgaaaatgtttagacgggctcaca

SEQ ID NO: 4166 - DNA, 51 bp, Artificial Sequence
  Synthetic polynucleotide
ctgattgagatggctggtgactgcaytggtacccatgggactgagtgtggc

SEQ ID NO: 4167 - DNA, 51 bp, Artificial Sequence
  Synthetic polynucleotide
ctcctgactctggatatcttgaaacrtggcaagcgcttccatgccaccgtc

SEQ ID NO: 4168 - DNA, 51 bp, Artificial Sequence
  Synthetic polynucleotide
gaagcgggtggaagatgtccttggcragggctgggagaatcacgtggaggg

SEQ ID NO: 4169 - DNA, 51 bp, Artificial Sequence
  Synthetic polynucleotide
ctaagaataaccaatcaggtaatctrcttgaatccaccaattgaagagtgc

SEQ ID NO: 4170 - DNA, 51 bp, Artificial Sequence
  Synthetic polynucleotide
actgtaggggtgctctgggtttggghagcactgggcactgagccaggagtc

SEQ ID NO: 4171 - DNA, 51 bp, Artificial Sequence
  Synthetic polynucleotide
atgctctcttccttccctccaggctvcttgtacctggccattgagtacgcg

SEQ ID NO: 4172 - DNA, 51 bp, Artificial Sequence
  Synthetic polynucleotide
agatggcagtgtgaagagagaagacrtattctacacttcaaaggtactgtg

SEQ ID NO: 4173 - DNA, 51 bp, Artificial Sequence
  Synthetic polynucleotide
acaagaacagctgttactcaagaagrtgtatttaatgcttgacaataagag

SEQ ID NO: 4174 - DNA, 51 bp, Artificial Sequence
  Synthetic polynucleotide
gagcatgaaatcaagagcctggaagrtttacaagatgaatatgacttcaaa

SEQ ID NO: 4175 - DNA, 51 bp, Artificial Sequence
  Synthetic polynucleotide
gttggaggaattggaacagaaatacrcctacgaacatgaccctatcacaaa

SEQ ID NO: 4176 - DNA, 51 bp, Artificial Sequence
  Synthetic polynucleotide
cctccaggtccccaggcctcttgcartgcggaaagaggggatccaaaccag

SEQ ID NO: 4177 - DNA, 51 bp, Artificial Sequence
  Synthetic polynucleotide
catgtacattgccatcatcctggagracttcagtgtagccacagaggaaag

SEQ ID NO: 4178 - DNA, 51 bp, Artificial Sequence
  Synthetic polynucleotide
tacatctcacggccgcgccgggtggrgctggctgtcatgttgaacttgacc

SEQ ID NO: 4179 - DNA, 51 bp, Artificial Sequence
  Synthetic polynucleotide
cattgggtatggcttccgagtcatcrcagagaagtgtccagaggggattat

SEQ ID NO: 4180 - DNA, 51 bp, Artificial Sequence
  Synthetic polynucleotide
acggtcgagggggcagagaaggaagrtgagggcgtctacacggtcacagtg

SEQ ID NO: 4181 - DNA, 51 bp, Artificial Sequence
  Synthetic polynucleotide
tgttgatgaccttcgtcgcttatgcrtactcaggatgagttttgtgaaagg

SEQ ID NO: 4182 - DNA, 51 bp, Artificial Sequence
  Synthetic polynucleotide
ttgatgaccttcgtcgcttatgcatrctcaggatgagttttgtgaaaggct

SEQ ID NO: 4183 - DNA, 51 bp, Artificial Sequence
  Synthetic polynucleotide
tatcaatttttgactgctttttcacrattgatctctcgaatttgtcattct

SEQ ID NO: 4184 - DNA, 51 bp, Artificial Sequence
  Synthetic polynucleotide
ccccaaccgcccccaggtttggttcragaatcgtcgggccaaatggagaaa

SEQ ID NO: 4185 - DNA, 51 bp, Artificial Sequence
  Synthetic polynucleotide
ctgtgccaactgtcacaccacaactrccaccttatggcgcagaaacgccga

SEQ ID NO: 4186 - DNA, 51 bp, Artificial Sequence
  Synthetic polynucleotide
aaacgccgagggtgaacccgtgtgcvatgcttgtggactctacatgaaact

SEQ ID NO: 4187 - DNA, 51 bp, Artificial Sequence
  Synthetic polynucleotide
cttgtggaagccctgaagccagagtrtgtggcacctcttgtcctttggctt

SEQ ID NO: 4188 - DNA, 51 bp, Artificial Sequence
  Synthetic polynucleotide
gcctgtgacagcaacattaatgcggrgaccatcattggccttgttcgggta

SEQ ID NO: 4189 - DNA, 51 bp, Artificial Sequence
  Synthetic polynucleotide
catcataaaaaccaaacacttctctrtaatctttttgacatttctcagtct

SEQ ID NO: 4190 - DNA, 51 bp, Artificial Sequence
  Synthetic polynucleotide
gctccactaggttggccagcatgccygcgaagaggtagagacccttgagca

SEQ ID NO: 4191 - DNA, 51 bp, Artificial Sequence
  Synthetic polynucleotide
tcagggaggtggcgtggctcgggccyggggaaaaacagagtcagggcccaa

SEQ ID NO: 4192 - DNA, 51 bp, Artificial Sequence
  Synthetic polynucleotide
tacttgcccacctggcagaaaatctrcttctacagttggggctgacagacc

SEQ ID NO: 4193 - DNA, 51 bp, Artificial Sequence
  Synthetic polynucleotide
ttgatcctgagctgaccgggtagccrtggccttgcggctcctgaagctggc

SEQ ID NO: 4194 - DNA, 51 bp, Artificial Sequence
  Synthetic polynucleotide
tggttgtacagcagtcgcctgctgcrgtactcagatgccttggagcacttg

SEQ ID NO: 4195 - DNA, 51 bp, Artificial Sequence
  Synthetic polynucleotide
tatttttcagattgttcagtttggcdtgaatgaaaaggttgggcaaatctc

SEQ ID NO: 4196 - DNA, 51 bp, Artificial Sequence
  Synthetic polynucleotide
tatttaccaaaagaacaatacctctrtaccaaagagcagctcttggatagg

SEQ ID NO: 4197 - DNA, 51 bp, Artificial Sequence
  Synthetic polynucleotide
caaaattctttgtatcttttcatctrgctaaaagaccagcttcaggacaaa

SEQ ID NO: 4198 - DNA, 51 bp, Artificial Sequence
  Synthetic polynucleotide
gaatctgtttcactgtcacacaggcragtgccttaattacagccttgtgtg

SEQ ID NO: 4199 - DNA, 51 bp, Artificial Sequence
  Synthetic polynucleotide
catgaatttgccctacaacagtacargttatccaaattattttggccacag

SEQ ID NO: 4200 - DNA, 51 bp, Artificial Sequence
  Synthetic polynucleotide
agcttacatgcagaatcctaatgccrtcatactgtgtattcaaggtaaatc

SEQ ID NO: 4201 - DNA, 51 bp, Artificial Sequence
  Synthetic polynucleotide
cgtgggctgaagctgacggggacctrtagcatcatgatccagaaggtacgg

SEQ ID NO: 4202 - DNA, 51 bp, Artificial Sequence
  Synthetic polynucleotide
tctacggggaagacctgcctgcccarggccttgctgaacctgagcaatggc

SEQ ID NO: 4203 - DNA, 51 bp, Artificial Sequence
  Synthetic polynucleotide
ggcccgtgggcgcttcttccagcccraggatgaggggggctacttctactt

SEQ ID NO: 4204 - DNA, 51 bp, Artificial Sequence
  Synthetic polynucleotide
gtctcggattgcaaagacggggaggrcgagtaccgctgtggtaaggtcatg

SEQ ID NO: 4205 - DNA, 51 bp, Artificial Sequence
  Synthetic polynucleotide
gatggatatctgagaatattcctatrgtgataacaaccgaacctacagatg

SEQ ID NO: 4206 - DNA, 51 bp, Artificial Sequence
  Synthetic polynucleotide
gtcctccagtggcctggacctgcccrtgaaggtggtggacatgttcgggtg

SEQ ID NO: 4207 - DNA, 51 bp, Artificial Sequence
  Synthetic polynucleotide
gctaatggtttggggttttattttcrggttactggagacaatgttaattcc

SEQ ID NO: 4208 - DNA, 51 bp, Artificial Sequence
  Synthetic polynucleotide
taccttctctcattttctcccagctrcatccgatactcccagatctgtgca

SEQ ID NO: 4209 - DNA, 51 bp, Artificial Sequence
  Synthetic polynucleotide
cacaacaccagacccgtcgtaggtaytggaagtactgaccaatgttccaaa

SEQ ID NO: 4210 - DNA, 51 bp, Artificial Sequence
  Synthetic polynucleotide
ctctgactgtacccccatgtttaggrggcagccatggccaagctggccgcc

SEQ ID NO: 4211 - DNA, 51 bp, Artificial Sequence
  Synthetic polynucleotide
gggggaccctactggcaggaggtcarggtaacagcataaatcttcattgtt

SEQ ID NO: 4212 - DNA, 51 bp, Artificial Sequence
  Synthetic polynucleotide
gaacccgaagctggagaaagcggagrtattggagttcgccgtgggctactt

SEQ ID NO: 4213 - DNA, 51 bp, Artificial Sequence
  Synthetic polynucleotide
ggacgggaaccgtcgctatgccaagragtgccaggtggagcggcaggaagg

SEQ ID NO: 4214 - DNA, 51 bp, Artificial Sequence
  Synthetic polynucleotide
ctcaaatttggattcagtagcagagratacgtcttgctccatgagtcgtcg

SEQ ID NO: 4215 - DNA, 51 bp, Artificial Sequence
  Synthetic polynucleotide
aattgaacacctctcctttcccaagrtaagagatcatctttaagaaaaggc

SEQ ID NO: 4216 - DNA, 51 bp, Artificial Sequence
  Synthetic polynucleotide
gtttttgttttccctcaaaggttcarcatacaaatttagggtcattgccat

SEQ ID NO: 4217 - DNA, 51 bp, Artificial Sequence
  Synthetic polynucleotide
agaccctgaggccgaggggggaacartggggcccttgagggcccctcctcc

SEQ ID NO: 4218 - DNA, 51 bp, Artificial Sequence
  Synthetic polynucleotide
tggatcctacccctcttttttctgcrgttgctgttctctgtgtctgtgact

SEQ ID NO: 4219 - DNA, 51 bp, Artificial Sequence
  Synthetic polynucleotide
ctcgaagacctggtgtttgtaggcartcccttggaagagaaacattctgct

SEQ ID NO: 4220 - DNA, 51 bp, Artificial Sequence
  Synthetic polynucleotide
agttttccctttattgctgaacggtytgaagcgtgcagagatggcatagaa

SEQ ID NO: 4221 - DNA, 51 bp, Artificial Sequence
  Synthetic polynucleotide
aatggacaagtataattttgatacartgatatatgtggtaagtaatcagaa

SEQ ID NO: 4222 - DNA, 51 bp, Artificial Sequence
  Synthetic polynucleotide
ctctgcgcgctccgggatccataccyggcaagcaatagcgcggcgaaagcc

SEQ ID NO: 4223 - DNA, 51 bp, Artificial Sequence
  Synthetic polynucleotide
tgtctcctgcaggaccggccgcagcrtggacgctcccaggcggtttccgac

SEQ ID NO: 4224 - DNA, 51 bp, Artificial Sequence
  Synthetic polynucleotide
taatcgtgccagttccaacataatcygtagagcaaagggctagattcatca

SEQ ID NO: 4225 - DNA, 51 bp, Artificial Sequence
  Synthetic polynucleotide
ttcgtccttgaccgcagggtcctggrtatgcccacccaagaactgggcctc

SEQ ID NO: 4226 - DNA, 51 bp, Artificial Sequence
  Synthetic polynucleotide
aacgggtatgagtgtgagtggcgctrtaacagctgtgcacctgcctgtcaa

SEQ ID NO: 4227 - DNA, 51 bp, Artificial Sequence
  Synthetic polynucleotide
accttacctatccacagcttcttgtytgtcatggtcaaaatcttgtaccat

SEQ ID NO: 4228 - DNA, 51 bp, Artificial Sequence
  Synthetic polynucleotide
gctgagaaatgtcttactctcttgcrgggagaatgctgttgaaagacttga

SEQ ID NO: 4229 - DNA, 51 bp, Artificial Sequence
  Synthetic polynucleotide
cggaccctggaggacctgacagaagrcagcatgtggtgggtcctgccccca

SEQ ID NO: 4230 - DNA, 51 bp, Artificial Sequence
  Synthetic polynucleotide
gaagtgacgtcaggcggccgcggagrtggaggatttgctcgacttggacga

SEQ ID NO: 4231 - DNA, 51 bp, Artificial Sequence
  Synthetic polynucleotide
aacatttggatcaacctcacaatcargtagtttttcaaaaattcataagcg

SEQ ID NO: 4232 - DNA, 51 bp, Artificial Sequence
  Synthetic polynucleotide
gtagtaaaaggacacatcttacataygtaggtagctgattttttggatgat

SEQ ID NO: 4233 - DNA, 51 bp, Artificial Sequence
  Synthetic polynucleotide
tttcaggaaggagaaaacattttctrtttggcagttgaagatatagaaaca

SEQ ID NO: 4234 - DNA, 51 bp, Artificial Sequence
  Synthetic polynucleotide
ctatagttctctgggggacttaccaytggggtctttcctgaatagtgtatt

SEQ ID NO: 4235 - DNA, 51 bp, Artificial Sequence
  Synthetic polynucleotide
accaactgagtttttcttccacacartggccggccgggaaggtctagtcga

SEQ ID NO: 4236 - DNA, 51 bp, Artificial Sequence
  Synthetic polynucleotide
tactggatctcggcccgcagctcctyggtgacgtagttcaccagcatggcc

SEQ ID NO: 4237 - DNA, 51 bp, Artificial Sequence
  Synthetic polynucleotide
tactttgccctcagcatctcccttcrtgtctgggtcatggtaagagtggca

SEQ ID NO: 4238 - DNA, 51 bp, Artificial Sequence
  Synthetic polynucleotide
ttcctccccacagcagcagtgttgtrctgctacttctataaacggacagcc

SEQ ID NO: 4239 - DNA, 51 bp, Artificial Sequence
  Synthetic polynucleotide
aaaggaacacgggcatatgcctgccrgtgtagctggagaactattgaagaa

SEQ ID NO: 4240 - DNA, 51 bp, Artificial Sequence
  Synthetic polynucleotide
cccaagtggccgcaggcagatggatrtgtgggggacacgcagcaggtgagg

SEQ ID NO: 4241 - DNA, 51 bp, Artificial Sequence
  Synthetic polynucleotide
agcagtgagacatactttcttggtgyccacagaggtatacagaagcaccat

SEQ ID NO: 4242 - DNA, 51 bp, Artificial Sequence
  Synthetic polynucleotide
agcctgcaggaggagctgaaccaggraaaggggcagaaggaggtgctgctg

SEQ ID NO: 4243 - DNA, 51 bp, Artificial Sequence
  Synthetic polynucleotide
caaggacaagcccgtttctttccacragtgaggaccctgcgcgcctcgcgg

SEQ ID NO: 4244 - DNA, 51 bp, Artificial Sequence
  Synthetic polynucleotide
aacaaacggcaaatgagtcgcatttrccccaagggaggccgagtcgattcc

SEQ ID NO: 4245 - DNA, 51 bp, Artificial Sequence
  Synthetic polynucleotide
cactacttcatcagttcttcccatavcacttatctcactggcagacagttc

SEQ ID NO: 4246 - DNA, 51 bp, Artificial Sequence
  Synthetic polynucleotide
gggagacggcgggatctctttcgccrtggctgccgggccgatctccgagcg

SEQ ID NO: 4247 - DNA, 51 bp, Artificial Sequence
  Synthetic polynucleotide
tgggacatagaacgaggagagaattrtatactgagtccagatgagaagttt

SEQ ID NO: 4248 - DNA, 51 bp, Artificial Sequence
  Synthetic polynucleotide
gacagaagacgaagtggagaagttgrtggctgggcaagaggactccaatgg

SEQ ID NO: 4249 - DNA, 51 bp, Artificial Sequence
  Synthetic polynucleotide
atatctcagcttctaagagagagctrtttagctgaaaccagacatcgggga

SEQ ID NO: 4250 - DNA, 51 bp, Artificial Sequence
  Synthetic polynucleotide
tgagtttgcggagaggtcagtaactraattggagaaaagcattgatgactt

SEQ ID NO: 4251 - DNA, 51 bp, Artificial Sequence
  Synthetic polynucleotide
agctgcttacacagagaagtctgctrcatatgtcaacactgagggtagagc

SEQ ID NO: 4252 - DNA, 51 bp, Artificial Sequence
  Synthetic polynucleotide
aattccttttattgaaacatcagcaragacaagacaggtaagtaacactga

SEQ ID NO: 4253 - DNA, 51 bp, Artificial Sequence
  Synthetic polynucleotide
gaagatgaactcatctgcaaaaacahcacgtaggaagcgaaagcaactgta

SEQ ID NO: 4254 - DNA, 51 bp, Artificial Sequence
  Synthetic polynucleotide
ggcacccgtcggaagtccagaatccygcaagagaggaagctctgttccatc

SEQ ID NO: 4255 - DNA, 51 bp, Artificial Sequence
  Synthetic polynucleotide
aggctttctcatcttgactgtaatcygcaaaggaggagaagggcaatgaga

SEQ ID NO: 4256 - DNA, 51 bp, Artificial Sequence
  Synthetic polynucleotide
ctgcttcacatcttcacggtcaacaracagctggggcccaagatcgtcatc

SEQ ID NO: 4257 - DNA, 51 bp, Artificial Sequence
  Synthetic polynucleotide
gctgtcgcccgcagatttcttcgccragcgcaagagatcagcgcctgagaa

SEQ ID NO: 4258 - DNA, 51 bp, Artificial Sequence
  Synthetic polynucleotide
agtgtgcctctgtttttcctttgacrggaaatcgatgattgtctggtccaa

SEQ ID NO: 4259 - DNA, 51 bp, Artificial Sequence
  Synthetic polynucleotide
tgtgacattcttcgacacgccccccrtgctctttgtgttcattgccctggg

SEQ ID NO: 4260 - DNA, 51 bp, Artificial Sequence
  Synthetic polynucleotide
gtccacacccatgctctgcagcgtgygcacagccagggcagcctcctgctt

SEQ ID NO: 4261 - DNA, 51 bp, Artificial Sequence
  Synthetic polynucleotide
acattttgtgtttatgttatttgcartgttttctatggaaatatttcacag

SEQ ID NO: 4262 - DNA, 51 bp, Artificial Sequence
  Synthetic polynucleotide
gctcgaggcctggcttgagatgaggytctcattgtgaaaccactgtgtgga

SEQ ID NO: 4263 - DNA, 51 bp, Artificial Sequence
  Synthetic polynucleotide
tatggctgcgtggtgaacttgcggargacagtggtgaacttccctgtagaa

SEQ ID NO: 4264 - DNA, 51 bp, Artificial Sequence
  Synthetic polynucleotide
gttgatcaaaccaccgtggacacctyctttgcccatcagcaggactagcgc

SEQ ID NO: 4265 - DNA, 51 bp, Artificial Sequence
  Synthetic polynucleotide
gttgcacagaagtcatatggaaatgraaaaaggtaagattatttttctggt

SEQ ID NO: 4266 - DNA, 51 bp, Artificial Sequence
  Synthetic polynucleotide
gataaaagtcatctccaaaccttccraaaagaagcagtcattgaaaaatgc

SEQ ID NO: 4267 - DNA, 51 bp, Artificial Sequence
  Synthetic polynucleotide
ggtcatcctggcccctttgcagagaracactgcagaagctaagacatagga

SEQ ID NO: 4268 - DNA, 51 bp, Artificial Sequence
  Synthetic polynucleotide
cacagaaacatcaaaaagtaggtccygtttcttttcagaagctcgatcaca

SEQ ID NO: 4269 - DNA, 51 bp, Artificial Sequence
  Synthetic polynucleotide
aaaatctctagtgttctaagctacarcgaaaaactgctgaaagaaaaggaa

SEQ ID NO: 4270 - DNA, 51 bp, Artificial Sequence
  Synthetic polynucleotide
gacatttcccctcaagcaccaacacrttttctggtgatacccaagaaacat

SEQ ID NO: 4271 - DNA, 51 bp, Artificial Sequence
  Synthetic polynucleotide
gagctgggtgaagcagctgatgaggyagatgcacacaaaggcattctggac

SEQ ID NO: 4272 - DNA, 51 bp, Artificial Sequence
  Synthetic polynucleotide
gctggggccaactggaaccattggcrgctgcacgctcattactaccctccg

SEQ ID NO: 4273 - DNA, 51 bp, Artificial Sequence
  Synthetic polynucleotide
acttgctgagtgtgtttctcaaacartttaatttcaggagcctacaagaaa

SEQ ID NO: 4274 - DNA, 51 bp, Artificial Sequence
  Synthetic polynucleotide
gcaaagcatggattcaaacttaggtrttggaaccaggtttttgtgtttgcc

SEQ ID NO: 4275 - DNA, 51 bp, Artificial Sequence
  Synthetic polynucleotide
tgatgggttgtgtttggtttctttcvgcatgattttgaagtcagaggagat

SEQ ID NO: 4276 - DNA, 51 bp, Artificial Sequence
  Synthetic polynucleotide
gtgcagccagatgcctggacagaggrcaatggcttccatggtaaggtgcct

SEQ ID NO: 4277 - DNA, 51 bp, Artificial Sequence
  Synthetic polynucleotide
tatgctatacatgatgaaacatcttrtaaaggaaaaaaaataccgaaagac

SEQ ID NO: 4278 - DNA, 51 bp, Artificial Sequence
  Synthetic polynucleotide
acaattttcccctttttttacccccrgtggtatgtgggagtttgtttcata

SEQ ID NO: 4279 - DNA, 51 bp, Artificial Sequence
  Synthetic polynucleotide
  misc_feature (26)..(26): n is a, c, g, t or u
aaagtggccattattgaacttacagntgggtggtatgctgttaaggcccag

SEQ ID NO: 4280 - DNA, 51 bp, Artificial Sequence
  Synthetic polynucleotide
gaattaataatccttttgttttcttdgaaaacacaacaaaaccatatttac

SEQ ID NO: 4281 - DNA, 51 bp, Artificial Sequence
  Synthetic polynucleotide
aataatggaacccttgttgaccgctrccgtaaacacaacctctactttgag

SEQ ID NO: 4282 - DNA, 51 bp, Artificial Sequence
  Synthetic polynucleotide
acccctctggagtccttttggtaccrtgacatggaaaatcccaaaagtcac

SEQ ID NO: 4283 - DNA, 51 bp, Artificial Sequence
  Synthetic polynucleotide
atcatgaagaagctcttgaccaagtrtgacaacctctttgagacgtccttt

SEQ ID NO: 4284 - DNA, 51 bp, Artificial Sequence
  Synthetic polynucleotide
tgttacgtggttgccctgggagcccrcaccggggaggagagcgtggctgac

SEQ ID NO: 4285 - DNA, 51 bp, Artificial Sequence
  Synthetic polynucleotide
caccaccaaagtggatgcactgaagragatgttgttggatcaggtgagcag

SEQ ID NO: 4286 - DNA, 51 bp, Artificial Sequence
  Synthetic polynucleotide
gttgctgccccctttgatgatgatgrcaagatcgttgggggctacaactgt

SEQ ID NO: 4287 - DNA, 51 bp, Artificial Sequence
  Synthetic polynucleotide
gactaaccctgcagtgctttccctcrgtgcatccaccgggacgtggcagcg

SEQ ID NO: 4288 - DNA, 51 bp, Artificial Sequence
  Synthetic polynucleotide
gaaaacgtttctttttctttgttctrggtggttctggaatggagccgagat

SEQ ID NO: 4289 - DNA, 51 bp, Artificial Sequence
  Synthetic polynucleotide
aaatattatatatcacatattttcarcagggcctcagggtgtggaagggcc

SEQ ID NO: 4290 - DNA, 51 bp, Artificial Sequence
  Synthetic polynucleotide
  misc_feature (26)..(26): n is a, c, g, t or u
tgggaatgctttatggcttaatgaangagagtgctcaattcagagaagaaa

SEQ ID NO: 4291 - DNA, 51 bp, Artificial Sequence
  Synthetic polynucleotide
tctcttcttgaaacagtggagcatcrtacagagtttacttgtggtttagac

SEQ ID NO: 4292 - DNA, 51 bp, Artificial Sequence
  Synthetic polynucleotide
acaacgtccttggagaaaacatgcaratattccattgtaaacaaatcaaag

SEQ ID NO: 4293 - DNA, 51 bp, Artificial Sequence
  Synthetic polynucleotide
tcaaaggaaaaatacatttaagattvtaagtctggttataagcttaaaaag

SEQ ID NO: 4294 - DNA, 51 bp, Artificial Sequence
  Synthetic polynucleotide
gcggcagagcgccagcgagcgggagraactgcgcatgcgcacgctggcccg

SEQ ID NO: 4295 - DNA, 51 bp, Artificial Sequence
  Synthetic polynucleotide
taggggaggccataaggagcgccccrcagtcatgctgtttccctttaggaa

SEQ ID NO: 4296 - DNA, 51 bp, Artificial Sequence
  Synthetic polynucleotide
ccccacagtcatgctgtttccctttrggaatctcggctcaccaacccaggt

SEQ ID NO: 4297 - DNA, 51 bp, Artificial Sequence
  Synthetic polynucleotide
acaacacgctgaagaatttcttatcraacctgaatccaaagttgctaagtt

SEQ ID NO: 4298 - DNA, 51 bp, Artificial Sequence
  Synthetic polynucleotide
agaatttcttatcaaacctgaatccraagttgctaagttggacacgtctca

SEQ ID NO: 4299 - DNA, 51 bp, Artificial Sequence
  Synthetic polynucleotide
gaattttgataagctgaatgtaaggrcaacacactatacacctcttgcatg

SEQ ID NO: 4300 - DNA, 51 bp, Artificial Sequence
  Synthetic polynucleotide
gtaaatgccatctgctatggggccargattatgcttccaggtgttcttcga

SEQ ID NO: 4301 - DNA, 51 bp, Artificial Sequence
  Synthetic polynucleotide
gcatgtcgtcttcccacttgcaataytgccctcgacacagatctggcaaaa

SEQ ID NO: 4302 - DNA, 51 bp, Artificial Sequence
  Synthetic polynucleotide
aaccaacaacccactcaccagaggaytgtggccacggacatttctccactt

SEQ ID NO: 4303 - DNA, 51 bp, Artificial Sequence
  Synthetic polynucleotide
agtttaccttcggaccaatcctgagrcttgttaccagaggttaaagaagag

SEQ ID NO: 4304 - DNA, 51 bp, Artificial Sequence
  Synthetic polynucleotide
tttattttctctttggttttatcgtrggtttatttgacatggcctgtgcca

SEQ ID NO: 4305 - DNA, 51 bp, Artificial Sequence
  Synthetic polynucleotide
ttcacatcgcggaaagtccctgctcrcatgcctcacatgattgaccggatt

SEQ ID NO: 4306 - DNA, 51 bp, Artificial Sequence
  Synthetic polynucleotide
aggaagtttgtttgcctgaatgacarcattgaccacaatcataaagatgct

SEQ ID NO: 4307 - DNA, 51 bp, Artificial Sequence
  Synthetic polynucleotide
agcaaaaatactgggaggcaactaaragatacatttgcagattccctcaga

SEQ ID NO: 4308 - DNA, 51 bp, Artificial Sequence
  Synthetic polynucleotide
tccacgctgctctgcagcctgtgctrcggcgacatggagaacaagctgttt

SEQ ID NO: 4309 - DNA, 51 bp, Artificial Sequence
  Synthetic polynucleotide
tagagaaactggagcagctcattttrgaagggtaagaaagagctcattaaa

SEQ ID NO: 4310 - DNA, 51 bp, Artificial Sequence
  Synthetic polynucleotide
tttggctgacctgcctagaaatattrtgttgaataatgatgagttggaatt

SEQ ID NO: 4311 - DNA, 51 bp, Artificial Sequence
  Synthetic polynucleotide
ttcaaagcaaattgacaaatcctctrtgtacaagtttttagaaccatggct

SEQ ID NO: 4312 - DNA, 51 bp, Artificial Sequence
  Synthetic polynucleotide
cttatgtttaaagaaggatgggaacrcaaaaagagccttcagatcctacat

SEQ ID NO: 4313 - DNA, 51 bp, Artificial Sequence
  Synthetic polynucleotide
ggtgggcctgggaggggtggtggccdttttttgtctaaccctaactgagaa

SEQ ID NO: 4314 - DNA, 51 bp, Artificial Sequence
  Synthetic polynucleotide
gaggggtggtggccattttttgtctraccctaactgagaagggcgtaggcg

SEQ ID NO: 4315 - DNA, 51 bp, Artificial Sequence
  Synthetic polynucleotide
catgtgtttcctctttgaaacagagratgctctcatcactcagtcaaggct

SEQ ID NO: 4316 - DNA, 51 bp, Artificial Sequence
  Synthetic polynucleotide
gccgttagcctgatcatcttcacctrctacaccgcctgggtgattctcttg

SEQ ID NO: 4317 - DNA, 51 bp, Artificial Sequence
  Synthetic polynucleotide
ggagagacatcgtcagctacgtcatrgaccacttcgacattgagatcatgg

SEQ ID NO: 4318 - DNA, 51 bp, Artificial Sequence
  Synthetic polynucleotide
ttatgttctatttcagtgtcatcctrgtggctgtttgatagacctctgcct

SEQ ID NO: 4319 - DNA, 51 bp, Artificial Sequence
  Synthetic polynucleotide
cctttttacatagaaaaggttcatgragaaattgaaagagtcattggcgcc

SEQ ID NO: 4320 - DNA, 51 bp, Artificial Sequence
  Synthetic polynucleotide
ggtgtgctctttgtgaaattccaccrtggcgtaccgtggccagggtcagaa

SEQ ID NO: 4321 - DNA, 51 bp, Artificial Sequence
  Synthetic polynucleotide
acctgtgttgtggtttacactggatrtggaaatagagaggagcaaaatctg

SEQ ID NO: 4322 - DNA, 51 bp, Artificial Sequence
  Synthetic polynucleotide
catgcagagaaccatgcgcacacgcragcgcagaaagatgtatgagatgtg

SEQ ID NO: 4323 - DNA, 51 bp, Artificial Sequence
  Synthetic polynucleotide
tgttcagtgtcaatgtatcttggcaytggaaatctggagtgaagaatttcc

SEQ ID NO: 4324 - DNA, 51 bp, Artificial Sequence
  Synthetic polynucleotide
accctccacggctgcgtcactcgggyaataataggtgatgatctccgtcac

SEQ ID NO: 4325 - DNA, 51 bp, Artificial Sequence
  Synthetic polynucleotide
gtgactgtcaggacccttctgagcayggcagtgatggttgctctgggcagc

SEQ ID NO: 4326 - DNA, 51 bp, Artificial Sequence
  Synthetic polynucleotide
cactatcactgccctgctccacaatratcggaaactcctggaaaaacacat

SEQ ID NO: 4327 - DNA, 51 bp, Artificial Sequence
  Synthetic polynucleotide
ataaactaatacaccagtcttgtaarccggagatgaaaacctttttccaag

SEQ ID NO: 4328 - DNA, 51 bp, Artificial Sequence
  Synthetic polynucleotide
tttttttacttttctagatttgaaarttgtggaatttttattgttatgttg

SEQ ID NO: 4329 - DNA, 51 bp, Artificial Sequence
  Synthetic polynucleotide
ccggtcggagtaaacacagaatgctrtcgaatctatgaggcttgctcctat

SEQ ID NO: 4330 - DNA, 51 bp, Artificial Sequence
  Synthetic polynucleotide
actgatttttttctcctccccccacrggagatccaccacctgcatcacctg

SEQ ID NO: 4331 - DNA, 51 bp, Artificial Sequence
  Synthetic polynucleotide
ggatttgtttgcttttttcctgtacrggaaactggatgccttcatctatga

SEQ ID NO: 4332 - DNA, 51 bp, Artificial Sequence
  Synthetic polynucleotide
attctctacgtggatttggatctgcrccatggagatggtaagccctttggt

SEQ ID NO: 4333 - DNA, 51 bp, Artificial Sequence
  Synthetic polynucleotide
acactatcctctgagatcccagatcrtgaggtaagtaaggctctgacaagt

SEQ ID NO: 4334 - DNA, 51 bp, Artificial Sequence
  Synthetic polynucleotide
gcagacctgcgcaagctggcggtgarcatggtgcccttccctcgcctgcac

SEQ ID NO: 4335 - DNA, 51 bp, Artificial Sequence
  Synthetic polynucleotide
attgctgaatgttcacaggatggcartggttatatcagtgcagcagaacta

SEQ ID NO: 4336 - DNA, 51 bp, Artificial Sequence
  Synthetic polynucleotide
gccccacccacccccctgcagtgtcrtgcggttcctggtgtccaagcggaa

SEQ ID NO: 4337 - DNA, 51 bp, Artificial Sequence
  Synthetic polynucleotide
tgtattcttttttcgttttcctgtargttcgaagcattcagcaaacaatgg

SEQ ID NO: 4338 - DNA, 51 bp, Artificial Sequence
  Synthetic polynucleotide
tgaacaatcatcagctggaactggcraagcagctacacaaagagggtcatc

SEQ ID NO: 4339 - DNA, 51 bp, Artificial Sequence
  Synthetic polynucleotide
ccccatcaggtatgacaatcggtgcrggaacatgagccaggagcaggtggc

SEQ ID NO: 4340 - DNA, 51 bp, Artificial Sequence
  Synthetic polynucleotide
tgccttgtacaactacatctttgctragaagtaccaggggagcttcatcct

SEQ ID NO: 4341 - DNA, 51 bp, Artificial Sequence
  Synthetic polynucleotide
acccttcatggatcagcattatttcraagaggacaaacacaggtaatttat

SEQ ID NO: 4342 - DNA, 51 bp, Artificial Sequence
  Synthetic polynucleotide
cctttcaccataagagttacatctgragtcctagagtcaaatggtatggta

SEQ ID NO: 4343 - DNA, 51 bp, Artificial Sequence
  Synthetic polynucleotide
attttttttttaacagatttggttcrtttgacttgcacatcttctaaaaca

SEQ ID NO: 4344 - DNA, 51 bp, Artificial Sequence
  Synthetic polynucleotide
ttgtgttttgtgatggaatatgttartgggggcgaggtgagtcaagaagta

SEQ ID NO: 4345 - DNA, 51 bp, Artificial Sequence
  Synthetic polynucleotide
cccagcaggaagaagggggacaactrttacctgaatcggactcacatgctg

SEQ ID NO: 4346 - DNA, 51 bp, Artificial Sequence
  Synthetic polynucleotide
caagtgccgggaatcatttcacgggrgtccgctgggcggccagcagtgcta

SEQ ID NO: 4347 - DNA, 51 bp, Artificial Sequence
  Synthetic polynucleotide
cctcatcgtctccttttcatcctctrggtcctctggacacagacatgcagc

SEQ ID NO: 4348 - DNA, 51 bp, Artificial Sequence
  Synthetic polynucleotide
gaccgcaatgtggccaccccacgagrctactactttgctctggcccatacc

SEQ ID NO: 4349 - DNA, 51 bp, Artificial Sequence
  Synthetic polynucleotide
ttacttagtatttgcttttcaggacrtgtgaatttctctgatgaggtcaca

SEQ ID NO: 4350 - DNA, 51 bp, Artificial Sequence
  Synthetic polynucleotide
gctgttcaacatgaaaccttaaactrtataggtctgctggactgtgtggct

SEQ ID NO: 4351 - DNA, 51 bp, Artificial Sequence
  Synthetic polynucleotide
aagaaagacgtttttgatttttttcrgacttctctggctccactaccctgc

SEQ ID NO: 4352 - DNA, 51 bp, Artificial Sequence
  Synthetic polynucleotide
tggagcatcctgtgaagatatagctrgagtctgtcatgcacatccggtaat

SEQ ID NO: 4353 - DNA, 51 bp, Artificial Sequence
  Synthetic polynucleotide
  misc_feature (26)..(26): n is a, c, g, t or u
actaacattaagaacaaacaaacccntatttttagtttcccaagtctatct

SEQ ID NO: 4354 - DNA, 51 bp, Artificial Sequence
  Synthetic polynucleotide
agagatgagagaccactctttccccragtaagtaaaagcttcatgctatcc

SEQ ID NO: 4355 - DNA, 51 bp, Artificial Sequence
  Synthetic polynucleotide
gtaggcaagagtgccttgacgatacdgctaattcagaatcattttgtggac

SEQ ID NO: 4356 - DNA, 51 bp, Artificial Sequence
  Synthetic polynucleotide
actttttatgtatttcagggtgttgdtgatgccttctatacattagttcga

SEQ ID NO: 4357 - DNA, 51 bp, Artificial Sequence
  Synthetic polynucleotide
tagtaaaagtaaccctggagacttcrcactttccgttaggtaagttggaat

SEQ ID NO: 4358 - DNA, 51 bp, Artificial Sequence
  Synthetic polynucleotide
  misc_feature (26)..(26): n is a, c, g, t or u
agctgtcacccacatcaagattcagnacactggtgattactatgacctgta

SEQ ID NO: 4359 - DNA, 51 bp, Artificial Sequence
  Synthetic polynucleotide
tttctttctttccagacactacaacracaggagtgcaaacttctctacagc

SEQ ID NO: 4360 - DNA, 51 bp, Artificial Sequence
  Synthetic polynucleotide
caaaaacaaaaatagatataaaaacrtcctgccctgtaagtatcaatattc

SEQ ID NO: 4361 - DNA, 51 bp, Artificial Sequence
  Synthetic polynucleotide
gatggtgcggtctcagaggtcagggrtggtccagacagaagcacagtaccg

SEQ ID NO: 4362 - DNA, 51 bp, Artificial Sequence
  Synthetic polynucleotide
acttgtggctacaaatttcatgagcrctgtagcaccaaagtacctactatg

SEQ ID NO: 4363 - DNA, 51 bp, Artificial Sequence
  Synthetic polynucleotide
aattgtgacccagtggtgcgagggcrgcagcctctacaaacacctgcatgt

SEQ ID NO: 4364 - DNA, 51 bp, Artificial Sequence
  Synthetic polynucleotide
tattaaagtggcaatgtgtgctgacraggtaggaaactgagcttttctatt

SEQ ID NO: 4365 - DNA, 51 bp, Artificial Sequence
  Synthetic polynucleotide
gcggctggaagcctttctcacccagraagccaaggtcggcgaactcaaaga

SEQ ID NO: 4366 - DNA, 51 bp, Artificial Sequence
  Synthetic polynucleotide
ggagaatgaaggaaggctggtgcacrtcattggcgccttacggacatccaa

SEQ ID NO: 4367 - DNA, 51 bp, Artificial Sequence
  Synthetic polynucleotide
ctgatggctgcagccatgacaagcargtgggtggcagatgctcttgggcgg

SEQ ID NO: 4368 - DNA, 51 bp, Artificial Sequence
  Synthetic polynucleotide
ccttctttcttctaggtcagctactrttttcccctcaaaacattgtggcgt

SEQ ID NO: 4369 - DNA, 51 bp, Artificial Sequence
  Synthetic polynucleotide
ggcgtggacttcgagggcacgttccrtgtgaacacggtcacggatgacgac

SEQ ID NO: 4370 - DNA, 51 bp, Artificial Sequence
  Synthetic polynucleotide
aatggcacgttcacttgtgacgtcaraaaccctccagacatagtgggcaag

SEQ ID NO: 4371 - DNA, 51 bp, Artificial Sequence
  Synthetic polynucleotide
aaggatggctccattgtcatacacarcctagactacagtgacaatggcacg

SEQ ID NO: 4372 - DNA, 51 bp, Artificial Sequence
  Synthetic polynucleotide
gcagatcacttacaaagatgtggctdtgaatattcactttctgttttcttt

SEQ ID NO: 4373 - DNA, 51 bp, Artificial Sequence
  Synthetic polynucleotide
tattcactttctgttttctttccagraagtggtttggcaaaagaaaaggta

SEQ ID NO: 4374 - DNA, 51 bp, Artificial Sequence
  Synthetic polynucleotide
taaaagtgaaatattttcttttaacrggtttcaggatctgataaagaaaat

SEQ ID NO: 4375 - DNA, 51 bp, Artificial Sequence
  Synthetic polynucleotide
gctgctgctcaactactgccagtgcdagctggtggtcgaggagtactacga

SEQ ID NO: 4376 - DNA, 51 bp, Artificial Sequence
  Synthetic polynucleotide
gagaaggcgcagctccaggacctcartgaccgcttcgccagcttcatcgag

SEQ ID NO: 4377 - DNA, 51 bp, Artificial Sequence
  Synthetic polynucleotide
atatctcaagtctttgatgaagttgrtacagatcaatctggtgtcttgtct

SEQ ID NO: 4378 - DNA, 51 bp, Artificial Sequence
  Synthetic polynucleotide
taaagctaacttttatttttcctatrgagaatggactctctctgattttgt

SEQ ID NO: 4379 - DNA, 51 bp, Artificial Sequence
  Synthetic polynucleotide
acaagaatccatccttctccccaggrtaagtccagaaggcaagtgtgagag

SEQ ID NO: 4380 - DNA, 51 bp, Artificial Sequence
  Synthetic polynucleotide
gaatgaaattttagataagctggccrggtattataactgttgaactaatac

SEQ ID NO: 4381 - DNA, 51 bp, Artificial Sequence
  Synthetic polynucleotide
cagtgaggagtatgggctggtggtargtagccccctcaaccccagtctcca

SEQ ID NO: 4382 - DNA, 51 bp, Artificial Sequence
  Synthetic polynucleotide
attttgcaaactcgtaatttctttcrggaggaggcaaaacagattcagaat

SEQ ID NO: 4383 - DNA, 51 bp, Artificial Sequence
  Synthetic polynucleotide
ccagttcagctacctggaaccaggtrtggcctgcaccagccgcccatcatg

SEQ ID NO: 4384 - DNA, 51 bp, Artificial Sequence
  Synthetic polynucleotide
gacgatgatgccaatggtgatgtggrtgtggaagaaagtgatgaggtgagc

SEQ ID NO: 4385 - DNA, 51 bp, Artificial Sequence
  Synthetic polynucleotide
ccaacagtgaaacacagcaccttccrtggtgaggataagctcatcagcgtg

SEQ ID NO: 4386 - DNA, 51 bp, Artificial Sequence
  Synthetic polynucleotide
ggctaagagctgttcctgctccaccygagaggcacagggttgagtgtcata

SEQ ID NO: 4387 - DNA, 51 bp, Artificial Sequence
  Synthetic polynucleotide
ggcggagccgggccagagacggatgyctgacgggtagcctgtggggggccc

SEQ ID NO: 4388 - DNA, 51 bp, Artificial Sequence
  Synthetic polynucleotide
tatttgggatagctatacaacaaatraggtagaatttcttcataattcttt

SEQ ID NO: 4389 - DNA, 51 bp, Artificial Sequence
  Synthetic polynucleotide
ctgaacctagagcttcagacgccctrtggcgtccgcctcgacccaaccggc

SEQ ID NO: 4390 - DNA, 51 bp, Artificial Sequence
  Synthetic polynucleotide
gggagatgaagtcaactggtatctgrtgggaatgggcaatgaaatagactt

SEQ ID NO: 4391 - DNA, 51 bp, Artificial Sequence
  Synthetic polynucleotide
aatattaacaacataattattttatrgctagacagataagtttacagcagc

SEQ ID NO: 4392 - DNA, 51 bp, Artificial Sequence
  Synthetic polynucleotide
tttcaaaagggcttgaatgaggagtrgctttgccacatcttgatctgctca

SEQ ID NO: 4393 - DNA, 51 bp, Artificial Sequence
  Synthetic polynucleotide
ggatcttttcctgtaggtggctcgtragttggtgatcattgaaggagactt

SEQ ID NO: 4394 - DNA, 51 bp, Artificial Sequence
  Synthetic polynucleotide
agagacccgtgctgagtttgctgagrgatcggtagccaagctggaaaagac

SEQ ID NO: 4395 - DNA, 51 bp, Artificial Sequence
  Synthetic polynucleotide
gcattaaacacttttttccccctgcrgtgactcagcggtgttttttgaaca

SEQ ID NO: 4396 - DNA, 51 bp, Artificial Sequence
  Synthetic polynucleotide
cctgttttgcagaaagggggccctgrggcagaaggtggtccacgaagtcaa

SEQ ID NO: 4397 - DNA, 51 bp, Artificial Sequence
  Synthetic polynucleotide
gtgttttgttttgttgtgtttttctrgaggatttcaacaagctgtgctctg

SEQ ID NO: 4398 - DNA, 51 bp, Artificial Sequence
  Synthetic polynucleotide
acccggatttgccacaaaagaaattrcaaatggaaagcctttcttcaaagg

SEQ ID NO: 4399 - DNA, 51 bp, Artificial Sequence
  Synthetic polynucleotide
ggcctgtaatcctgcctgcttcatcrcacagctcctccctgtgaaaaggaa

SEQ ID NO: 4400 - DNA, 51 bp, Artificial Sequence
  Synthetic polynucleotide
acttcaacggccccttctgttctacrgcaagtaagttcccctctggatggc

SEQ ID NO: 4401 - DNA, 51 bp, Artificial Sequence
  Synthetic polynucleotide
gtcagcctcgtcggcaggtgtgacgycgtcaatggtcagtttgtggaccct

SEQ ID NO: 4402 - DNA, 51 bp, Artificial Sequence
  Synthetic polynucleotide
ctctgaactacattgtgtcttctgcrgaacctcccaagatccacctggact

SEQ ID NO: 4403 - DNA, 51 bp, Artificial Sequence
  Synthetic polynucleotide
gggccgcaggtgcgtctggcacgtcbggatggggtgggatggacccacatc

SEQ ID NO: 4404 - DNA, 51 bp, Artificial Sequence
  Synthetic polynucleotide
gtggcttcttgctaaaagctgagacygaagggccaggtggaggctacagcg

SEQ ID NO: 4405 - DNA, 51 bp, Artificial Sequence
  Synthetic polynucleotide
ggccacagcctagactgcgggacacrgggactcgaagctggaggcaccagc

SEQ ID NO: 4406 - DNA, 51 bp, Artificial Sequence
  Synthetic polynucleotide
agcggccatccctgagggacagttcrttgatagcaggaagggggcagagaa

SEQ ID NO: 4407 - DNA, 51 bp, Artificial Sequence
  Synthetic polynucleotide
ctcccctctgttcctcaccttcaggdacaagacaacctggcagatgctgag

SEQ ID NO: 4408 - DNA, 51 bp, Artificial Sequence
  Synthetic polynucleotide
ccttaccccatccctgtgcccctgcrgctttgagcagctctgcatcaactt

SEQ ID NO: 4409 - DNA, 51 bp, Artificial Sequence
  Synthetic polynucleotide
gtgccagggaaggatcccatggccgrttccatcttccactattaccaggtg

SEQ ID NO: 4410 - DNA, 51 bp, Artificial Sequence
  Synthetic polynucleotide
ctctctatgccctttctgctcccccrggatatcctcaccactcatcccttc

SEQ ID NO: 4411 - DNA, 51 bp, Artificial Sequence
  Synthetic polynucleotide
ccctcctcgctgtcctctggctcgcrggtcatggcagcgccaggcggcagg

SEQ ID NO: 4412 - DNA, 51 bp, Artificial Sequence
  Synthetic polynucleotide
attacaccatcgatgggaaccaggtdtgggtgcccttttgctgaactggtt

SEQ ID NO: 4413 - DNA, 51 bp, Artificial Sequence
  Synthetic polynucleotide
gatttggtttttgcccttccagtgtrtactctgaaagagcgatgcctccag

SEQ ID NO: 4414 - DNA, 51 bp, Artificial Sequence
  Synthetic polynucleotide
aaatattatttttttaaatgaatccrggagctgtgcggtcttatgcattgg

SEQ ID NO: 4415 - DNA, 51 bp, Artificial Sequence
  Synthetic polynucleotide
cagagcaaaccgcccagagtagaagrtggattggggcacgctgcagacgat

SEQ ID NO: 4416 - DNA, 51 bp, Artificial Sequence
  Synthetic polynucleotide
gtgtctggaatttgcatcctgctgartgtcactgaattgtgttatttgcta

SEQ ID NO: 4417 - DNA, 51 bp, Artificial Sequence
  Synthetic polynucleotide
  misc_feature (26)..(26): n is a, c, g, t or u
ttggatattctcgacacagcaggtcnagaggagtacagtgcaatgagggac

SEQ ID NO: 4418 - DNA, 51 bp, Artificial Sequence
  Synthetic polynucleotide
gatcctctctctgaaatcactgagcrggagaaagattttctatggagtcac

SEQ ID NO: 4419 - DNA, 51 bp, Artificial Sequence
  Synthetic polynucleotide
tgatgacattgcatacattcgaaagrccctagccttagataaaactgagca

SEQ ID NO: 4420 - DNA, 51 bp, Artificial Sequence
  Synthetic polynucleotide
ttcttcatgatttaatttttttcccrgatcaggtttcattgttgctgaaat

SEQ ID NO: 4421 - DNA, 51 bp, Artificial Sequence
  Synthetic polynucleotide
ttatttgtttgtttgttttgtcactrgcacggggattctaaccttagggaa

SEQ ID NO: 4422 - DNA, 51 bp, Artificial Sequence
  Synthetic polynucleotide
atcttcaaccaaggcatgatctggtrggccagctgttggacagcttatcac

SEQ ID NO: 4423 - DNA, 51 bp, Artificial Sequence
  Synthetic polynucleotide
caacttaacctgttaattttcttacrgggaacaagccatcaagcccacctg

SEQ ID NO: 4424 - DNA, 51 bp, Artificial Sequence
  Synthetic polynucleotide
cccgtcactgaagatgttgtatgtcyacagaaggacagaagcaaaagggat

SEQ ID NO: 4425 - DNA, 51 bp, Artificial Sequence
  Synthetic polynucleotide
ataatgcataacctttccctgatgcrggaaggaactgtgagctgtgcaagg

SEQ ID NO: 4426 - DNA, 51 bp, Artificial Sequence
  Synthetic polynucleotide
gatgttcctgcttgtcttttgctttrgatatgagcttctgagacgtaaaat

SEQ ID NO: 4427 - DNA, 51 bp, Artificial Sequence
  Synthetic polynucleotide
ggcctcacgcacttcctgatgaacgrggtcatcaagctgcagcagcagatg

SEQ ID NO: 4428 - DNA, 51 bp, Artificial Sequence
  Synthetic polynucleotide
caccgctgtcccctctgctggtgacrgcacgcagtggaagcactctggaag

SEQ ID NO: 4429 - DNA, 51 bp, Artificial Sequence
  Synthetic polynucleotide
tcattggcctcccttgtgcctgtgcrggaggagctgattaactcagtggtc

SEQ ID NO: 4430 - DNA, 51 bp, Artificial Sequence
  Synthetic polynucleotide
ccctgaccaccctctccattaccgcdgctctggccaggctgccgcacctct

SEQ ID NO: 4431 - DNA, 51 bp, Artificial Sequence
  Synthetic polynucleotide
tttgttctcactgttttctttctttrggtgaaagtcttcgaccagcgatga

SEQ ID NO: 4432 - DNA, 51 bp, Artificial Sequence
  Synthetic polynucleotide
caacaacgaggcaggccgtacggtgrgctttgagaggctccgcaccctaag

SEQ ID NO: 4433 - DNA, 51 bp, Artificial Sequence
  Synthetic polynucleotide
aagcttgaatgtgtcaaaaccaaacrccctcagctccacattgagagcaaa

SEQ ID NO: 4434 - DNA, 51 bp, Artificial Sequence
  Synthetic polynucleotide
agcatgtattacccacgggtacaacrttaccgagagctgcttgactccttg

SEQ ID NO: 4435 - DNA, 51 bp, Artificial Sequence
  Synthetic polynucleotide
catggggatttcgtggctccagagcractgtggccctatggagaggacgtg

SEQ ID NO: 4436 - DNA, 51 bp, Artificial Sequence
  Synthetic polynucleotide
cgtcggtacttccgctctggagttgrgattatccgaatggcatccatttac

SEQ ID NO: 4437 - DNA, 51 bp, Artificial Sequence
  Synthetic polynucleotide
actaccatccgagtctgttgcactaytggggtctcggtcaaggtcagactc

SEQ ID NO: 4438 - DNA, 51 bp, Artificial Sequence
  Synthetic polynucleotide
taccaaggccagctgcccttccccarccacgccgagaagcagaagcagttc

SEQ ID NO: 4439 - DNA, 51 bp, Artificial Sequence
  Synthetic polynucleotide
gggctcatgtgccaagccccagaaarggttcgtgggatggctattaaggat

SEQ ID NO: 4440 - DNA, 51 bp, Artificial Sequence
  Synthetic polynucleotide
tttttatttttcctgagtagaccatrtccttaaatgtaaaaggccctggac

SEQ ID NO: 4441 - DNA, 51 bp, Artificial Sequence
  Synthetic polynucleotide
ccggcggtcccacccgagctggacargcacttcttgctgtgcgaggcctgt

SEQ ID NO: 4442 - DNA, 51 bp, Artificial Sequence
  Synthetic polynucleotide
aaggccatgccctccagcaccttcaycaggaaatcgtcctctaccagccca

SEQ ID NO: 4443 - DNA, 51 bp, Artificial Sequence
  Synthetic polynucleotide
tacatgtaattgtggaacacaggcgycctcttgctcagccggtccacatac

SEQ ID NO: 4444 - DNA, 51 bp, Artificial Sequence
  Synthetic polynucleotide
gttccatccccaaaaggaggctgaaratcagcacaataagatcctatatcg

SEQ ID NO: 4445 - DNA, 51 bp, Artificial Sequence
  Synthetic polynucleotide
aaaataaactattttctttcctcccvgggtcgtcagacaccaaaacatatt

SEQ ID NO: 4446 - DNA, 51 bp, Artificial Sequence
  Synthetic polynucleotide
atgtaatataaaataattgtttcctrggcacaataaaagatcgaagattgt

SEQ ID NO: 4447 - DNA, 51 bp, Artificial Sequence
  Synthetic polynucleotide
aacttatatattttctccccattgcdgcacaactaaggaacgtcaagagat

SEQ ID NO: 4448 - DNA, 51 bp, Artificial Sequence
  Synthetic polynucleotide
gataatattctacttttatttgttcrgggctctgtgtgacactccaggtgt

SEQ ID NO: 4449 - DNA, 51 bp, Artificial Sequence
  Synthetic polynucleotide
agcagacccagcttaccttgaggtgrgagagtaagaggacatataatgagg

SEQ ID NO: 4450 - DNA, 51 bp, Artificial Sequence
  Synthetic polynucleotide
gttgaatttttgttttgttttctgtrggtttcagatgaaattttatttcag

SEQ ID NO: 4451 - DNA, 51 bp, Artificial Sequence
  Synthetic polynucleotide
taggctacgttttcatttttttatcrgatgtcttctcctaattgtgagata

SEQ ID NO: 4452 - DNA, 51 bp, Artificial Sequence
  Synthetic polynucleotide
aaggtgcagcagaagcagaggcagargcacttcaaccggcagatcccggcg

SEQ ID NO: 4453 - DNA, 51 bp, Artificial Sequence
  Synthetic polynucleotide
tcgacgcatgcagtactttgtggccvagaagaaattccaggtaagccctgt

SEQ ID NO: 4454 - DNA, 51 bp, Artificial Sequence
  Synthetic polynucleotide
cgcacccacgtccagggccgcgtctrcaacttcctcgagcgtcccaccggc

SEQ ID NO: 4455 - DNA, 51 bp, Artificial Sequence
  Synthetic polynucleotide
ctcctgggctccgtggtcttcatccvccgccaggtgggtggcccgggttag

SEQ ID NO: 4456 - DNA, 51 bp, Artificial Sequence
  Synthetic polynucleotide
  misc_feature (26)..(26): n is a, c, g, t or u
caggtcacagtcaccaccatcggctntggggacaaggtgccccagacgtgg

SEQ ID NO: 4457 - DNA, 51 bp, Artificial Sequence
  Synthetic polynucleotide
cctaataatgatgggttttatttccrgacttcacttctaatggtgattatg

SEQ ID NO: 4458 - DNA, 51 bp, Artificial Sequence
  Synthetic polynucleotide
acagaaaaagaaatatttgaaaggtvtgttctttgaataccttacttataa

SEQ ID NO: 4459 - DNA, 51 bp, Artificial Sequence
  Synthetic polynucleotide
cagggaccccagcgcccgagagaccrtgcagaggtcgcctctggaaaaggc

SEQ ID NO: 4460 - DNA, 51 bp, Artificial Sequence
  Synthetic polynucleotide
accaacatgttttctttgatcttacdgttgttattaattgtgattggagct

SEQ ID NO: 4461 - DNA, 51 bp, Artificial Sequence
  Synthetic polynucleotide
  misc_feature (26)..(26): n is a, c, g, t or u
acaacctgaacaaatttgatgaagtntgtacctattgatttaatcttttag

SEQ ID NO: 4462 - DNA, 51 bp, Artificial Sequence
  Synthetic polynucleotide
gaacctgtctccacaaagtgtgaccrcatattttgcaagtaagtttgaatg

SEQ ID NO: 4463 - DNA, 51 bp, Artificial Sequence
  Synthetic polynucleotide
ttaaagttcattggaacagaaagaartggatttatctgctcttcgcgttga

SEQ ID NO: 4464 - DNA, 51 bp, Artificial Sequence
  Synthetic polynucleotide
tgtaagaatgatataaccaaaaggtrtataatttggtaatgatgctaggtt

SEQ ID NO: 4465 - DNA, 51 bp, Artificial Sequence
  Synthetic polynucleotide
tctgaacctctgtttttgttatttavggtgaagcagcatctgggtgtgaga

SEQ ID NO: 4466 - DNA, 51 bp, Artificial Sequence
  Synthetic polynucleotide
gttttctccttccatttatctttctrggtcatccccttctaaatgcccatc

SEQ ID NO: 4467 - DNA, 51 bp, Artificial Sequence
  Synthetic polynucleotide
ataatggaatatttgatttaatttcrgatgctcgtgtacaagtttgccaga

SEQ ID NO: 4468 - DNA, 51 bp, Artificial Sequence
  Synthetic polynucleotide
aactaatctaattactgaagagactrctcatgttgttatgaaaacaggtat

SEQ ID NO: 4469 - DNA, 51 bp, Artificial Sequence
  Synthetic polynucleotide
aatgctctttccttcctggggatccdgggtgtccacccaattgtggttgtg

SEQ ID NO: 4470 - DNA, 51 bp, Artificial Sequence
  Synthetic polynucleotide
cgctaccgtgctcaaggagcagctcragctctgcctggccgccgagggctt

SEQ ID NO: 4471 - DNA, 51 bp, Artificial Sequence
  Synthetic polynucleotide
cggcagctggcggctgctgaggacgrgaagaagacgctgaactcgctgctg

SEQ ID NO: 4472 - DNA, 51 bp, Artificial Sequence
  Synthetic polynucleotide
catcgtgtgcgtcatgggcccggtgrgcgccccgcgccgggaccctcccca

SEQ ID NO: 4473 - DNA, 51 bp, Artificial Sequence
  Synthetic polynucleotide
aggagcacgctcagcaaggcatgaghtgcacaagagttgggtatcagctgt

SEQ ID NO: 4474 - DNA, 51 bp, Artificial Sequence
  Synthetic polynucleotide
aggaatcattggatgtatatgagtargtaggtttgttaaagcaaaagaagt

SEQ ID NO: 4475 - DNA, 51 bp, Artificial Sequence
  Synthetic polynucleotide
gcttcgctcactccgctctcttcccrggtgcacgtcggcgacgaggacttc

SEQ ID NO: 4476 - DNA, 51 bp, Artificial Sequence
  Synthetic polynucleotide
ttaaaatctaggtatgaatttttcartgagctttatcatcgcttcttgctc

SEQ ID NO: 4477 - DNA, 51 bp, Artificial Sequence
  Synthetic polynucleotide
cttaaaaaaaaaaaaaaaaaaaaaarccttttcaggagggcctgaggctat

SEQ ID NO: 4478 - DNA, 51 bp, Artificial Sequence
  Synthetic polynucleotide
ttccagaaaatagttcacaaccctgdtgtgattacctatgacactgaattt

SEQ ID NO: 4479 - DNA, 51 bp, Artificial Sequence
  Synthetic polynucleotide
gcatagaacaacgtttgggaaagtarcaaaaaattcttcttcgattaaagt

SEQ ID NO: 4480 - DNA, 51 bp, Artificial Sequence
  Synthetic polynucleotide
ctgagtgtgcgatggaccctgttacrgaaaccagccctgagcaaaggggtt

SEQ ID NO: 4481 - DNA, 51 bp, Artificial Sequence
  Synthetic polynucleotide
aaacacaagcaccaccttatcgagcrctcaaggcttcactcgggcgagaag

SEQ ID NO: 4482 - DNA, 51 bp, Artificial Sequence
  Synthetic polynucleotide
ccaactggacatttccgagccatacraagtttaccgaattgttcctgagga

SEQ ID NO: 4483 - DNA, 51 bp, Artificial Sequence
  Synthetic polynucleotide
caaagctgaaccagccacttggaagrcgaggttacgctgtgctttgaataa

SEQ ID NO: 4484 - DNA, 51 bp, Artificial Sequence
  Synthetic polynucleotide
tgtcccggcctgcagagcttggactrtgacaacagtgagaaccagctgttc

SEQ ID NO: 4485 - DNA, 51 bp, Artificial Sequence
  Synthetic polynucleotide
agagaaggcagtggactctctagtgragaagttaaagaagaagaagggagc

SEQ ID NO: 4486 - DNA, 51 bp, Artificial Sequence
  Synthetic polynucleotide
tggaccttcttccaggcctactactrctgcttcatcaccctcaccaccatc

SEQ ID NO: 4487 - DNA, 51 bp, Artificial Sequence
  Synthetic polynucleotide
cgccacgcccgccgcagcagcttcayggcgcccgcgccgggccggcggccc

SEQ ID NO: 4488 - DNA, 51 bp, Artificial Sequence
  Synthetic polynucleotide
cggcgctcggcggcgcggggcgcgcyggccaccagcactgccaggaaggcg

SEQ ID NO: 4489 - DNA, 51 bp, Artificial Sequence
  Synthetic polynucleotide
cgggccagaccagcgagcccaaaagragggggacattatccttggggggct

SEQ ID NO: 4490 - DNA, 51 bp, Artificial Sequence
  Synthetic polynucleotide
gggaccctgctctccctctctgaacrgggtgagcatctcgctctactcctc

SEQ ID NO: 4491 - DNA, 51 bp, Artificial Sequence
  Synthetic polynucleotide
gagatcactgaacttggtgactccayactgagctgtgccacggtccagggc

SEQ ID NO: 4492 - DNA, 51 bp, Artificial Sequence
  Synthetic polynucleotide
ggcagccgggcccgtgccagccaaarcggcggcgggcgggagccccgcaag

SEQ ID NO: 4493 - DNA, 51 bp, Artificial Sequence
  Synthetic polynucleotide
gggcagcactgggatgctccagggcygtcggaccttcgagtggggcagggg

SEQ ID NO: 4494 - DNA, 51 bp, Artificial Sequence
  Synthetic polynucleotide
gaacttggccctggtgtcttggaacrgcccacagtggtggtgggcaagggc

SEQ ID NO: 4495 - DNA, 51 bp, Artificial Sequence
  Synthetic polynucleotide
aagctctacaacccagagaacatctrcctgtcggaacatggaggaggagct

SEQ ID NO: 4496 - DNA, 51 bp, Artificial Sequence
  Synthetic polynucleotide
acctttttagggggtgatggtgggartgggacaaaaagacagctacgtggg

SEQ ID NO: 4497 - DNA, 51 bp, Artificial Sequence
  Synthetic polynucleotide
agctacaatgattttgggaattacarcaatcagtcttcaaattttggaccc

SEQ ID NO: 4498 - DNA, 51 bp, Artificial Sequence
  Synthetic polynucleotide
cttaatagttagcattgggagaacayagatcaccttgtatgatgttaaagg

SEQ ID NO: 4499 - DNA, 51 bp, Artificial Sequence
  Synthetic polynucleotide
ctaacccgctatccccttgcagctcracaacaacacaacgcagggccaggc

SEQ ID NO: 4500 - DNA, 51 bp, Artificial Sequence
  Synthetic polynucleotide
ataattcttctcaccctaacaggtcracctcgcttccccacccttactaac

SEQ ID NO: 4501 - DNA, 51 bp, Artificial Sequence
  Synthetic polynucleotide
gggaaggcttctgttcaagcgatcartgtttttcatcctgctgtaagtgac

SEQ ID NO: 4502 - DNA, 51 bp, Artificial Sequence
  Synthetic polynucleotide
  misc_feature (26)..(26): n is a, c, g, t or u
ccagcagtgggggctcgcggacgtgnagggccactggtccccaacaatgtg

SEQ ID NO: 4503 - DNA, 51 bp, Artificial Sequence
  Synthetic polynucleotide
tcctgcaccgagagagatggaataargcccttgaaccagccctgctgtgcc

SEQ ID NO: 4504 - DNA, 51 bp, Artificial Sequence
  Synthetic polynucleotide
ctgcgcgcccgggatttcgatctggrcctggcctggcgggtaagcgtgcgt

SEQ ID NO: 4505 - DNA, 51 bp, Artificial Sequence
  Synthetic polynucleotide
aaacctttacgtgtcaagaagctctrtgtactgtcagccttacttatagag

SEQ ID NO: 4506 - DNA, 51 bp, Artificial Sequence
  Synthetic polynucleotide
gtatatgacgaagattcaccttatcraaatataaaaattctacactcgaag

SEQ ID NO: 4507 - DNA, 51 bp, Artificial Sequence
  Synthetic polynucleotide
aaaatacaatacaataaagtagtaarggcccaactatggatatatttgaga

SEQ ID NO: 4508 - DNA, 51 bp, Artificial Sequence
  Synthetic polynucleotide
tgggccctgtaccacctctcaaaggrccctgagatccaggaggccttgcac

SEQ ID NO: 4509 - DNA, 51 bp, Artificial Sequence
  Synthetic polynucleotide
tcactctatgccaccttcctccccargtggactcgccccgtgctgcctttc

SEQ ID NO: 4510 - DNA, 51 bp, Artificial Sequence
  Synthetic polynucleotide
atcccaactatcgggcggctgcgcargagggcagggaaggtggtgtccgag

SEQ ID NO: 4511 - DNA, 51 bp, Artificial Sequence
  Synthetic polynucleotide
ctacctgtacaccgtggtggccttcracttcttccgcaagttctacaacaa

SEQ ID NO: 4512 - DNA, 51 bp, Artificial Sequence
  Synthetic polynucleotide
cgcgggtgacgaatacgagctctacrgggtggtcttcgacatcaccttctt

SEQ ID NO: 4513 - DNA, 51 bp, Artificial Sequence
  Synthetic polynucleotide
gccttcaacttcttccgcaagttctrcaacaagagcgaggatgaggatgaa

SEQ ID NO: 4514 - DNA, 51 bp, Artificial Sequence
  Synthetic polynucleotide
gatcgaatagaagtgacaaggctcartgggaccatgaggaagatcttgatt

SEQ ID NO: 4515 - DNA, 51 bp, Artificial Sequence
  Synthetic polynucleotide
gttataaacgaaaagttgatgaacartcatcagctggaactggcaaagcag

SEQ ID NO: 4516 - DNA, 51 bp, Artificial Sequence
  Synthetic polynucleotide
cagggtgacttttctttgcacccacrgataatagaggagttggcagatgcc

SEQ ID NO: 4517 - DNA, 51 bp, Artificial Sequence
  Synthetic polynucleotide
aattgtaccaggttacagcagctggrcatattaggtaaggttacaatatat

SEQ ID NO: 4518 - DNA, 51 bp, Artificial Sequence
  Synthetic polynucleotide
gccgactaccagcccaccgagcaggrcatcctccgaaccagggtcaaaacc

SEQ ID NO: 4519 - DNA, 51 bp, Artificial Sequence
  Synthetic polynucleotide
gacctgggttccccctctcctgcagracgattccctgatgaggcagatgcg

SEQ ID NO: 4520 - DNA, 51 bp, Artificial Sequence
  Synthetic polynucleotide
gggttctgaggtccataccaagaagrcggtgatgatcaagaccatcgagac

SEQ ID NO: 4521 - DNA, 51 bp, Artificial Sequence
  Synthetic polynucleotide
tccttaagaaagtgcatgaagaggtrtaccttggcccctcttcctggggtc

SEQ ID NO: 4522 - DNA, 51 bp, Artificial Sequence
  Synthetic polynucleotide
gccctggacatcgagatcgccacctrcaggaagctgctagagggcgaggag

SEQ ID NO: 4523 - DNA, 51 bp, Artificial Sequence
  Synthetic polynucleotide
atcgccacctacaggaagctgctagdgggcgaggagaaccggtgagccctc

SEQ ID NO: 4524 - DNA, 51 bp, Artificial Sequence
  Synthetic polynucleotide
tacaggaagctgctagagggcgaggrgaaccggtgagccctcatcacagcc

SEQ ID NO: 4525 - DNA, 51 bp, Artificial Sequence
  Synthetic polynucleotide
gagcgggcagagatgatggagctcartgaccgctttgccagctacatcgag

SEQ ID NO: 4526 - DNA, 51 bp, Artificial Sequence
  Synthetic polynucleotide
aacatgcatgaagccgaagagtggtrccgctccaaggtagccctgcctgtg

SEQ ID NO: 4527 - DNA, 51 bp, Artificial Sequence
  Synthetic polynucleotide
caacgcggagctgctccgccaggccragcacgaagccaacgactaccggcg

SEQ ID NO: 4528 - DNA, 51 bp, Artificial Sequence
  Synthetic polynucleotide
ggagcgtgaacagatcaagaccctcdacaacaagtttgcctccttcatcga

SEQ ID NO: 4529 - DNA, 51 bp, Artificial Sequence
  Synthetic polynucleotide
gagcgtgaacagatcaagaccctcavcaacaagtttgcctccttcatcgac

SEQ ID NO: 4530 - DNA, 51 bp, Artificial Sequence
  Synthetic polynucleotide
tgagaaggtgaccatgcagaacctcratgaccgcctggcctcctacctgga

SEQ ID NO: 4531 - DNA, 51 bp, Artificial Sequence
  Synthetic polynucleotide
ttttggtttctgtgtccttcctccavcccttccaggagctgcgtgagacca

SEQ ID NO: 4532 - DNA, 51 bp, Artificial Sequence
  Synthetic polynucleotide
gcggctgcgctttgcccggaagcccrtttccatcatcggtgagtcatgcct

SEQ ID NO: 4533 - DNA, 51 bp, Artificial Sequence
  Synthetic polynucleotide
catggtggtcctctgcgtgggctccraggggcaggtgtttgccacgtcggc

SEQ ID NO: 4534 - DNA, 51 bp, Artificial Sequence
  Synthetic polynucleotide
cctgtacatcggcttcctgggcctcrtcttctcctcgtactttgtgtacct

SEQ ID NO: 4535 - DNA, 51 bp, Artificial Sequence
  Synthetic polynucleotide
atctacacggctgtcttcacaccctvctcggctgccttcctgctgaaggag

SEQ ID NO: 4536 - DNA, 51 bp, Artificial Sequence
  Synthetic polynucleotide
  misc_feature (26)..(26): n is a, c, g, t or u
caccccggccgcatcgccgtccactncttcaagggctggttcctcatcgac

SEQ ID NO: 4537 - DNA, 51 bp, Artificial Sequence
  Synthetic polynucleotide
atgtgcacctttgcgctcatcgcgcvctggctagcctgcatctggtacgcc

SEQ ID NO: 4538 - DNA, 51 bp, Artificial Sequence
  Synthetic polynucleotide
ctggctagcctgcatctggtacgccvtcggcaacatggagcagccacacat

SEQ ID NO: 4539 - DNA, 51 bp, Artificial Sequence
  Synthetic polynucleotide
ctgcatctggtacgccatcggcaacvtggagcagccacacatggactcacg

SEQ ID NO: 4540 - DNA, 51 bp, Artificial Sequence
  Synthetic polynucleotide
gagctgtgcggctactcgcgggccgvggtgatgcagcgaccctgcacctgc

SEQ ID NO: 4541 - DNA, 51 bp, Artificial Sequence
  Synthetic polynucleotide
  misc_feature (26)..(26): n is a, c, g, t or u
agcctcaccagtgtgggcttcggcancgtctctcccaacaccaactcagag

SEQ ID NO: 4542 - DNA, 51 bp, Artificial Sequence
  Synthetic polynucleotide
gtgggcttcggcaacgtctctcccadcaccaactcagagaagatcttctcc

SEQ ID NO: 4543 - DNA, 51 bp, Artificial Sequence
  Synthetic polynucleotide
agagaagatcttctccatctgcgtcdtgctcattggctgtgagtgtgccca

SEQ ID NO: 4544 - DNA, 51 bp, Artificial Sequence
  Synthetic polynucleotide
gcacgcctggtcctacaccaacggcrtcgacatgaacgcggtgaggccacc

SEQ ID NO: 4545 - DNA, 51 bp, Artificial Sequence
  Synthetic polynucleotide
caaagtggaaatcgccttctaccggdaagatggtaggagcgggccggggcg

SEQ ID NO: 4546 - DNA, 51 bp, Artificial Sequence
  Synthetic polynucleotide
tcggcggccccggggcgacgtggagrgcaggctggatgccctccagcgcca

SEQ ID NO: 4547 - DNA, 51 bp, Artificial Sequence
  Synthetic polynucleotide
catactggaaggcatggtggaagccvctgccatgacgacacagtgccgtag

SEQ ID NO: 4548 - DNA, 51 bp, Artificial Sequence
  Synthetic polynucleotide
cagtacattgtagaggactggcaggraaagtacaagagccaaatcttgaat

SEQ ID NO: 4549 - DNA, 51 bp, Artificial Sequence
  Synthetic polynucleotide
aaaggatatgagtgaaccagaatctycacagccgctctccggatggggtgg

SEQ ID NO: 4550 - DNA, 51 bp, Artificial Sequence
  Synthetic polynucleotide
tgccctggtgggcgccatcccgtccrtcatgaacgtcctcctcgtctgcct

SEQ ID NO: 4551 - DNA, 51 bp, Artificial Sequence
  Synthetic polynucleotide
atcttcatgacagaggagcagaagargtactacaatgccatgaagaagctg

SEQ ID NO: 4552 - DNA, 51 bp, Artificial Sequence
  Synthetic polynucleotide
gatgtccctgcctgccctcttcaacrtcgggctgctgctcttcctcgtcat

SEQ ID NO: 4553 - DNA, 51 bp, Artificial Sequence
  Synthetic polynucleotide
ccgagtcctccgggccctgaaaactrtatcagtcatttcaggtgaaaatca

SEQ ID NO: 4554 - DNA, 51 bp, Artificial Sequence
  Synthetic polynucleotide
ttctggagggtgctgttcaaggactrcaacctggagcgctatggccggctg

SEQ ID NO: 4555 - DNA, 51 bp, Artificial Sequence
  Synthetic polynucleotide
acgcaacagcaacctgagtcagaccrgtaggtcatcccggatgctggcagt

SEQ ID NO: 4556 - DNA, 51 bp, Artificial Sequence
  Synthetic polynucleotide
gaagaaagtctgtacatgtatctttrctttgttattttcatcatctttggg

SEQ ID NO: 4557 - DNA, 51 bp, Artificial Sequence
  Synthetic polynucleotide
tgtttcctctctcgccccacggagaraaccatcttcatcatcttcatgctg

SEQ ID NO: 4558 - DNA, 51 bp, Artificial Sequence
  Synthetic polynucleotide
agctgtgtctttgtgtttgtgctgcrggtgggcaagtgggagaaccatacg

SEQ ID NO: 4559 - DNA, 51 bp, Artificial Sequence
  Synthetic polynucleotide
ggagagttttgaggcctgtggttgaratggaaatatcttcacagaaaaact

SEQ ID NO: 4560 - DNA, 51 bp, Artificial Sequence
  Synthetic polynucleotide
aatctgacagaagcactgtcgctctvtgaagaacagctggggcgcctgtat

SEQ ID NO: 4561 - DNA, 51 bp, Artificial Sequence
  Synthetic polynucleotide
caagagagtgccaaccttctgtttcrgatacctgggctatatgtgtgacct

SEQ ID NO: 4562 - DNA, 51 bp, Artificial Sequence
  Synthetic polynucleotide
gtccaggttcgctgcaaaccagaccrtggatactggagtgcatggagtcca

SEQ ID NO: 4563 - DNA, 51 bp, Artificial Sequence
  Synthetic polynucleotide
ttggcttcaagattttgtgccaaccrggtaaaatgttcttttctatttttt

SEQ ID NO: 4564 - DNA, 51 bp, Artificial Sequence
  Synthetic polynucleotide
aaagaccttttcctccctcattcacrggctggcttattagctgtaatggcc

SEQ ID NO: 4565 - DNA, 51 bp, Artificial Sequence
  Synthetic polynucleotide
aatgctatcaaagagatgattgagarctggtacggagggagtcgagccggg

SEQ ID NO: 4566 - DNA, 51 bp, Artificial Sequence
  Synthetic polynucleotide
ttttctgtttgatttgccagtttagrtgcaaaatccacaagtattcaagtg

SEQ ID NO: 4567 - DNA, 51 bp, Artificial Sequence
  Synthetic polynucleotide
  misc_feature (26)..(26): n is a, c, g, t or u
tttttggttttattttttgttttgcngttctccgggagatgttgcataacc

SEQ ID NO: 4568 - DNA, 51 bp, Artificial Sequence
  Synthetic polynucleotide
ttgaggtattgaatttctttggaccrggtgaattgggacgaagaaaaggaa

SEQ ID NO: 4569 - DNA, 51 bp, Artificial Sequence
  Synthetic polynucleotide
tttactcatctttttggtatctaacvgaaagaagatctggatattgtatgt

SEQ ID NO: 4570 - DNA, 51 bp, Artificial Sequence
  Synthetic polynucleotide
tgggaaaattttggaagttgttggcrggtacagtccaaaatctgggagtgg

SEQ ID NO: 4571 - DNA, 51 bp, Artificial Sequence
  Synthetic polynucleotide
aaaattttggaagttgttggcaggtrcagtccaaaatctgggagtgggtct

SEQ ID NO: 4572 - DNA, 51 bp, Artificial Sequence
  Synthetic polynucleotide
tcttactcttttgtttttcttttccvggtattcagtacacaatgcaggcat

SEQ ID NO: 4573 - DNA, 51 bp, Artificial Sequence
  Synthetic polynucleotide
ttgtgtcttctgctgtttgtttatcrgcaaggagagacagtagctgatgtt

SEQ ID NO: 4574 - DNA, 51 bp, Artificial Sequence
  Synthetic polynucleotide
gatttttttatataggttatcgacabaccgactaacagcatttccaaagat

SEQ ID NO: 4575 - DNA, 51 bp, Artificial Sequence
  Synthetic polynucleotide
actggttgctttctttttattgtttrgatcgtctggtagaatcaacttcct

SEQ ID NO: 4576 - DNA, 51 bp, Artificial Sequence
  Synthetic polynucleotide
aaacacacacccattcctgtacctcvggtaatgtagcaccaaactcctcaa

SEQ ID NO: 4577 - DNA, 51 bp, Artificial Sequence
  Synthetic polynucleotide
cacacccattcctgtacctcaggtartgtagcaccaaactcctcaaccaag

SEQ ID NO: 4578 - DNA, 51 bp, Artificial Sequence
  Synthetic polynucleotide
tttgtttgttttactactttcttttvggaaaacaccagaaattattgttgg

SEQ ID NO: 4579 - DNA, 51 bp, Artificial Sequence
  Synthetic polynucleotide
ctttttcttttcttcttgattatcarggcttggaccctggcaaacagatta

SEQ ID NO: 4580 - DNA, 51 bp, Artificial Sequence
  Synthetic polynucleotide
  misc_feature (26)..(26): n is a, c, g, t or u
gaagaatggtgttaaatttaccaacnggtttgcaagtcgttattatatttt

SEQ ID NO: 4581 - DNA, 51 bp, Artificial Sequence
  Synthetic polynucleotide
ccgaggcggatcgggtgttgcatccdtggagcgagctgagagctcgaggtg

SEQ ID NO: 4582 - DNA, 51 bp, Artificial Sequence
  Synthetic polynucleotide
ataaatatgttttcttttttgccttrgaatgcgttgatatcaatgttactc

SEQ ID NO: 4583 - DNA, 51 bp, Artificial Sequence
  Synthetic polynucleotide
taagggatttgctttgttttattttrgtcctgttgttctacaatgtacaca

SEQ ID NO: 4584 - DNA, 51 bp, Artificial Sequence
  Synthetic polynucleotide
cagcaggagctggcttgggagtgtgrctaccgtcgtgaggcggcttgtgcc

SEQ ID NO: 4585 - DNA, 51 bp, Artificial Sequence
  Synthetic polynucleotide
tacacgcgcagggccctggccaccgrggtcaccgccggcctgctatcgctg

SEQ ID NO: 4586 - DNA, 51 bp, Artificial Sequence
  Synthetic polynucleotide
ggcaggtgggatggagagcatgtccratgttccatatgtaatgaacagagg

SEQ ID NO: 4587 - DNA, 51 bp, Artificial Sequence
  Synthetic polynucleotide
tccacctgtgctgtctctttcctgcrgcaacacgggattcccatcccggtc

SEQ ID NO: 4588 - DNA, 51 bp, Artificial Sequence
  Synthetic polynucleotide
cccacttgctcccctcttttgcctcrgggaacgccccatgtacggccggga

SEQ ID NO: 4589 - DNA, 51 bp, Artificial Sequence
  Synthetic polynucleotide
gcataatgcatgtgggagggctcagbgccgtctgaatagaggagagcaaaa

SEQ ID NO: 4590 - DNA, 51 bp, Artificial Sequence
  Synthetic polynucleotide
ccccactgtctctcttctttctgtcrggggctcccacaggatcagaggctg

SEQ ID NO: 4591 - DNA, 51 bp, Artificial Sequence
  Synthetic polynucleotide
ctcctgggctgcttcgggctcacagrgcccaacagcggaagtgaccccagc

SEQ ID NO: 4592 - DNA, 51 bp, Artificial Sequence
  Synthetic polynucleotide
tggggagtagatctgctaaaatttgrtggttgttactgtgacagtttggaa

SEQ ID NO: 4593 - DNA, 51 bp, Artificial Sequence
  Synthetic polynucleotide
tattttacccattgttttctcatacrggttataagcacatgtccttggccc

SEQ ID NO: 4594 - DNA, 51 bp, Artificial Sequence
  Synthetic polynucleotide
tcatatctgttttcacagcccaattrtacagaaatccgacagtactgcaat

SEQ ID NO: 4595 - DNA, 51 bp, Artificial Sequence
  Synthetic polynucleotide
gctcggcggcggcgggcgcgggaagrtggcggcagcggcggcggcggctgc

SEQ ID NO: 4596 - DNA, 51 bp, Artificial Sequence
  Synthetic polynucleotide
taaaatttttctttgggaaattaccrggttctgaagtaattgttggagtaa

SEQ ID NO: 4597 - DNA, 51 bp, Artificial Sequence
  Synthetic polynucleotide
agtgggcagcccatccctcgagtggdatacatggaggaagaaaagaaaaca

SEQ ID NO: 4598 - DNA, 51 bp, Artificial Sequence
  Synthetic polynucleotide
cagattgactttccattccagatttrctggtttactgtggagtttgggctc

SEQ ID NO: 4599 - DNA, 51 bp, Artificial Sequence
  Synthetic polynucleotide
tgattatttctttttccctcctaccrggaaataataaactttacatgtttg

SEQ ID NO: 4600 - DNA, 51 bp, Artificial Sequence
  Synthetic polynucleotide
attaacgtgggtgtctcattgcctcrgagaacacagcgcagcacggaaatt

SEQ ID NO: 4601 - DNA, 51 bp, Artificial Sequence
  Synthetic polynucleotide
ttctctctttttgttttgtttttccrgattcgctttgtggtggaactcgtg

SEQ ID NO: 4602 - DNA, 51 bp, Artificial Sequence
  Synthetic polynucleotide
ccccgtgacccctgactctgcccccrgagccctcggcagtctctcttcttc

SEQ ID NO: 4603 - DNA, 51 bp, Artificial Sequence
  Synthetic polynucleotide
taatgttctttatttcttcttttttrgataaaatcagtggttctggaagta

SEQ ID NO: 4604 - DNA, 51 bp, Artificial Sequence
  Synthetic polynucleotide
tgcactgcttgtggacaacaggtcartcattttcaaaaagattccatttat

SEQ ID NO: 4605 - DNA, 51 bp, Artificial Sequence
  Synthetic polynucleotide
cttctattaccgtggcgacacgctgrtggcggccaccctcgggcagcacaa

SEQ ID NO: 4606 - DNA, 51 bp, Artificial Sequence
  Synthetic polynucleotide
atgtattgcaatttgtaacgttaatrgcttgcgccgggcacaatagttgaa

SEQ ID NO: 4607 - DNA, 51 bp, Artificial Sequence
  Synthetic polynucleotide
atagtatttgcctttattgcaagggragtccttaggcatgatttttgagaa

SEQ ID NO: 4608 - DNA, 51 bp, Artificial Sequence
  Synthetic polynucleotide
gagccctcccaggtcatcttctgcartcgcagtccgcgcgtcgtgctgccc

SEQ ID NO: 4609 - DNA, 51 bp, Artificial Sequence
  Synthetic polynucleotide
ccaaccttgacctgttttgtgttccrgggagaacgaggcaagccggggctc

SEQ ID NO: 4610 - DNA, 51 bp, Artificial Sequence
  Synthetic polynucleotide
aatgaataacaatttaatgcttttcrggctttcaaaaagcaatggtcaaga

SEQ ID NO: 4611 - DNA, 51 bp, Artificial Sequence
  Synthetic polynucleotide
tcaacagtgtccttcattcccccacrgaactgcccaagatggaatccaagg

SEQ ID NO: 4612 - DNA, 51 bp, Artificial Sequence
  Synthetic polynucleotide
caggccctctctgctcccttgctctrgggaccgcctgactcacaatgacat

SEQ ID NO: 4613 - DNA, 51 bp, Artificial Sequence
  Synthetic polynucleotide
aagaggtcataataggcttctttcavattttcagtttacatagagttttaa

SEQ ID NO: 4614 - DNA, 51 bp, Artificial Sequence
  Synthetic polynucleotide
agtgggatcacatgtgccaacaggtrtagacaatctctttcactgtggctt

SEQ ID NO: 4615 - DNA, 51 bp, Artificial Sequence
  Synthetic polynucleotide
aaacgttgttgcatttgtctgtttcrgttactggtggaagagttgcccctg

SEQ ID NO: 4616 - DNA, 51 bp, Artificial Sequence
  Synthetic polynucleotide
agctgtgaatgcttcattcaggcccragtaaatataggaagaggtgtagtg

SEQ ID NO: 4617 - DNA, 51 bp, Artificial Sequence
  Synthetic polynucleotide
gctgtgaatgcttcattcaggcccargtaaatataggaagaggtgtagtgg

SEQ ID NO: 4618 - DNA, 51 bp, Artificial Sequence
  Synthetic polynucleotide
tgttgcaattttcttcttcctttgtrgaccttttcaagcaagtggcaagtt

SEQ ID NO: 4619 - DNA, 51 bp, Artificial Sequence
  Synthetic polynucleotide
gagatgatgacacgttctccagttavggtaagaacataggccgtctcagtg

SEQ ID NO: 4620 - DNA, 51 bp, Artificial Sequence
  Synthetic polynucleotide
ttgctctgcccctgcccttctccccrgtgggccccaccatcctgaataaga

SEQ ID NO: 4621 - DNA, 51 bp, Artificial Sequence
  Synthetic polynucleotide
agatttacttttccttttcatggacrgggctgccggtcacttgctgcaggg

SEQ ID NO: 4622 - DNA, 51 bp, Artificial Sequence
  Synthetic polynucleotide
gttagctccttcttgccaaccaaccrtgagctcccagattcgtcagaatta

SEQ ID NO: 4623 - DNA, 51 bp, Artificial Sequence
  Synthetic polynucleotide
gtgcagagcttttcctgcttaccctrcgggcgtctggcctaccacctggct

SEQ ID NO: 4624 - DNA, 51 bp, Artificial Sequence
  Synthetic polynucleotide
tactaaattttttgctaggatggcadtggctatattagtgctgcagaactt

SEQ ID NO: 4625 - DNA, 51 bp, Artificial Sequence
  Synthetic polynucleotide
acacagtgcaagcgcgtaggaacacratgctgggtgtttgggtgagtaatc

SEQ ID NO: 4626 - DNA, 51 bp, Artificial Sequence
  Synthetic polynucleotide
ggaccagcgcacagcaaacagatacytgagggagagctgcagcgaagtcaa

SEQ ID NO: 4627 - DNA, 51 bp, Artificial Sequence
  Synthetic polynucleotide
tacttctgttttataaaggtggactvtgcgccctcattaatggctcggctt

SEQ ID NO: 4628 - DNA, 51 bp, Artificial Sequence
  Synthetic polynucleotide
aatttcatccattgccagacgaccgyattctgtgaagagctttaaaaaaga

SEQ ID NO: 4629 - DNA, 51 bp, Artificial Sequence
  Synthetic polynucleotide
gtcatggtgtccctgctgacagattrctcacctcagctccagaagcctaaa

SEQ ID NO: 4630 - DNA, 51 bp, Artificial Sequence
  Synthetic polynucleotide
aataaagtgcagctgaagggccgtgrccttctcactctaaaaaactttacc

SEQ ID NO: 4631 - DNA, 51 bp, Artificial Sequence
  Synthetic polynucleotide
actctaaaaaactttaccggagaagraattaaatatatgctatggctatca

SEQ ID NO: 4632 - DNA, 51 bp, Artificial Sequence
  Synthetic polynucleotide
tcgtcctttacacaattaaaagaagdtgctgtttaatctgaggatcctgtt

SEQ ID NO: 4633 - DNA, 51 bp, Artificial Sequence
  Synthetic polynucleotide
cttaggcatgatttttgagaaaagargtactcgaacaagattgtctacaga

SEQ ID NO: 4634 - DNA, 51 bp, Artificial Sequence
  Synthetic polynucleotide
gatttttgagaaaagaagtactcgarcaagattgtctacagaaacaggtaa

SEQ ID NO: 4635 - DNA, 51 bp, Artificial Sequence
  Synthetic polynucleotide
tgttttcttaccacacaagatattcdtttgggtgtgaatgaaagtctcacg

SEQ ID NO: 4636 - DNA, 51 bp, Artificial Sequence
  Synthetic polynucleotide
ttgggtgtgaatgaaagtctcacggrcacggcccggtttgtaaatattttc

SEQ ID NO: 4637 - DNA, 51 bp, Artificial Sequence
  Synthetic polynucleotide
  misc_feature (26)..(26): n is a, c, g, t or u
gattatctttttcttggtttgccacngtgtattgtctagcatggcagatgc

SEQ ID NO: 4638 - DNA, 51 bp, Artificial Sequence
  Synthetic polynucleotide
taaagaagcatccatcccaattatcratgggctgtcagatttgtaccatcc

SEQ ID NO: 4639 - DNA, 51 bp, Artificial Sequence
  Synthetic polynucleotide
aaagaagcatccatcccaattatcartgggctgtcagatttgtaccatcct

SEQ ID NO: 4640 - DNA, 51 bp, Artificial Sequence
  Synthetic polynucleotide
atcaatgggctgtcagatttgtaccvtcctatccagatcctggctgattac

SEQ ID NO: 4641 - DNA, 51 bp, Artificial Sequence
  Synthetic polynucleotide
taccatcctatccagatcctggctgdttacctcacgctccaggttggttta

SEQ ID NO: 4642 - DNA, 51 bp, Artificial Sequence
  Synthetic polynucleotide
catcctatccagatcctggctgattrcctcacgctccaggttggtttattt

SEQ ID NO: 4643 - DNA, 51 bp, Artificial Sequence
  Synthetic polynucleotide
tcatctccttcatcccgtgccttttrggaacactatagctctctgaaaggt

SEQ ID NO: 4644 - DNA, 51 bp, Artificial Sequence
  Synthetic polynucleotide
tctccttcatcccgtgccttttaggracactatagctctctgaaaggtctt

SEQ ID NO: 4645 - DNA, 51 bp, Artificial Sequence
  Synthetic polynucleotide
tcatcccgtgccttttaggaacactrtagctctctgaaaggtcttaccctc

SEQ ID NO: 4646 - DNA, 51 bp, Artificial Sequence
  Synthetic polynucleotide
cctcagctggatcggggatgggaacratatcctgcactccatcatgatgag

SEQ ID NO: 4647 - DNA, 51 bp, Artificial Sequence
  Synthetic polynucleotide
ctcagctggatcggggatgggaacartatcctgcactccatcatgatgagc

SEQ ID NO: 4648 - DNA, 51 bp, Artificial Sequence
  Synthetic polynucleotide
tgggaacaatatcctgcactccatcrtgatgagcgcagcgaaattcggaat

SEQ ID NO: 4649 - DNA, 51 bp, Artificial Sequence
  Synthetic polynucleotide
aagttggcagagcagtatgccaaagdggtatgctctttacatgtaaagcta

SEQ ID NO: 4650 - DNA, 51 bp, Artificial Sequence
  Synthetic polynucleotide
tggcagagcagtatgccaaagaggtrtgctctttacatgtaaagctattat

SEQ ID NO: 4651 - DNA, 51 bp, Artificial Sequence
  Synthetic polynucleotide
tttaaccagcgtgtttatgtatgctrgaatggtaccaagctgttgctgaca

SEQ ID NO: 4652 - DNA, 51 bp, Artificial Sequence
  Synthetic polynucleotide
catggaggcaatgtattaattacagrcacttggataagcatgggacaagaa

SEQ ID NO: 4653 - DNA, 51 bp, Artificial Sequence
  Synthetic polynucleotide
tggaggcaatgtattaattacagacrcttggataagcatgggacaagaaga

SEQ ID NO: 4654 - DNA, 51 bp, Artificial Sequence
  Synthetic polynucleotide
gctgcctctgactggacatttttacdctgcttgcccagaaagccagaagaa

SEQ ID NO: 4655 - DNA, 51 bp, Artificial Sequence
  Synthetic polynucleotide
cactgcttgcccagaaagccagaagragtggatgatgaagtcttttattct

SEQ ID NO: 4656 - DNA, 51 bp, Artificial Sequence
  Synthetic polynucleotide
actagtgttcccagaggcagaaaacrgaaagtggacaatcatggtaagcaa

SEQ ID NO: 4657 - DNA, 51 bp, Artificial Sequence
  Synthetic polynucleotide
gggctcaagaacggcatgaagtactrccgggacacagacacccctggcagg

SEQ ID NO: 4658 - DNA, 51 bp, Artificial Sequence
  Synthetic polynucleotide
agcctgcagcccctacttctgtgcgdtgttcacaggtatggtgagtggcca

SEQ ID NO: 4659 - DNA, 51 bp, Artificial Sequence
  Synthetic polynucleotide
ctcacatcagtattaaaacgacttaygtagcgctccggatgtttgtcatac

SEQ ID NO: 4660 - DNA, 51 bp, Artificial Sequence
  Synthetic polynucleotide
tcctaccgagttcgagccctggactrctgggcccgaccaggccccttctcg

SEQ ID NO: 4661 - DNA, 51 bp, Artificial Sequence
  Synthetic polynucleotide
gtgtaacagttcctgcatgggcggcvtgaaccggaggcccatcctcaccat

SEQ ID NO: 4662 - DNA, 51 bp, Artificial Sequence
  Synthetic polynucleotide
gccatgatgagatcacccaagtaatyggggtggcgaacaaagccccaccat

SEQ ID NO: 4663 - DNA, 51 bp, Artificial Sequence
  Synthetic polynucleotide
attaaaaaatatttttatttcctctrgggtcctactggtcctattggtcct

SEQ ID NO: 4664 - DNA, 51 bp, Artificial Sequence
  Synthetic polynucleotide
tcttgaaattgtatttaattttttcrgggccctcctggtcctcctggaact

SEQ ID NO: 4665 - DNA, 51 bp, Artificial Sequence
  Synthetic polynucleotide
cattgtgatgtcatgatactttcttdgggacctgttggacccagtggacct

SEQ ID NO: 4666 - DNA, 51 bp, Artificial Sequence
  Synthetic polynucleotide
aaaagagctcttgaaattgtatttarttttttcagggccctcctggtcctc

SEQ ID NO: 4667 - DNA, 51 bp, Artificial Sequence
  Synthetic polynucleotide
acagagtgtatcattatacttttctdggggcctggtggtgacaaaggagac

SEQ ID NO: 4668 - DNA, 51 bp, Artificial Sequence
  Synthetic polynucleotide
cttctcaattgaatgttttcatcttrgggccctgctggccctgctggtgct

SEQ ID NO: 4669 - DNA, 51 bp, Artificial Sequence
  Synthetic polynucleotide
agtaaataccgaccacttcttctttrgggtgctcctggtaagaatggagaa

SEQ ID NO: 4670 - DNA, 51 bp, Artificial Sequence
  Synthetic polynucleotide
ctttttggcaataatgaaaaggtaarttgatcaagagagaggaaataggca

SEQ ID NO: 4671 - DNA, 51 bp, Artificial Sequence
  Synthetic polynucleotide
agtgatggtcagtgtgtcgtagaggycacacagagtgtcaaatttccactc

SEQ ID NO: 4672 - DNA, 51 bp, Artificial Sequence
  Synthetic polynucleotide
tttgttacttgttggtgatttatgcygactccgccttctgttatcattcga

SEQ ID NO: 4673 - DNA, 51 bp, Artificial Sequence
  Synthetic polynucleotide
actgtcacggagttccagcccctctrttacgtggcagagagttttaatgat

SEQ ID NO: 4674 - DNA, 51 bp, Artificial Sequence
  Synthetic polynucleotide
ttccactgcacacagtacatcagacdtggatccaagcccatgtataccccc

SEQ ID NO: 4675 - DNA, 51 bp, Artificial Sequence
  Synthetic polynucleotide
attgcccagaacatagttggaatagygtttgccacagaggcccagagaaag

SEQ ID NO: 4676 - DNA, 51 bp, Artificial Sequence
  Synthetic polynucleotide
ccagctagccccagacttcggccccrtgcggctcacccgctgccaggctgc

SEQ ID NO: 4677 - DNA, 51 bp, Artificial Sequence
  Synthetic polynucleotide
gtatggacttggaagccctaggtccragagagccttggagaatttacttcc

SEQ ID NO: 4678 - DNA, 51 bp, Artificial Sequence
  Synthetic polynucleotide
taatgtatactgtatgtttacccaargaagtttcctatcagaggtttggaa

SEQ ID NO: 4679 - DNA, 51 bp, Artificial Sequence
  Synthetic polynucleotide
gcccatgaagacctcatagaaatcayaggacaagcctttggcaccaaacat

SEQ ID NO: 4680 - DNA, 51 bp, Artificial Sequence
  Synthetic polynucleotide
tgattccttcagcaggtacaggctgycatcttccagaaagctgtgggccaa

SEQ ID NO: 4681 - DNA, 51 bp, Artificial Sequence
  Synthetic polynucleotide
tgttctttctttctttataatttatrgattttgcatgctgaaacttctcaa

SEQ ID NO: 4682 - DNA, 51 bp, Artificial Sequence
  Synthetic polynucleotide
aaattaaacttctcccattcctttcrgagggaaccccttacctggaatctg

SEQ ID NO: 4683 - DNA, 51 bp, Artificial Sequence
  Synthetic polynucleotide
ggaaatgacaatcaagtttcttacaytgtatcaataatgttgccaactttg

SEQ ID NO: 4684 - DNA, 51 bp, Artificial Sequence
  Synthetic polynucleotide
ttttggaagagattcatagtcctccyggaaaacacaagactccccatgtta

SEQ ID NO: 4685 - DNA, 51 bp, Artificial Sequence
  Synthetic polynucleotide
accaatgccccgccgttctccacgaygggctataaagaagtaatcatcaca

SEQ ID NO: 4686 - DNA, 51 bp, Artificial Sequence
  Synthetic polynucleotide
aagccaccgatatctaggtaatccayaatttgtcatcctggctttcaaagt

SEQ ID NO: 4687 - DNA, 51 bp, Artificial Sequence
  Synthetic polynucleotide
gtcactcggatctttccagacaaggycagagtggggaggttgccctgcatc

SEQ ID NO: 4688 - DNA, 51 bp, Artificial Sequence
  Synthetic polynucleotide
tggttcccagaagactgagagttcarccgaaggtaaagaacaagaagagaa

SEQ ID NO: 4689 - DNA, 51 bp, Artificial Sequence
  Synthetic polynucleotide
ctgtggacccccaactctcactatgyggattcgaggctcatacttatgcaa

SEQ ID NO: 4690 - DNA, 51 bp, Artificial Sequence
  Synthetic polynucleotide
agccttccagacccagaagccattgraatctacctctctttcactgtttta

SEQ ID NO: 4691 - DNA, 51 bp, Artificial Sequence
  Synthetic polynucleotide
gctgggctcagcgatgggcccaaggrgccggcgccaaaggggcgcggcgcg

SEQ ID NO: 4692 - DNA, 51 bp, Artificial Sequence
  Synthetic polynucleotide
ccagcaggtcttcgatgccaagaacrtgatggctgcctgtgacccccgcca

SEQ ID NO: 4693 - DNA, 51 bp, Artificial Sequence
  Synthetic polynucleotide
tgcttctatttgttccctttcttacrgatttaatgtgtgccgaccatttcc

SEQ ID NO: 4694 - DNA, 51 bp, Artificial Sequence
  Synthetic polynucleotide
ctccgtcatgtgctgtgactgcttgyagatggccatggcgcggacgcgggt

SEQ ID NO: 4695 - DNA, 51 bp, Artificial Sequence
  Synthetic polynucleotide
tttcgacatagtgtggtggtgccctvtgagccgcctgaggtctggtttgca

SEQ ID NO: 4696 - DNA, 51 bp, Artificial Sequence
  Synthetic polynucleotide
ggctctgactgtaccaccatccactrcaactacatgtgtaacagttcctgc

SEQ ID NO: 4697 - DNA, 51 bp, Artificial Sequence
  Synthetic polynucleotide
cacagtccgaccctgagcacgcccaygttccccgcaggccggaacagcccc

SEQ ID NO: 4698 - DNA, 51 bp, Artificial Sequence
  Synthetic polynucleotide
atctaatattatctcttctgtatttrggttcgactagtgatagtggatggt

SEQ ID NO: 4699 - DNA, 51 bp, Artificial Sequence
  Synthetic polynucleotide
tctacagcagcaaaggccaccactcyttcccctgggagacataaaatcgtt

SEQ ID NO: 4700 - DNA, 51 bp, Artificial Sequence
  Synthetic polynucleotide
aaaagatcctgagaagaaaactcctyctacagcagcaaaggccaccactct

SEQ ID NO: 4701 - DNA, 51 bp, Artificial Sequence
  Synthetic polynucleotide
cactcgaacgacccattcaacgtctdcatcgagtccgatgcctggcaagag

SEQ ID NO: 4702 - DNA, 51 bp, Artificial Sequence
  Synthetic polynucleotide
ttcactgctgaacgaagtattgaagrtgaactaaatcgtgaaagtgacagt

SEQ ID NO: 4703 - DNA, 51 bp, Artificial Sequence
  Synthetic polynucleotide
ctggggctgtgtcccactcaccctgygcagagctgacacagtctgaaagga

SEQ ID NO: 4704 - DNA, 51 bp, Artificial Sequence
  Synthetic polynucleotide
gggtggccaggcgagagcgtggaggrgaacgccaatgtggtggtgcggctg

SEQ ID NO: 4705 - DNA, 51 bp, Artificial Sequence
  Synthetic polynucleotide
tttgtatatatattttttatctttcrgcctcagggatttagagatactgtt

SEQ ID NO: 4706 - DNA, 51 bp, Artificial Sequence
  Synthetic polynucleotide
tgtatttttaaaaatcatttcttatrggtatgttcacatacgatgaatcta

SEQ ID NO: 4707 - DNA, 51 bp, Artificial Sequence
  Synthetic polynucleotide
tccttggcaatgtaaacagccactcyggtttttccactccctgtagggagg

SEQ ID NO: 4708 - DNA, 51 bp, Artificial Sequence
  Synthetic polynucleotide
gccacacagaacaggaacagcaccaygtagatgattttgtacattacgatt

SEQ ID NO: 4709 - DNA, 51 bp, Artificial Sequence
  Synthetic polynucleotide
accgccaaacagaactacgtcaagcrcatgttcgtacacacaggtgagtgt

SEQ ID NO: 4710 - DNA, 51 bp, Artificial Sequence
  Synthetic polynucleotide
tgcctgatactacgtccatctcaccygttctgctcccaccatgctaattgg

SEQ ID NO: 4711 - DNA, 51 bp, Artificial Sequence
  Synthetic polynucleotide
aagcacatggccgactaccccgactrcaagtaccggccccggaaaaagccc

SEQ ID NO: 4712 - DNA, 51 bp, Artificial Sequence
  Synthetic polynucleotide
ttcagaccctgaggccgaggggggarcaatggggcccttgagggcccctcc

SEQ ID NO: 4713 - DNA, 51 bp, Artificial Sequence
  Synthetic polynucleotide
gatttacttcccgtggtttcttctcrgagctgaacaaatggccagtgttca

SEQ ID NO: 4714 - DNA, 51 bp, Artificial Sequence
  Synthetic polynucleotide
ggtgtctcctcatctcgctgctgtcyggaaggaaggaaggaatcacgccct

SEQ ID NO: 4715 - DNA, 51 bp, Artificial Sequence
  Synthetic polynucleotide
aatctcagccaagcttgttgcaaatrtgctatctgtagcaggtgcagatca

SEQ ID NO: 4716 - DNA, 51 bp, Artificial Sequence
  Synthetic polynucleotide
tcgccctcgccctcgacccgcagccrtggtgcccggggtgcccggcgcggt

SEQ ID NO: 4717 - DNA, 51 bp, Artificial Sequence
  Synthetic polynucleotide
tggtgcttctttgaggatgatgtcartgagttcacctgccctgtgtgtttc

SEQ ID NO: 4718 - DNA, 51 bp, Artificial Sequence
  Synthetic polynucleotide
cacaaagtcagctccacataaatgaytgagtttgcccttggacccatcatt

SEQ ID NO: 4719 - DNA, 51 bp, Artificial Sequence
  Synthetic polynucleotide
tttctctcacacctgaactttaagtygtctgtttggaagatctgtatagag

SEQ ID NO: 4720 - DNA, 51 bp, Artificial Sequence
  Synthetic polynucleotide
cttttctactccttgtattttgtgcrggtctgcagactcgtgaatgaggtc

SEQ ID NO: 4721 - DNA, 51 bp, Artificial Sequence
  Synthetic polynucleotide
gggcttcttgcattctgggacagccdagtctgtgacttgcacggtcagttg

SEQ ID NO: 4722 - DNA, 51 bp, Artificial Sequence
  Synthetic polynucleotide
cgtgtttgtgcctgtcctgggagagdccggcgcacagaggaagagaatctc

SEQ ID NO: 4723 - DNA, 51 bp, Artificial Sequence
  Synthetic polynucleotide
cccctgcctggctgccctccctctcrggtctgctggcaggactgtgggagt

SEQ ID NO: 4724 - DNA, 51 bp, Artificial Sequence
  Synthetic polynucleotide
tctcctccctgcttctgtctcctacrgccacctgaagtccaaaaagggtca

SEQ ID NO: 4725 - DNA, 51 bp, Artificial Sequence
  Synthetic polynucleotide
ggcttctcttttttttctgtccaccrgggagtaactattcccagtcagagg

SEQ ID NO: 4726 - DNA, 51 bp, Artificial Sequence
  Synthetic polynucleotide
atatattttaattttgtgcccttgcrgattgatcacttattcattagtaat

SEQ ID NO: 4727 - DNA, 51 bp, Artificial Sequence
  Synthetic polynucleotide
tggaaagggacgaactggtgtaatgrtatgtgcatatttattacatcgggg

SEQ ID NO: 4728 - DNA, 51 bp, Artificial Sequence
  Synthetic polynucleotide
taaattattttctgtttgatttgccdgtttagatgcaaaatccacaagtat

SEQ ID NO: 4729 - DNA, 51 bp, Artificial Sequence
  Synthetic polynucleotide
ggtccaacagcaacagtatatgggtragagttgtcaagattaaggcaaaca

SEQ ID NO: 4730 - DNA, 51 bp, Artificial Sequence
  Synthetic polynucleotide
tggaccaaaatagacaatcttgaagvtacaattgtcttaaactggagaaaa

SEQ ID NO: 4731 - DNA, 51 bp, Artificial Sequence
  Synthetic polynucleotide
catctgagcattgtgaccctggaggrggcaccatttgtcattgtggaaagt

SEQ ID NO: 4732 - DNA, 51 bp, Artificial Sequence
  Synthetic polynucleotide
tgtagctatacgttagctcttgcacrtgctgtgtggcaccattctagcatc

SEQ ID NO: 4733 - DNA, 51 bp, Artificial Sequence
  Synthetic polynucleotide
gaaacacatgaaattgtggcgatcargaaattcaaggacagtgaaggtaga

SEQ ID NO: 4734 - DNA, 51 bp, Artificial Sequence
  Synthetic polynucleotide
ctaatcaaggctattcactggtgccrtaagaatgatattgtccatcgaggt

SEQ ID NO: 4735 - DNA, 51 bp, Artificial Sequence
  Synthetic polynucleotide
agcgctccctatggaaagtccgtggrcatgtggtcggtgggctgtattctt

SEQ ID NO: 4736 - DNA, 51 bp, Artificial Sequence
  Synthetic polynucleotide
tgaccatgccagcccatgggccacgytgaaattccctttttcacacactgc

SEQ ID NO: 4737 - DNA, 51 bp, Artificial Sequence
  Synthetic polynucleotide
ctcctgcatgaaatgatacatgcctrtttatttgtcactaataacgacaaa

SEQ ID NO: 4738 - DNA, 51 bp, Artificial Sequence
  Synthetic polynucleotide
ggaggatgaactggaccaagccagcrcccctacagacgtgcgggatatcga

SEQ ID NO: 4739 - DNA, 51 bp, Artificial Sequence
  Synthetic polynucleotide
agggtcatgttcgtaggtgtatttcygttccaattcctccaactttttaag

SEQ ID NO: 4740 - DNA, 51 bp, Artificial Sequence
  Synthetic polynucleotide
gttggattcttccatgttcatcactyttgtgtttgtgcccagaatgttaaa

SEQ ID NO: 4741 - DNA, 51 bp, Artificial Sequence
  Synthetic polynucleotide
gatgcctgcacagttgacagctacayccacacggccaaactttccttttgc

SEQ ID NO: 4742 - DNA, 51 bp, Artificial Sequence
  Synthetic polynucleotide
cgcgcggaccgggagctacccggtgrgaagtcctggtgctggtaccgacct

SEQ ID NO: 4743 - DNA, 51 bp, Artificial Sequence
  Synthetic polynucleotide
cgagaaaaccgtcttcaccgtcttcrtgctagctgcctctggcatctgcat

SEQ ID NO: 4744 - DNA, 51 bp, Artificial Sequence
  Synthetic polynucleotide
ttacccccagcagaggtgaaggaagrcagtgcgtacgggagccagtcagtg

SEQ ID NO: 4745 - DNA, 51 bp, Artificial Sequence
  Synthetic polynucleotide
tgttacagaaattaagtattgcaacytactgagggctttgaaggctcttgg

SEQ ID NO: 4746 - DNA, 51 bp, Artificial Sequence
  Synthetic polynucleotide
ttcctcacaggtttctactccaaagrccacatcatcgaaaccgcaaacata

SEQ ID NO: 4747 - DNA, 51 bp, Artificial Sequence
  Synthetic polynucleotide
gtaatactttccaaaggcatggtctytgtcaatatttggatacagatactt

SEQ ID NO: 4748 - DNA, 51 bp, Artificial Sequence
  Synthetic polynucleotide
gggaaagtaacagcagaaagttcttycttcgtgtagggttcaaccgcatgg

SEQ ID NO: 4749 - DNA, 51 bp, Artificial Sequence
  Synthetic polynucleotide
gcattcgatgttcctcttaaagtggrtctcatcacctttgatacccccttt

SEQ ID NO: 4750 - DNA, 51 bp, Artificial Sequence
  Synthetic polynucleotide
tacttacatacttgtttaacacttcrgggaagaaaagtcagaagaccagga

SEQ ID NO: 4751 - DNA, 51 bp, Artificial Sequence
  Synthetic polynucleotide
  misc_feature (26)..(26): n is a, c, g, t or u
cttgtgtctttctgtttgtccccacngtccccagggaaaagcctttcgctc

SEQ ID NO: 4752 - DNA, 51 bp, Artificial Sequence
  Synthetic polynucleotide
tttccttctgcttcttttcccttgcrggaaacacatgaaattgtggcgatc

SEQ ID NO: 4753 - DNA, 51 bp, Artificial Sequence
  Synthetic polynucleotide
acaactttggactttgctatctttcrggttttgctcgtaatctgtcagaag

SEQ ID NO: 4754 - DNA, 51 bp, Artificial Sequence
  Synthetic polynucleotide
gatatacttcttttgtttttaacatrgaaaccaagccggcaaaagtactgc

SEQ ID NO: 4755 - DNA, 51 bp, Artificial Sequence
  Synthetic polynucleotide
ttggcagtgcaagtgcatgcctggcrgttgtactacagcaagaagctccta

SEQ ID NO: 4756 - DNA, 51 bp, Artificial Sequence
  Synthetic polynucleotide
aactgagctctatgggacaggagcartggattttggagtaggtggctttgt

SEQ ID NO: 4757 - DNA, 51 bp, Artificial Sequence
  Synthetic polynucleotide
tcgcaggcgcaggtctatgagctggrgcggcgcttcaagcagcagcggtac

SEQ ID NO: 4758 - DNA, 51 bp, Artificial Sequence
  Synthetic polynucleotide
cgccgaggtgggcgcgggcggcaacragagccgccttactctctccatgtc

SEQ ID NO: 4759 - DNA, 51 bp, Artificial Sequence
  Synthetic polynucleotide
gcggagcaacagagacatctgacgghaagcaacagcctatggtacagaata

SEQ ID NO: 4760 - DNA, 51 bp, Artificial Sequence
  Synthetic polynucleotide
gatgacccatattctgtttcttactrggaatcaaccctcaaaagcgtattg

SEQ ID NO: 4761 - DNA, 51 bp, Artificial Sequence
  Synthetic polynucleotide
ttcaatgagctgaagccagctgtggwtggggcaaacttcattgttaaccac

SEQ ID NO: 4762 - DNA, 51 bp, Artificial Sequence
  Synthetic polynucleotide
gcagggtttgtgcaagtttgcaaacrtgttcaccctgtctcagacctcgag

SEQ ID NO: 4763 - DNA, 51 bp, Artificial Sequence
  Synthetic polynucleotide
aatgcttcggactctcaagcaggaaracattgtggagttgaaggaagcatt

SEQ ID NO: 4764 - DNA, 51 bp, Artificial Sequence
  Synthetic polynucleotide
aattttttttttatcttgacactccrgatataaaaccagaaaatctcttaa

SEQ ID NO: 4765 - DNA, 51 bp, Artificial Sequence
  Synthetic polynucleotide
ttaatcagccacaatgatgtcctaaractgtgtgactttggtaagttaaaa

SEQ ID NO: 4766 - DNA, 51 bp, Artificial Sequence
  Synthetic polynucleotide
acttcaagggcttcttttatcgtttyaaggttgtctctttccttggttaga

SEQ ID NO: 4767 - DNA, 51 bp, Artificial Sequence
  Synthetic polynucleotide
attttaccaaatttttgtatttgatrgatcccattgaagaggaagatgcaa

SEQ ID NO: 4768 - DNA, 51 bp, Artificial Sequence
  Synthetic polynucleotide
gtgtttaaaactatgcaaatggtaaytgcaagatctacaaaaggatccatt

SEQ ID NO: 4769 - DNA, 51 bp, Artificial Sequence
  Synthetic polynucleotide
  misc_feature (26)..(26): n is a, c, g, t or u
tattagtattaatttgtattattcantttttttccccagtatgagaataat

SEQ ID NO: 4770 - DNA, 51 bp, Artificial Sequence
  Synthetic polynucleotide
ttaatacagattttaaattctttacrgtgcacttcagaaggagatcacaac

SEQ ID NO: 4771 - DNA, 51 bp, Artificial Sequence
  Synthetic polynucleotide
atccagaccaccttcatagccaacaytgtcaaaagcaaaactcttcttcat

SEQ ID NO: 4772 - DNA, 51 bp, Artificial Sequence
  Synthetic polynucleotide
atgtgggacattattttttctttgcragggagaactaatgcctcacaggac

SEQ ID NO: 4773 - DNA, 51 bp, Artificial Sequence
  Synthetic polynucleotide
taagtcaggaggtatttcttgttctrgggtgaatttgtgaatgagtatgtg

SEQ ID NO: 4774 - DNA, 51 bp, Artificial Sequence
  Synthetic polynucleotide
aaaggaaactatgctcggttcatgartcattgctgccagcccaactgtgaa

SEQ ID NO: 4775 - DNA, 51 bp, Artificial Sequence
  Synthetic polynucleotide
ggtgaaatcacaaaggagcgagaagrtgagtgttttagttgtggggatgct

SEQ ID NO: 4776 - DNA, 51 bp, Artificial Sequence
  Synthetic polynucleotide
aatcctagacatggttcaagtgaggrctacctacacatggtgcacaggcta

SEQ ID NO: 4777 - DNA, 51 bp, Artificial Sequence
  Synthetic polynucleotide
tgtttttttctcttcatttttctttrgcttgatatgcaacgaggtgttcat

SEQ ID NO: 4778 - DNA, 51 bp, Artificial Sequence
  Synthetic polynucleotide
ccactacgacgacccgggcaagggcractactggatgctggacccgtcgag

SEQ ID NO: 4779 - DNA, 51 bp, Artificial Sequence
  Synthetic polynucleotide
aagccaaaacgactgcaggagtggtrcaaaaagatgctggacaaggcgttt

SEQ ID NO: 4780 - DNA, 51 bp, Artificial Sequence
  Synthetic polynucleotide
ctcacctgctccttctggacttcctrgggctgcagaccacaagactgggaa

SEQ ID NO: 4781 - DNA, 51 bp, Artificial Sequence
  Synthetic polynucleotide
ttttttttttctccttattgttttargatctattctccagatcacactaac

SEQ ID NO: 4782 - DNA, 51 bp, Artificial Sequence
  Synthetic polynucleotide
ttaactttgtctcttctcttcttatrggacctgtacctgcctctgtccttg

SEQ ID NO: 4783 - DNA, 51 bp, Artificial Sequence
  Synthetic polynucleotide
tgtgcgtgtgcttctgaacaagaagrcagcccactcttttgagcaagtcct

SEQ ID NO: 4784 - DNA, 51 bp, Artificial Sequence
  Synthetic polynucleotide
ggagaacaaggactttgtgcgccccragctggttaccatcatccgcagtgg

SEQ ID NO: 4785 - DNA, 51 bp, Artificial Sequence
  Synthetic polynucleotide
caacagtgcacaggccagggagaacraggactttgtgcgccccaagctggt

SEQ ID NO: 4786 - DNA, 51 bp, Artificial Sequence
  Synthetic polynucleotide
caatcccaactggtctgtcaacgtadaaacatctgccaatatgaaagcccc

SEQ ID NO: 4787 - DNA, 51 bp, Artificial Sequence
  Synthetic polynucleotide
gacaacttctttaaaaaggtggagtrcaccaagaatgtcaatcccaactgg

SEQ ID NO: 4788 - DNA, 51 bp, Artificial Sequence
  Synthetic polynucleotide
aattgaaaaaatgggaggcgcgacargtagaggagaaaattcctatggtct

SEQ ID NO: 4789 - DNA, 51 bp, Artificial Sequence
  Synthetic polynucleotide
actgtcatacttctcctttgcccccrggacatgagaaacctgaggttcgct

SEQ ID NO: 4790 - DNA, 51 bp, Artificial Sequence
  Synthetic polynucleotide
gacttgaatttctttttttcctcacrgggcttgcccaatcaccattggaga

SEQ ID NO: 4791 - DNA, 51 bp, Artificial Sequence
  Synthetic polynucleotide
acagggcttgcccaatcaccattggrgaataacttttattaataagtgcta

SEQ ID NO: 4792 - DNA, 51 bp, Artificial Sequence
  Synthetic polynucleotide
ttggtggttccgtatcgtgcctcagrtgatgacctccggagagttgcaact

SEQ ID NO: 4793 - DNA, 51 bp, Artificial Sequence
  Synthetic polynucleotide
caatttttgattataattttggatcrtctgtatagttgccgatttggtact

SEQ ID NO: 4794 - DNA, 51 bp, Artificial Sequence
  Synthetic polynucleotide
tttgagatccttggggttgtaggtgraggtaagttggaatttttgcgttcc

SEQ ID NO: 4795 - DNA, 51 bp, Artificial Sequence
  Synthetic polynucleotide
gtggctaccaacattgatgagatctrtaaggccctgtcccgcaatagcagt

SEQ ID NO: 4796 - DNA, 51 bp, Artificial Sequence
  Synthetic polynucleotide
cctgccaccattcccctgtttgcacrggctgaccggtaccagcgcctgaag

SEQ ID NO: 4797 - DNA, 51 bp, Artificial Sequence
  Synthetic polynucleotide
gcctaacttgatttagggggaagaarccttaagaatagaggatatccttga

SEQ ID NO: 4798 - DNA, 51 bp, Artificial Sequence
  Synthetic polynucleotide
  misc_feature (26)..(26): n is a, c, g, t or u
ttggacatcctggataccgccggccnggaggagtacagcgccatgcgggac

SEQ ID NO: 4799 - DNA, 51 bp, Artificial Sequence
  Synthetic polynucleotide
ctagctggagggctgcatgcagggarggtcattaaaggttggtgatgaaac

SEQ ID NO: 4800 - DNA, 51 bp, Artificial Sequence
  Synthetic polynucleotide
tccattgcctacaccctgaccagcadtatcccggagatcacgcccttcctg

SEQ ID NO: 4801 - DNA, 51 bp, Artificial Sequence
  Synthetic polynucleotide
cagtgccgtagctcttatctagcaartgaaatcctgtggggccaccgctat

SEQ ID NO: 4802 - DNA, 51 bp, Artificial Sequence
  Synthetic polynucleotide
tacacttacagttttgtctttcacaytccaaaacacagcagctccttccct

SEQ ID NO: 4803 - DNA, 51 bp, Artificial Sequence
  Synthetic polynucleotide
gaaccttccaaactgaagcgctcctdctcctccccagatataacccaggct

SEQ ID NO: 4804 - DNA, 51 bp, Artificial Sequence
  Synthetic polynucleotide
caatgtttcagctctacgcactttcrgggtactgagggctttgaaaactat

SEQ ID NO: 4805 - DNA, 51 bp, Artificial Sequence
  Synthetic polynucleotide
ccccaggcaagccaggaagcagacartgttctgatcctgcaggacaggaag

SEQ ID NO: 4806 - DNA, 51 bp, Artificial Sequence
  Synthetic polynucleotide
gtccaaggcgcggcgcatggccgccracgtgcgggagcgcaagcgcatcct

SEQ ID NO: 4807 - DNA, 51 bp, Artificial Sequence
  Synthetic polynucleotide
gagtgagacgctgatgggaggatggrcgtactggtgtctgagtgctccgcg

SEQ ID NO: 4808 - DNA, 51 bp, Artificial Sequence
  Synthetic polynucleotide
tggcgagtgagacgctgatgggaggrtggacgtactggtgtctgagtgctc

SEQ ID NO: 4809 - DNA, 51 bp, Artificial Sequence
  Synthetic polynucleotide
ccgctggtggccgtgtattacaccarccgggccttgtgctacctgaagatg

SEQ ID NO: 4810 - DNA, 51 bp, Artificial Sequence
  Synthetic polynucleotide
atgggcatcctctgtcctatctcccrgatacagcatcatgcaggcctgctg

SEQ ID NO: 4811 - DNA, 51 bp, Artificial Sequence
  Synthetic polynucleotide
cataaggccccagcattcctgtatgrtatctacctcaggatgactggaaga

SEQ ID NO: 4812 - DNA, 51 bp, Artificial Sequence
  Synthetic polynucleotide
gccatcccaggcaggcgagtgttgcyctgcagacccagaatcacagccttg

SEQ ID NO: 4813 - DNA, 51 bp, Artificial Sequence
  Synthetic polynucleotide
tttgtgaaactgctttttgaaacagrgaaaatagatatagtactacatttt

SEQ ID NO: 4814 - DNA, 51 bp, Artificial Sequence
  Synthetic polynucleotide
tctgttttgttttccaagacccaccratgacatgagatacccaatgaagtc

SEQ ID NO: 4815 - DNA, 51 bp, Artificial Sequence
  Synthetic polynucleotide
gctcgacaggatattgaccaccgccygcggggataaagccagggagctggt

SEQ ID NO: 4816 - DNA, 51 bp, Artificial Sequence
  Synthetic polynucleotide
catcgccgggggctcgctgtcctccrcccccatgagcacgccgtgcagctc

SEQ ID NO: 4817 - DNA, 51 bp, Artificial Sequence
  Synthetic polynucleotide
acctctagcacttctctatgccaccrtcttcgggaatgtgacgactatttt

SEQ ID NO: 4818 - DNA, 51 bp, Artificial Sequence
  Synthetic polynucleotide
ttcgggaatgtgacgactattttccracagatgtatgccaacaccaacaga

SEQ ID NO: 4819 - DNA, 51 bp, Artificial Sequence
  Synthetic polynucleotide
ggacagaagaaactgtgccacttgtrtcaggaccacatgcagtacatcgga

SEQ ID NO: 4820 - DNA, 51 bp, Artificial Sequence
  Synthetic polynucleotide
gccaagtttttattccttttctcttycattcgcttctttatgtcttcaaga

SEQ ID NO: 4821 - DNA, 51 bp, Artificial Sequence
  Synthetic polynucleotide
acttagctacccactctatacccacrgaacggccacggcttcagctgccca

SEQ ID NO: 4822 - DNA, 51 bp, Artificial Sequence
  Synthetic polynucleotide
gctcaagaatggccaggagatccagrtgagcggcaggtgcagcctggggtg

SEQ ID NO: 4823 - DNA, 51 bp, Artificial Sequence
  Synthetic polynucleotide
tgttactatcttttgcttcttctgcrggaatcagaaggtcagggctgtcct

SEQ ID NO: 4824 - DNA, 51 bp, Artificial Sequence
  Synthetic polynucleotide
ttcttcatgcgctccaggtgggcgcyggtgtcctgctccttcttcagctcc

SEQ ID NO: 4825 - DNA, 51 bp, Artificial Sequence
  Synthetic polynucleotide
caagacaacctggcagatgctgaggrgcgctgtgatcagctgatcaaaaac

SEQ ID NO: 4826 - DNA, 51 bp, Artificial Sequence
  Synthetic polynucleotide
aatatcaaggggaagcctgaagcccrcttctccctgatccactatgccggc

SEQ ID NO: 4827 - DNA, 51 bp, Artificial Sequence
  Synthetic polynucleotide
caccacatgtttgtgctggagcaggrggagtacaagaaggagggcatcgag

SEQ ID NO: 4828 - DNA, 51 bp, Artificial Sequence
  Synthetic polynucleotide
gctgctgaagagtgcagaaagagagraggagatggcctccatgaaggagga

SEQ ID NO: 4829 - DNA, 51 bp, Artificial Sequence
  Synthetic polynucleotide
ctttcagactgtgtcagctctgcacrgggtgagtgggacacagccccagcc

SEQ ID NO: 4830 - DNA, 51 bp, Artificial Sequence
  Synthetic polynucleotide
cttccagaggctgacaagtctgcctrcctcatggggctgaactcagccgac

SEQ ID NO: 4831 - DNA, 51 bp, Artificial Sequence
  Synthetic polynucleotide
tacattgcactgtccccatctcaacrggtgctggagcagccggagtcctcc

SEQ ID NO: 4832 - DNA, 51 bp, Artificial Sequence
  Synthetic polynucleotide
tctgctaccgctgccccccttcccarggctacaatgacgactactatgaag

SEQ ID NO: 4833 - DNA, 51 bp, Artificial Sequence
  Synthetic polynucleotide
gtgcctctggctgccctggctgtccrctgccatgacacctatggtcaagcc

SEQ ID NO: 4834 - DNA, 51 bp, Artificial Sequence
  Synthetic polynucleotide
ctacgtgcccttctctgctggccccrggaactgtataggtttgtatccatc

SEQ ID NO: 4835 - DNA, 51 bp, Artificial Sequence
  Synthetic polynucleotide
gtcagcagggtggtctctattccacrgggcctacgcttctcaggggtcaat

SEQ ID NO: 4836 - DNA, 51 bp, Artificial Sequence
  Synthetic polynucleotide
tttgaattatttcattctttttctcrgttagtgattggcaactttggcctc

SEQ ID NO: 4837 - DNA, 51 bp, Artificial Sequence
  Synthetic polynucleotide
gtgtgattttcatggtgttttaaacrggaagaaacattaccaaggtcctca

SEQ ID NO: 4838 - DNA, 51 bp, Artificial Sequence
  Synthetic polynucleotide
aatatatattaatctttcattttccrgctgcgagttttcaagttggcaaaa

SEQ ID NO: 4839 - DNA, 51 bp, Artificial Sequence
  Synthetic polynucleotide
cctcaccctctgtggctgtgttttcrggcgttgggactccagctgcagctg

SEQ ID NO: 4840 - DNA, 51 bp, Artificial Sequence
  Synthetic polynucleotide
tgacattgctgggcctggggcttacrggatgcccaggctgaggaagagatc

SEQ ID NO: 4841 - DNA, 51 bp, Artificial Sequence
  Synthetic polynucleotide
tgattttgacttcacggtaactgggrgagggagcccctcccggcgagagca

SEQ ID NO: 4842 - DNA, 51 bp, Artificial Sequence
  Synthetic polynucleotide
cttgtcctgggacaaggaaggggagrggtgggagtgcgagggatccctccc

SEQ ID NO: 4843 - DNA, 51 bp, Artificial Sequence
  Synthetic polynucleotide
tatttgaatccttgctctgcgatggrctattccctggctgcagccctcact

SEQ ID NO: 4844 - DNA, 51 bp, Artificial Sequence
  Synthetic polynucleotide
cacgctgtttgtggagacatccctgrgacggccacaggacaaggatgccaa

SEQ ID NO: 4845 - DNA, 51 bp, Artificial Sequence
  Synthetic polynucleotide
tcaaacctaagaaatatgtctgataraagagttactttgatagagtaaata

SEQ ID NO: 4846 - DNA, 51 bp, Artificial Sequence
  Synthetic polynucleotide
atttgctgtaaatcaaatcatgggcrgccaagacttcctggtgctagcaat

SEQ ID NO: 4847 - DNA, 51 bp, Artificial Sequence
  Synthetic polynucleotide
tgccacttccctgcggcccccacccrggtacatctttgagtccatcggtgc

SEQ ID NO: 4848 - DNA, 51 bp, Artificial Sequence
  Synthetic polynucleotide
cgatcagccccttaacacgactcgtdtaaatgctgctgaaatagaaagcag

SEQ ID NO: 4849 - DNA, 51 bp, Artificial Sequence
  Synthetic polynucleotide
tcccaggcctccctggagcacgaggrgggcaagatcctccgggcccagctg

SEQ ID NO: 4850 - DNA, 51 bp, Artificial Sequence
  Synthetic polynucleotide
aacgagaggctggaggatgaggaggrgatgaatgctgagctcactgccaag

SEQ ID NO: 4851 - DNA, 51 bp, Artificial Sequence
  Synthetic polynucleotide
ctggtcatgcaccagctgcgctgcartggtgtgctggagggcatccgcatc

SEQ ID NO: 4852 - DNA, 51 bp, Artificial Sequence
  Synthetic polynucleotide
ctgcagaagaacaaggatcctctcartgagactgtcgtgggcttgtatcag

SEQ ID NO: 4853 - DNA, 51 bp, Artificial Sequence
  Synthetic polynucleotide
catgtccatcctggaagaggagtgcrtgttccccaaggccaccgacatgac

SEQ ID NO: 4854 - DNA, 51 bp, Artificial Sequence
  Synthetic polynucleotide
gctgcagcagttcttcaaccaccacrtgtttgtgctggagcaggaggagta

SEQ ID NO: 4855 - DNA, 51 bp, Artificial Sequence
  Synthetic polynucleotide
ttcaactggatggtgacgcgcatcavtgccaccctggagaccaagcagcca

SEQ ID NO: 4856 - DNA, 51 bp, Artificial Sequence
  Synthetic polynucleotide
agggtggcattgatgcgcgtcaccahccagttgaacatcctctcatacact

SEQ ID NO: 4857 - DNA, 51 bp, Artificial Sequence
  Synthetic polynucleotide
ttcagaggagaaaaactccatgtatragctgacaggcgccatcatgcactt

SEQ ID NO: 4858 - DNA, 51 bp, Artificial Sequence
  Synthetic polynucleotide
caggaaagttggcatctgcagacatrgagacctgtgagtgccatgaatctg

SEQ ID NO: 4859 - DNA, 51 bp, Artificial Sequence
  Synthetic polynucleotide
attgcagccattggggaccgcagcargaaggaccagagcccgggcaaggta

SEQ ID NO: 4860 - DNA, 51 bp, Artificial Sequence
  Synthetic polynucleotide
actgagtggaatggagggccgcaagvaaaagtttgagagctgagccttcct

SEQ ID NO: 4861 - DNA, 51 bp, Artificial Sequence
  Synthetic polynucleotide
gcaggtgaagaaggaggacaccgagraggtgagtgtgggctaaggccagga

SEQ ID NO: 4862 - DNA, 51 bp, Artificial Sequence
  Synthetic polynucleotide
tgactcttttcctccctctcatttcrggttcacagcaaaggactgaagcta

SEQ ID NO: 4863 - DNA, 51 bp, Artificial Sequence
  Synthetic polynucleotide
gatgtgtgttctgaaattgtgaaccvtgagtctagtacttaatgatctgct

SEQ ID NO: 4864 - DNA, 51 bp, Artificial Sequence
  Synthetic polynucleotide
tatttaaccacagttcttttcccgtrggctgatccttattcaaaatgggcc

SEQ ID NO: 4865 - DNA, 51 bp, Artificial Sequence
  Synthetic polynucleotide
agttatatacatttttttcctcctcrgaacctaaaaataaaatatgtgttt

SEQ ID NO: 4866 - DNA, 51 bp, Artificial Sequence
  Synthetic polynucleotide
ttctggggctgtttttgtctcctctrgcgtgcccaaagagctgaaaagatt

SEQ ID NO: 4867 - DNA, 51 bp, Artificial Sequence
  Synthetic polynucleotide
ctgtaccaccatccactacaactacrtgtgtaacagttcctgcatgggcgg

SEQ ID NO: 4868 - DNA, 51 bp, Artificial Sequence
  Synthetic polynucleotide
gatgcttgagtacgaaccggccaagrggttctccatccggcagatccggca

SEQ ID NO: 4869 - DNA, 51 bp, Artificial Sequence
  Synthetic polynucleotide
tctctggaactggaggacctctcctrtgtacggataccaggatccttcaag

SEQ ID NO: 4870 - DNA, 51 bp, Artificial Sequence
  Synthetic polynucleotide
atggaagagcctgtgaccatcccagrcaagcccaatagcgaagaggagatt

SEQ ID NO: 4871 - DNA, 51 bp, Artificial Sequence
  Synthetic polynucleotide
gtatgagcaatcatctgttgttttcrggagggacgaagatggtgtgcagat

SEQ ID NO: 4872 - DNA, 51 bp, Artificial Sequence
  Synthetic polynucleotide
tgaccagttgccatggcatcctactrcgagatcctagacgtgccgcgaagt

SEQ ID NO: 4873 - DNA, 51 bp, Artificial Sequence
  Synthetic polynucleotide
aatctaattactgaagagactactcrtgttgttatgaaaacaggtatacca

SEQ ID NO: 4874 - DNA, 51 bp, Artificial Sequence
  Synthetic polynucleotide
gtagatgaaatgatcagagaagcagrtattgatggagacggacaagtcaac

SEQ ID NO: 4875 - DNA, 51 bp, Artificial Sequence
  Synthetic polynucleotide
ttgtattattatttttttaattttcrggggcgacagccagttttgtagtca

SEQ ID NO: 4876 - DNA, 51 bp, Artificial Sequence
  Synthetic polynucleotide
tcctgcctctcttttctccccatacrggacgggctctacgagtgcattctc

SEQ ID NO: 4877 - DNA, 51 bp, Artificial Sequence
  Synthetic polynucleotide
agtggaacagcatcctgagtatgagyacgtccaatcttgatgatctgtgca

SEQ ID NO: 4878 - DNA, 51 bp, Artificial Sequence
  Synthetic polynucleotide
ataaaaacttgtttctattttatttrgagcttaacttagatagcagtaatt

SEQ ID NO: 4879 - DNA, 51 bp, Artificial Sequence
  Synthetic polynucleotide
attcccagtcagaggcgctatgtgtrttattatagctacctgttaaagaat

SEQ ID NO: 4880 - DNA, 51 bp, Artificial Sequence
  Synthetic polynucleotide
ctggtcgacggctacaatgtgcactrtggcgcccgctccatcaaacatgag

SEQ ID NO: 4881 - DNA, 51 bp, Artificial Sequence
  Synthetic polynucleotide
tcctggaactcggacatgtccagcchgatgaagccctgtgtggaaacaagc

SEQ ID NO: 4882 - DNA, 51 bp, Artificial Sequence
  Synthetic polynucleotide
ctcacccgtcccctctcctctgcagractatgaacacttatttaaggtgaa

SEQ ID NO: 4883 - DNA, 51 bp, Artificial Sequence
  Synthetic polynucleotide
tacttagctgacttggagctagatgrggtggaagacttccttggagagctg

SEQ ID NO: 4884 - DNA, 51 bp, Artificial Sequence
  Synthetic polynucleotide
ataggctgcacacggctggtgtccaygatggcggcgcggcggcggtctggc

SEQ ID NO: 4885 - DNA, 51 bp, Artificial Sequence
  Synthetic polynucleotide
tcccatcttctgggcctccagaccaragagttacatctaccgtacccagga

SEQ ID NO: 4886 - DNA, 51 bp, Artificial Sequence
  Synthetic polynucleotide
ctttggtccacctgggaatgggaagrcaatgctggtaagggttctcttcaa

SEQ ID NO: 4887 - DNA, 51 bp, Artificial Sequence
  Synthetic polynucleotide
taaatccataaggttaagttggaccyacagagggaagggaaagagaagcgc

SEQ ID NO: 4888 - DNA, 51 bp, Artificial Sequence
  Synthetic polynucleotide
tcatttacgtcttttgtgcatctatdggagaaggagaaggaagagttggta

SEQ ID NO: 4889 - DNA, 51 bp, Artificial Sequence
  Synthetic polynucleotide
aacaccccctttctttttttttcaargcgaaggacaaggttgcccttttga

SEQ ID NO: 4890 - DNA, 51 bp, Artificial Sequence
  Synthetic polynucleotide
ggagaaggcctgggaggagatacacrtttcgacaatgctgagaagtggact

SEQ ID NO: 4891 - DNA, 51 bp, Artificial Sequence
  Synthetic polynucleotide
caccctagaactgctttcttttcagrtgccccatggtgtggtcactgcaaa

SEQ ID NO: 4892 - DNA, 51 bp, Artificial Sequence
  Synthetic polynucleotide
tgctcgcatcccgcaggctcacctgyttctccggcgtggaagaagtaaggc

SEQ ID NO: 4893 - DNA, 51 bp, Artificial Sequence
  Synthetic polynucleotide
taccacatcatccatgctgacatctrccgctggtttaacatttcgtttgat

SEQ ID NO: 4894 - DNA, 51 bp, Artificial Sequence
  Synthetic polynucleotide
tctgtataaaaataatctctttttcrggaaaacatactaagagaatcactt

SEQ ID NO: 4895 - DNA, 51 bp, Artificial Sequence
  Synthetic polynucleotide
tgcagaaagacttgaaggcgtatacrggaacaatattgatgatgtagtaag

SEQ ID NO: 4896 - DNA, 51 bp, Artificial Sequence
  Synthetic polynucleotide
gttttaaggtttttggattcaaagcdtaaaaaccattacaagatatacaat

SEQ ID NO: 4897 - DNA, 51 bp, Artificial Sequence
  Synthetic polynucleotide
tattctgaggttatctttttaccacrgttgcacaatatccttttgaagacc

SEQ ID NO: 4898 - DNA, 51 bp, Artificial Sequence
  Synthetic polynucleotide
gaacttatcaaacccttttgtgaagrtcttgaccaatggctaagtgaagat

SEQ ID NO: 4899 - DNA, 51 bp, Artificial Sequence
  Synthetic polynucleotide
caccagggagtaactattcccagtcrgaggcgctatgtgtattattatagc

SEQ ID NO: 4900 - DNA, 51 bp, Artificial Sequence
  Synthetic polynucleotide
ttttcttttctttttttttttttttdggacaaaatgtttcacttttgggta

SEQ ID NO: 4901 - DNA, 51 bp, Artificial Sequence
  Synthetic polynucleotide
atccgcgatcaatccctgcaggaggrgctggctcgccagcatgctaacgag

SEQ ID NO: 4902 - DNA, 51 bp, Artificial Sequence
  Synthetic polynucleotide
gcttttaattgtgtttgtttttttcrgggagtcatttaatacttcatgatt

SEQ ID NO: 4903 - DNA, 51 bp, Artificial Sequence
  Synthetic polynucleotide
agcctatggagttgtacttaaatgcrgacacaaggcaagtacattattttt

SEQ ID NO: 4904 - DNA, 51 bp, Artificial Sequence
  Synthetic polynucleotide
cacaatgatgtcctaaaactgtgtgrctttggtaagttaaaaagaaattaa

SEQ ID NO: 4905 - DNA, 51 bp, Artificial Sequence
  Synthetic polynucleotide
atatgataaaaatgtcttctcatttrggaaaagtcctgaaaatattagtca

SEQ ID NO: 4906 - DNA, 51 bp, Artificial Sequence
  Synthetic polynucleotide
catcgtcagcttcttcgtgctcaacrtgttcgtgggcgtcgtggtcgagaa

SEQ ID NO: 4907 - DNA, 51 bp, Artificial Sequence
  Synthetic polynucleotide
tgtttaatttgaattctatttcactrgttccttccaggaggtactttatgc

SEQ ID NO: 4908 - DNA, 51 bp, Artificial Sequence
  Synthetic polynucleotide
aatactttgagaggttggagaaggtraaaataaatgtggggagatgatgag

SEQ ID NO: 4909 - DNA, 51 bp, Artificial Sequence
  Synthetic polynucleotide
ccggactactgcctatcaccattgcrctttattatgtagtactgatgggac

SEQ ID NO: 4910 - DNA, 51 bp, Artificial Sequence
  Synthetic polynucleotide
aaccctggaagctcagttaagggagrctgtgggaacccatctgttggaatt

SEQ ID NO: 4911 - DNA, 51 bp, Artificial Sequence
  Synthetic polynucleotide
taattgttattatttttgtgtgtgcrggtttcattggtcagtttaacagca

SEQ ID NO: 4912 - DNA, 51 bp, Artificial Sequence
  Synthetic polynucleotide
tttattgtgacgcttagcctggtagracttggactcgccaatgtggaagga

SEQ ID NO: 4913 - DNA, 51 bp, Artificial Sequence
  Synthetic polynucleotide
gtcattggatagtgctccatggccahgaaaagagtatttaagacaatacag

SEQ ID NO: 4914 - DNA, 51 bp, Artificial Sequence
  Synthetic polynucleotide
agaggtactcctccccacaccaggtrtggcactgctgagtttactgatgca

SEQ ID NO: 4915 - DNA, 51 bp, Artificial Sequence
  Synthetic polynucleotide
tgtgtgaaagctggtagaaatcccadttatggctacacaagctttgatacc

SEQ ID NO: 4916 - DNA, 51 bp, Artificial Sequence
  Synthetic polynucleotide
ttgcagccaatgtccagagggatatrtgtgtgtgaaagctggtagaaatcc

SEQ ID NO: 4917 - DNA, 51 bp, Artificial Sequence
  Synthetic polynucleotide
acttgcagccaatgtccagagggatrtatgtgtgtgaaagctggtagaaat

SEQ ID NO: 4918 - DNA, 51 bp, Artificial Sequence
  Synthetic polynucleotide
cactattttgacaaactgtgtgtttrtgacaatgagtaaccctcctgattg

SEQ ID NO: 4919 - DNA, 51 bp, Artificial Sequence
  Synthetic polynucleotide
tagctattaagattttggtacattcrtatcctttttcaagtgattaatatt

SEQ ID NO: 4920 - DNA, 51 bp, Artificial Sequence
  Synthetic polynucleotide
tcggcacctgtgacagccacaatccyccggatacccttggcaatggcttct

SEQ ID NO: 4921 - DNA, 51 bp, Artificial Sequence
  Synthetic polynucleotide
tattctccatgctcgctcccgggccygcaacagagagagagagacctctca

SEQ ID NO: 4922 - DNA, 51 bp, Artificial Sequence
  Synthetic polynucleotide
actgggaatgtgtatttgctttgcavactcctatcccccacctccaaacag

SEQ ID NO: 4923 - DNA, 51 bp, Artificial Sequence
  Synthetic polynucleotide
actgaggggactggtggctgttgtcrggcttctcggtggaagggccatcgc

SEQ ID NO: 4924 - DNA, 51 bp, Artificial Sequence
  Synthetic polynucleotide
ggagacctatgacttcgacagcatcrtgcattacgctcggaacacattctc

SEQ ID NO: 4925 - DNA, 51 bp, Artificial Sequence
  Synthetic polynucleotide
ggagccaggacaaaggcttttgttcrggtagcacttcctttttctcctttc

SEQ ID NO: 4926 - DNA, 51 bp, Artificial Sequence
  Synthetic polynucleotide
gtccaattcaatgttacagaaacccrctgcctatgtgcggcccatggacgg

SEQ ID NO: 4927 - DNA, 51 bp, Artificial Sequence
  Synthetic polynucleotide
aatgtcaagctggccctggacatcgrgatcgccacctacaggaagctgcta

SEQ ID NO: 4928 - DNA, 51 bp, Artificial Sequence
  Synthetic polynucleotide
tgaccgctttgccagctacatcgagraggttcgcttcctggaacagcaaaa

SEQ ID NO: 4929 - DNA, 51 bp, Artificial Sequence
  Synthetic polynucleotide
atttgctgttcttcacagctttaggrtatgtatccaatgttttcttcaggt

SEQ ID NO: 4930 - DNA, 51 bp, Artificial Sequence
  Synthetic polynucleotide
acctttctccagctaattcatctggrgatcaaacccgcaatccggaaccag

SEQ ID NO: 4931 - DNA, 51 bp, Artificial Sequence
  Synthetic polynucleotide
cgtccccacagcctgatgttcaccarggtgaagctggagcaggtgctgaaa

SEQ ID NO: 4932 - DNA, 51 bp, Artificial Sequence
  Synthetic polynucleotide
tgagctcaagaaagaaaagcaagtcraccaacgaattgaaaatatgatgca

SEQ ID NO: 4933 - DNA, 51 bp, Artificial Sequence
  Synthetic polynucleotide
agaactgttaccattaagttgaagartgtgaattttgaagtaaaaactcgt

SEQ ID NO: 4934 - DNA, 51 bp, Artificial Sequence
  Synthetic polynucleotide
atttgccattgctaaggaattgctaraaacagaaattgatgctgattttcc

SEQ ID NO: 4935 - DNA, 51 bp, Artificial Sequence
  Synthetic polynucleotide
ggaaatcgagtagaaggtgtaaccayctggggaggtaggttcaggaaacca

SEQ ID NO: 4936 - DNA, 51 bp, Artificial Sequence
  Synthetic polynucleotide
tgaaatcgtggtcatactggaaggcrtggtggaagccactgccatgacgac

SEQ ID NO: 4937 - DNA, 51 bp, Artificial Sequence
  Synthetic polynucleotide
gacatcatccagcggctgtggaaggrctccggtatccaggcctgttttgag

SEQ ID NO: 4938 - DNA, 51 bp, Artificial Sequence
  Synthetic polynucleotide
cagtccctgcaggtgtcttgcccctrtgactccatgaagcactgggggagg

SEQ ID NO: 4939 - DNA, 51 bp, Artificial Sequence
  Synthetic polynucleotide
actggacatagcaaggaagctggatrtgtatggcatcaggcctcaccccgc

SEQ ID NO: 4940 - DNA, 51 bp, Artificial Sequence
  Synthetic polynucleotide
tcactctcaacagtaatcttctccayggtcaagtcagcctcaggggagctc

SEQ ID NO: 4941 - DNA, 51 bp, Artificial Sequence
  Synthetic polynucleotide
agtttcttccacttggaccaccaccrcctcggccacaggtctacccacctt

SEQ ID NO: 4942 - DNA, 51 bp, Artificial Sequence
  Synthetic polynucleotide
gccaactcggaggagatcgccttctrtgggggccatgaggtggggcaggtt

SEQ ID NO: 4943 - DNA, 51 bp, Artificial Sequence
  Synthetic polynucleotide
aggacgcctaccatgggctggctgcdctgggagcgcttcatgtgcaacctt

SEQ ID NO: 4944 - DNA, 51 bp, Artificial Sequence
  Synthetic polynucleotide
ccctgaccctgtccctctcctggccrggaaataccacacacacttgctaca

SEQ ID NO: 4945 - DNA, 51 bp, Artificial Sequence
  Synthetic polynucleotide
ttgctcaattccagtctttaccaccyaaaaaacatataaagcacttgctca

SEQ ID NO: 4946 - DNA, 51 bp, Artificial Sequence
  Synthetic polynucleotide
cgagtatcacgtgatccggcacgccrtgaacctggaggccgtgaacaccta

SEQ ID NO: 4947 - DNA, 51 bp, Artificial Sequence
  Synthetic polynucleotide
acaattgttaacttccttctttgtcrggggtacatgatggatttgacagcc

SEQ ID NO: 4948 - DNA, 51 bp, Artificial Sequence
  Synthetic polynucleotide
ctcaggctcccttggttctctctgcrgtttacatgagctggtgaaacatga

SEQ ID NO: 4949 - DNA, 51 bp, Artificial Sequence
  Synthetic polynucleotide
tctttcttttttattccccaccccarggactgaggaggagaagaaagactg

SEQ ID NO: 4950 - DNA, 51 bp, Artificial Sequence
  Synthetic polynucleotide
ctgctgctggctctgggcgctgcccygccgcagctgcccgctcttctcgga

SEQ ID NO: 4951 - DNA, 51 bp, Artificial Sequence
  Synthetic polynucleotide
atgctgtttttttccctttcccaacrgttgttagccctgaagatctggcta

SEQ ID NO: 4952 - DNA, 51 bp, Artificial Sequence
  Synthetic polynucleotide
gttccccctcccccaggctgggagtrtagcatcaccatccccccggagcgg

SEQ ID NO: 4953 - DNA, 51 bp, Artificial Sequence
  Synthetic polynucleotide
ctgccataaccagcttcgtgtctccrgggcggcgtgatggatgacaagagt

SEQ ID NO: 4954 - DNA, 51 bp, Artificial Sequence
  Synthetic polynucleotide
attacatttcattataattcttttcrggtaacagaaagaaagcaacagttg

SEQ ID NO: 4955 - DNA, 51 bp, Artificial Sequence
  Synthetic polynucleotide
gtgtactcctgtgagtggcctctttrtatgtggccctttcaaaaggtgaga

SEQ ID NO: 4956 - DNA, 51 bp, Artificial Sequence
  Synthetic polynucleotide
ctctgctctctcccttggctactccrggttcttctgtgacccagttgctgg

SEQ ID NO: 4957 - DNA, 51 bp, Artificial Sequence
  Synthetic polynucleotide
ggggttggaatgacccagatatggtraaaacttgagccctccttgttcaag

SEQ ID NO: 4958 - DNA, 51 bp, Artificial Sequence
  Synthetic polynucleotide
gcaggtgggatggagagcatgtccartgttccatatgtaatgaacagagga

SEQ ID NO: 4959 - DNA, 51 bp, Artificial Sequence
  Synthetic polynucleotide
gtctggttaaacacctcttaggtaarcagctcctgaaagacaagtctatcc

SEQ ID NO: 4960 - DNA, 51 bp, Artificial Sequence
  Synthetic polynucleotide
ggctctgaccccttgtcctatgtccdggtcattgctccctggaggatgcct

SEQ ID NO: 4961 - DNA, 51 bp, Artificial Sequence
  Synthetic polynucleotide
ttctgatctaacaatcctcattcccyaagagagaaaagatgattatgacta

SEQ ID NO: 4962 - DNA, 51 bp, Artificial Sequence
  Synthetic polynucleotide
tcttttttacttttttgatgccaatrggaatctgcaagcagaatatgaccg

SEQ ID NO: 4963 - DNA, 51 bp, Artificial Sequence
  Synthetic polynucleotide
acaagtttgctggtgtatggaagacyatacaaaaaggaaaaaaaaatcaaa

SEQ ID NO: 4964 - DNA, 51 bp, Artificial Sequence
  Synthetic polynucleotide
tcagaatcaaaggcatgggaggttgrtacctgccggggccattacaacaat

SEQ ID NO: 4965 - DNA, 51 bp, Artificial Sequence
  Synthetic polynucleotide
cgtcagctaattacatctttccttgrcagctcacaatccaggtgagtgaag

SEQ ID NO: 4966 - DNA, 51 bp, Artificial Sequence
  Synthetic polynucleotide
tgccatctctttgattttctgctcahagaactcctgctcttgttgcacagc

SEQ ID NO: 4967 - DNA, 51 bp, Artificial Sequence
  Synthetic polynucleotide
catcttagttagcgtgtcctctgaarggtacttggtaagtgtggaaagtag

SEQ ID NO: 4968 - DNA, 51 bp, Artificial Sequence
  Synthetic polynucleotide
aaatgcaactgctttaccaccaggtvatgttgttaatggaacgattggcaa

SEQ ID NO: 4969 - DNA, 51 bp, Artificial Sequence
  Synthetic polynucleotide
gaacctgcgaaggacatcggcttcarcgtcgccgtccttctgacaaacctc

SEQ ID NO: 4970 - DNA, 51 bp, Artificial Sequence
  Synthetic polynucleotide
agacagttcatatttgacgtggtcarcgaaggcggagagaaagagaagatg

SEQ ID NO: 4971 - DNA, 51 bp, Artificial Sequence
  Synthetic polynucleotide
acagtgacatggcttctctttttccrgggtgaaggtggtgcccccggactt

SEQ ID NO: 4972 - DNA, 51 bp, Artificial Sequence
  Synthetic polynucleotide
cttagggggccaggacatcttcatgrcagaggagcagaagaagtactacaa

SEQ ID NO: 4973 - DNA, 51 bp, Artificial Sequence
  Synthetic polynucleotide
ctctttgcacttagggggccaggacrtcttcatgacagaggagcagaagaa

SEQ ID NO: 4974 - DNA, 51 bp, Artificial Sequence
  Synthetic polynucleotide
ggtgagcctgacccattatctcgacrggtcctgaatctcttcctggccttg

SEQ ID NO: 4975 - DNA, 51 bp, Artificial Sequence
  Synthetic polynucleotide
gatggtggcttggttttgctcctcayaggccattgcgaccacggccaggat

SEQ ID NO: 4976 - DNA, 51 bp, Artificial Sequence
  Synthetic polynucleotide
ttcactgatcactctcatccttcacrgttttttgaagaggcgcagtctact

SEQ ID NO: 4977 - DNA, 51 bp, Artificial Sequence
  Synthetic polynucleotide
  misc_feature (26)..(26): n is a, c, g, t or u
tggtccagcctggagatcaccttcancctgcgagatgtgagttggctgccc

SEQ ID NO: 4978 - DNA, 51 bp, Artificial Sequence
  Synthetic polynucleotide
gtctctcccaacaccaactcagagargatcttctccatctgcgtcatgctc

SEQ ID NO: 4979 - DNA, 51 bp, Artificial Sequence
  Synthetic polynucleotide
ttcggcaacgtctctcccaacaccadctcagagaagatcttctccatctgc

SEQ ID NO: 4980 - DNA, 51 bp, Artificial Sequence
  Synthetic polynucleotide
gggcttcggcaacgtctctcccaacrccaactcagagaagatcttctccat

SEQ ID NO: 4981 - DNA, 51 bp, Artificial Sequence
  Synthetic polynucleotide
ccacacctccgccttccccgggtgcrggtcctgtccctgggcgccgacgtg

SEQ ID NO: 4982 - DNA, 51 bp, Artificial Sequence
  Synthetic polynucleotide
gagcgcaaagtggaaatcgccttctvccggaaagatggtaggagcgggccg

SEQ ID NO: 4983 - DNA, 51 bp, Artificial Sequence
  Synthetic polynucleotide
ggagaactgcgccgtcatctactgcdacgacggcttctgcgagctgtgcgg

SEQ ID NO: 4984 - DNA, 51 bp, Artificial Sequence
  Synthetic polynucleotide
agaatcctgtgaagcagctccagctrtgtgtgaagaagaggacagcactgc

SEQ ID NO: 4985 - DNA, 51 bp, Artificial Sequence
  Synthetic polynucleotide
gctccccctctcctgcactccacagrcctcatcgtggtcgtggcctccatg

SEQ ID NO: 4986 - DNA, 51 bp, Artificial Sequence
  Synthetic polynucleotide
gggagcctcctgtccattccttcccvggggattcttggctcggggtttgcc

SEQ ID NO: 4987 - DNA, 51 bp, Artificial Sequence
  Synthetic polynucleotide
caatctcctctcctctctccactgcrggctgcgggaacaccatcgggccac

SEQ ID NO: 4988 - DNA, 51 bp, Artificial Sequence
  Synthetic polynucleotide
atcggcgcccgcctgaaccgagtagragacaaggtaggctcacgcgccggc

SEQ ID NO: 4989 - DNA, 51 bp, Artificial Sequence
  Synthetic polynucleotide
tgcatgtgtcccgccggcttccagtrtgaacagttcagtggaggatgccaa

SEQ ID NO: 4990 - DNA, 51 bp, Artificial Sequence
  Synthetic polynucleotide
ttttgcttttttctccctccccccargatattgatgagtgctcccttccga

SEQ ID NO: 4991 - DNA, 51 bp, Artificial Sequence
  Synthetic polynucleotide
ggtcatttccattttgcagatattgrtgagtgtcagagagatcctctccta

SEQ ID NO: 4992 - DNA, 51 bp, Artificial Sequence
  Synthetic polynucleotide
agtcaacgtagaagttacgcgcataraagtgttcgatgcagatgaaatagg

SEQ ID NO: 4993 - DNA, 51 bp, Artificial Sequence
  Synthetic polynucleotide
tgagcaaaggggttctgaggtccatrccaagaagacggtgatgatcaagac

SEQ ID NO: 4994 - DNA, 51 bp, Artificial Sequence
  Synthetic polynucleotide
agaaatatgcatctgcttcttccccrggttaaccagcttcgtggcatcctc

SEQ ID NO: 4995 - DNA, 51 bp, Artificial Sequence
  Synthetic polynucleotide
gatatgaatatttcactcttttctcrggtcctccctcaccaccccttgacc

SEQ ID NO: 4996 - DNA, 51 bp, Artificial Sequence
  Synthetic polynucleotide
acttcatatttcagtttccctccctraagtacatccacgttatgatttaga

SEQ ID NO: 4997 - DNA, 51 bp, Artificial Sequence
  Synthetic polynucleotide
tacttcgaggggctccgcaagcactrcctgctcccggccatcgagtgagtg

SEQ ID NO: 4998 - DNA, 51 bp, Artificial Sequence
  Synthetic polynucleotide
tctatttttcaggtatcctggtcagrtataggaggactggaaagtatcaaa

SEQ ID NO: 4999 - DNA, 51 bp, Artificial Sequence
  Synthetic polynucleotide
acttttgatgcttgtttaattagtgragaattggcttatggatgtacaggg

SEQ ID NO: 5000 - DNA, 51 bp, Artificial Sequence
  Synthetic polynucleotide
cctaaagaaaatgttttaattggtgrcggagctggtttcaaagttgcaatg

SEQ ID NO: 5001 - DNA, 51 bp, Artificial Sequence
  Synthetic polynucleotide
gactgttctggaaatcttttatttcrggacacctcctacctgttcatcact

SEQ ID NO: 5002 - DNA, 51 bp, Artificial Sequence
  Synthetic polynucleotide
catacctatggaggatctttcctctrtcatttgaatgaaggtgaaccccta

SEQ ID NO: 5003 - DNA, 51 bp, Artificial Sequence
  Synthetic polynucleotide
aaaaatgggacaagatggccatgacrgaggagcaaaagttattgctacagg

SEQ ID NO: 5004 - DNA, 51 bp, Artificial Sequence
  Synthetic polynucleotide
tttaggccctggaccatccgccagtrtgctggttttagtactgtggaagaa

SEQ ID NO: 5005 - DNA, 51 bp, Artificial Sequence
  Synthetic polynucleotide
tcaggccatccagatcctgggcggcrtgggctacgtgacagagatgccggc

SEQ ID NO: 5006 - DNA, 51 bp, Artificial Sequence
  Synthetic polynucleotide
tccagctcggccgcctgtcagtgcartgctgccccatgtggtgctcacctt

SEQ ID NO: 5007 - DNA, 51 bp, Artificial Sequence
  Synthetic polynucleotide
gacatttttacactgcttgcccagaragccagaagaagtggatgatgaagt

SEQ ID NO: 5008 - DNA, 51 bp, Artificial Sequence
  Synthetic polynucleotide
acactggtcatctctggctcgggacrctgtgccctggaggccgccctggtc

SEQ ID NO: 5009 - DNA, 51 bp, Artificial Sequence
  Synthetic polynucleotide
cacccacagccgtccctgcttcctcrgggcctggcccagcacaagccagtg

SEQ ID NO: 5010 - DNA, 51 bp, Artificial Sequence
  Synthetic polynucleotide
cgtcccgagcaaaccacccatctacrggcatcgacatcctgtactcgggct

SEQ ID NO: 5011 - DNA, 51 bp, Artificial Sequence
  Synthetic polynucleotide
tggaccaagccccctcgtgtcttccrggtaccatcacacaatccccgtcat

SEQ ID NO: 5012 - DNA, 51 bp, Artificial Sequence
  Synthetic polynucleotide
ctcctgagggcctccctttccccgcrgctgtgaggtggagcagtgggactc

SEQ ID NO: 5013 - DNA, 51 bp, Artificial Sequence
  Synthetic polynucleotide
caccatgtccttgttggcagctaacracttgctggctggcctgagagggga

SEQ ID NO: 5014 - DNA, 51 bp, Artificial Sequence
  Synthetic polynucleotide
gtgggaattgacgcagccattgccartgcttttcgacgaattctgctagct

SEQ ID NO: 5015 - DNA, 51 bp, Artificial Sequence
  Synthetic polynucleotide
gctgtggtgctgcagctgtcccagcrgctgtctggcatcaacgctgtgagt

SEQ ID NO: 5016 - DNA, 51 bp, Artificial Sequence
  Synthetic polynucleotide
ataacagtgtggtttgtttctccgcrgaagctgacgggtcgcctcatgctg

SEQ ID NO: 5017 - DNA, 51 bp, Artificial Sequence
  Synthetic polynucleotide
actttgtcttccttgacgatattctrctttattcaatatgctcattatgtg

SEQ ID NO: 5018 - DNA, 51 bp, Artificial Sequence
  Synthetic polynucleotide
aataaatgtttgcaatggcctccagrtaattcttcctttgaaataaatatc

SEQ ID NO: 5019 - DNA, 51 bp, Artificial Sequence
  Synthetic polynucleotide
catgaatgtacttctggtttgtctgrtcttttggctaatattcagtatcat

SEQ ID NO: 5020 - DNA, 51 bp, Artificial Sequence
  Synthetic polynucleotide
taatttcaaccagcagaaaaagaagdtaagtatttctaatattttctctcc

SEQ ID NO: 5021 - DNA, 51 bp, Artificial Sequence
  Synthetic polynucleotide
atcctggctgtggtggccatggcctrcgaggaacagaatcaggccaccttg

SEQ ID NO: 5022 - DNA, 51 bp, Artificial Sequence
  Synthetic polynucleotide
gggattgaggccagtctagatgtgcrgtacctgatgagtgctggtgccaac

SEQ ID NO: 5023 - DNA, 51 bp, Artificial Sequence
  Synthetic polynucleotide
ggagaagaggaagaggccgttgctgyccaggaagaggcgcttgcgcttctg

SEQ ID NO: 5024 - DNA, 51 bp, Artificial Sequence
  Synthetic polynucleotide
gggccccgcatacctggtcaagaggytggtgatctgcaaggccagggcagc

SEQ ID NO: 5025 - DNA, 51 bp, Artificial Sequence
  Synthetic polynucleotide
gtgggcatcagccgtgagcatgccaraatcttcaactacggccgcatctat

SEQ ID NO: 5026 - DNA, 51 bp, Artificial Sequence
  Synthetic polynucleotide
cacaagggtgtagccaggtggggccygcaccatggctttcaactcactgcc

SEQ ID NO: 5027 - DNA, 51 bp, Artificial Sequence
  Synthetic polynucleotide
gagcagccagctggacattgacaacrtggcgggcgtattctacatgctggc

SEQ ID NO: 5028 - DNA, 51 bp, Artificial Sequence
  Synthetic polynucleotide
cttcttcgctgtcatattcctggctrgctacacagccaatctggctgcctt

SEQ ID NO: 5029 - DNA, 51 bp, Artificial Sequence
  Synthetic polynucleotide
gtcgggtcgccgtccagcctgcagcrtgagcgcccccagcgcgacccccat

SEQ ID NO: 5030 - DNA, 51 bp, Artificial Sequence
  Synthetic polynucleotide
ctgaccaccattggctacggggacargtacccccagacctggaacggcagg

SEQ ID NO: 5031 - DNA, 51 bp, Artificial Sequence
  Synthetic polynucleotide
gcgctccggagcctgcgcttcctgcrgattctgcggatgatccgcatggac

SEQ ID NO: 5032 - DNA, 51 bp, Artificial Sequence
  Synthetic polynucleotide
ctgagagcgcgcgttccctgcccccrggttcctcctggttttctcctgcct

SEQ ID NO: 5033 - DNA, 51 bp, Artificial Sequence
  Synthetic polynucleotide
gtcaccgtcagcgtgctggacaccartgacaatccgccggtcatcaacctg

SEQ ID NO: 5034 - DNA, 51 bp, Artificial Sequence
  Synthetic polynucleotide
cttagtatcaaggtgaccgactccadtgacaacaacccggtgtttagcgag

SEQ ID NO: 5035 - DNA, 51 bp, Artificial Sequence
  Synthetic polynucleotide
ttcacagcagaaggtgcactgacctbgagcttcacaaacatatgtgcttgt

SEQ ID NO: 5036 - DNA, 51 bp, Artificial Sequence
  Synthetic polynucleotide
tctcctccccaggtacaattttgtgrtgctggccctgtcctcctcattcct

SEQ ID NO: 5037 - DNA, 51 bp, Artificial Sequence
  Synthetic polynucleotide
tctgagtgcctgttctcgctcatcartggggacgacatgtttgtgacgttc

SEQ ID NO: 5038 - DNA, 51 bp, Artificial Sequence
  Synthetic polynucleotide
ttcattgaagaactaataaaaaattrtgatgggaaagtacacggggataga

SEQ ID NO: 5039 - DNA, 51 bp, Artificial Sequence
  Synthetic polynucleotide
accacggatagagtaaaagttatggyaagaggagagcctggaactgccaaa

SEQ ID NO: 5040 - DNA, 51 bp, Artificial Sequence
  Synthetic polynucleotide
cccaccccatccccatttcccccccrgcaaggcttcctgagccgacggcta

SEQ ID NO: 5041 - DNA, 51 bp, Artificial Sequence
  Synthetic polynucleotide
gataggcactgagatgatcatcaccraggccggcaggtaatgggcaagctg

SEQ ID NO: 5042 - DNA, 51 bp, Artificial Sequence
  Synthetic polynucleotide
gaggcatctggcttctgttacgtcartgatatcgtcttggccatcctggaa

SEQ ID NO: 5043 - DNA, 51 bp, Artificial Sequence
  Synthetic polynucleotide
tggtccacctgggaatgggaagacartgctggtaagggttctcttcaaatt

SEQ ID NO: 5044 - DNA, 51 bp, Artificial Sequence
  Synthetic polynucleotide
tatcaagaggatggattcgacttagrcttgacctgtatccatttctgcggc

SEQ ID NO: 5045 - DNA, 51 bp, Artificial Sequence
  Synthetic polynucleotide
gggtcctgcaggtatgtgacagggcrcatctgggcctgtcctccaagtgaa

SEQ ID NO: 5046 - DNA, 51 bp, Artificial Sequence
  Synthetic polynucleotide
gatccagaagattttgctgatgagcrgagccttgtgggccgcttcattcat

SEQ ID NO: 5047 - DNA, 51 bp, Artificial Sequence
  Synthetic polynucleotide
ggcatcatcgtggccaatgtcccagrgggtctgctggccactgtcactgta

SEQ ID NO: 5048 - DNA, 51 bp, Artificial Sequence
  Synthetic polynucleotide
tctcaggagctggtcactgcctggtrcatcggcttcctttgtctcatcctg

SEQ ID NO: 5049 - DNA, 51 bp, Artificial Sequence
  Synthetic polynucleotide
actaaatcttacatatttgaaggtartcttagacccattaaaacaagatgt

SEQ ID NO: 5050 - DNA, 51 bp, Artificial Sequence
  Synthetic polynucleotide
ttctgcaagaaatgcattctacgcarccttggtcgaaaggagttgtccaca

SEQ ID NO: 5051 - DNA, 51 bp, Artificial Sequence
  Synthetic polynucleotide
cccaccattagcttcttcctggagcrtttcacgcacgctcgcgtggaggcg

SEQ ID NO: 5052 - DNA, 51 bp, Artificial Sequence
  Synthetic polynucleotide
ctctagagaatcaggccgtccgagcyaacagtgatagaaaatacttctaga

SEQ ID NO: 5053 - DNA, 51 bp, Artificial Sequence
  Synthetic polynucleotide
tcgctttcccatccttttccttcccrgggctactttggagacccctggaat

SEQ ID NO: 5054 - DNA, 51 bp, Artificial Sequence
  Synthetic polynucleotide
caattggagtcagagtcccaaagacrtgggtaagtttcaaaaactttagca

SEQ ID NO: 5055 - DNA, 51 bp, Artificial Sequence
  Synthetic polynucleotide
cgtgcccttctctgctggccccaggractgtataggtttgtatccatctga

SEQ ID NO: 5056 - DNA, 51 bp, Artificial Sequence
  Synthetic polynucleotide
acaaagaaggtggtgaggtagtaggygggcagccggctcatgaacggcagg

SEQ ID NO: 5057 - DNA, 51 bp, Artificial Sequence
  Synthetic polynucleotide
caggggcagctctacccagagcccaytgatggtcacccaggagcccattcc

SEQ ID NO: 5058 - DNA, 51 bp, Artificial Sequence
  Synthetic polynucleotide
caagctgtctacctcttcgtgcaatrtatcatcatggtgaacctgttgatt

SEQ ID NO: 5059 - DNA, 51 bp, Artificial Sequence
  Synthetic polynucleotide
aataaaccctctgcttttgctctatrgttaatcagctcaaagatttgttgc

SEQ ID NO: 5060 - DNA, 51 bp, Artificial Sequence
  Synthetic polynucleotide
caagaacatgatatcactaatttctrtatgctcaccctagacaaagtaagt

SEQ ID NO: 5061 - DNA, 51 bp, Artificial Sequence
  Synthetic polynucleotide
gggatgctgctcctcgtggaggtcartgtcatcagggtgagggtaagcagg

SEQ ID NO: 5062 - DNA, 51 bp, Artificial Sequence
  Synthetic polynucleotide
gatggcagtggcagctcctccaatgyttgtgaagatcacttctgcaatcag

SEQ ID NO: 5063 - DNA, 51 bp, Artificial Sequence
  Synthetic polynucleotide
attttctagttttcttcctctttccrgggggagatggggtacccaggcctg

SEQ ID NO: 5064 - DNA, 51 bp, Artificial Sequence
  Synthetic polynucleotide
cagcatgccctgctctgtgcctcacrgaactacaggatctcatgcacatct

SEQ ID NO: 5065 - DNA, 51 bp, Artificial Sequence
  Synthetic polynucleotide
tgacctgacgcgatctctgtctgacracatcaacctgcctcagggagtgcg

SEQ ID NO: 5066 - DNA, 51 bp, Artificial Sequence
  Synthetic polynucleotide
tccaacacgtccaccttcgtgccctrtgagatcaaagtccaggccgtcaac

SEQ ID NO: 5067 - DNA, 51 bp, Artificial Sequence
  Synthetic polynucleotide
tcaatgattatcattcctatattgcrgtttttcggaggctggtacttctac

SEQ ID NO: 5068 - DNA, 51 bp, Artificial Sequence
  Synthetic polynucleotide
ctgctgaagggccaccccttcttctrtgtgcctgagattgtggatgagctc

SEQ ID NO: 5069 - DNA, 51 bp, Artificial Sequence
  Synthetic polynucleotide
aaacagcaaagctcacatactgaccyggcttttattaacatgatcgttggg

SEQ ID NO: 5070 - DNA, 51 bp, Artificial Sequence
  Synthetic polynucleotide
aaacttccgccacatgcagatgccakagaagatgaccctatagaaagaaaa

SEQ ID NO: 5071 - DNA, 51 bp, Artificial Sequence
  Synthetic polynucleotide
tacttacttgatttttttttttccartcaaacagagcagtatagctgtgac

SEQ ID NO: 5072 - DNA, 51 bp, Artificial Sequence
  Synthetic polynucleotide
ttgtgctgctttatccaattctaacygtcaaacagagagcaaagaacattt

SEQ ID NO: 5073 - DNA, 51 bp, Artificial Sequence
  Synthetic polynucleotide
attgttctgttgtaggtatatgccartctaacatcttgtcaagctcttgga

SEQ ID NO: 5074 - DNA, 51 bp, Artificial Sequence
  Synthetic polynucleotide
cacgtggctcaccagcaacacatagrgaagaaaatgctacggcttgagggc

SEQ ID NO: 5075 - DNA, 51 bp, Artificial Sequence
  Synthetic polynucleotide
aattaaagttcgaactgcccaataayaacatctcagatacctgtgaaaaca

SEQ ID NO: 5076 - DNA, 51 bp, Artificial Sequence
  Synthetic polynucleotide
ccatatggctctctctcttcttccarcctctcaggatgtcctatgaggatt

SEQ ID NO: 5077 - DNA, 51 bp, Artificial Sequence
  Synthetic polynucleotide
aggaatagggaggttctcatgaagabattttaaacttccatgctctgagaa

SEQ ID NO: 5078 - DNA, 51 bp, Artificial Sequence
  Synthetic polynucleotide
cagagtgattaaggaaggggcagtgyagtcgacccacggatgctcctcttt

SEQ ID NO: 5079 - DNA, 51 bp, Artificial Sequence
  Synthetic polynucleotide
tgtctatctctggaaaaattggtcartgagcacaagtgcctgtgtcagata

SEQ ID NO: 5080 - DNA, 51 bp, Artificial Sequence
  Synthetic polynucleotide
tagtaagatgaaacaggccgtccacygtacaaaaaaagatacttccattaa

SEQ ID NO: 5081 - DNA, 51 bp, Artificial Sequence
  Synthetic polynucleotide
tcagttttaaaggagaaaaccaggtraaagtgtctaatatcattagaggat

SEQ ID NO: 5082 - DNA, 51 bp, Artificial Sequence
  Synthetic polynucleotide
ccagtcctggccgtacacaaagcagyacttgcagtagaggtcatcatactc

SEQ ID NO: 5083 - DNA, 51 bp, Artificial Sequence
  Synthetic polynucleotide
ctgaggctggggaacatcgggcagcwtgagcggctgcgggctcttcctgcg

SEQ ID NO: 5084 - DNA, 64 bp, Artificial Sequence
  Synthetic
aaaaccccggggttttaaaaccccggggttttaaaaccccggggttttaaaaccccggggtttt

SEQ ID NO: 5085 - DNA, 64 bp, Artificial Sequence
  Synthetic
aaaaaaaaaaaaaaaaccccccccccccccccggggggggggggggggtttttttttttttttt

SEQ ID NO: 5086 - DNA, 64 bp, Artificial Sequence
  Synthetic
acgtacgtacgtacgtacgtacgtacgtacgtacgtacgtacgtacgtacgtacgtacgtacgt

SEQ ID NO: 5087 - protein, 1 aa, Artificial Sequence
  Synthetic
  MOD_RES (1)..(1): May be repeated 1 to 30 times
G

SEQ ID NO: 5088 - protein, 3 aa, Artificial Sequence
  Synthetic
  MOD_RES (1)..(3): May be repeated 1 to 30 times
GGS

SEQ ID NO: 5089 - protein, 2 aa, Artificial Sequence
  Synthetic
  MOD_RES (1)..(2): May be repeated 1 to 30 times
  MISC_FEATURE (1)..(1): Xaa can be any naturally occurring amino acid
XP

What is claimed is:

1. A Cas9 protein comprising an amino acid sequence that is at least 90% identical to the amino acid sequence of a Cas9 protein as provided by SEQ ID NO: 9,
   wherein the amino acid sequence of the Cas9 protein comprises an A262T substitution, and further comprises at least one substitution selected from the group consisting of S267G, K294R, F405I, S409I, E480K, E543D, M694I, E1219V, N1224K, 01256K, and L1362P of the amino acid sequence provided in SEQ ID NO: 9, and 13. A polynucleotide encoding the Cas9 protein of claim 1.

14. A vector comprising the polynucleotide of claim 13.

15. A cell comprising the Cas9 protein of claim 1, wherein the cell is not in a human being.

16. The Cas9 protein of claim 1, wherein the Cas9 protein recognizes a non-canonical PAM sequence.

17. The Cas9 protein of claim 16, wherein the non-canonical PAM sequence is selected from the group consisting of AAA, AAC, AAG, AAT, CAA, CAC, CAG, CAT, GAA, GAC, GAG, GAT, TAA, TAC, TAG, TAT, ACA, ACC, ACG, ACT, CCA, CCC, CCG, CCT, GCA, GCC, GCG, GCT, TCA, TCC, TCG, TCT, AGA, AGC, AGT, CGA, CGC, CGT, GGA, GGC, GGT, TGA, TGC, TGT, ATA, ATC, ATG, ATT, CTA, CTC, CTG, CTT, GTA, GTC, GTG, GTT, TTA, TTC, TTG, and TTT.

18. The Cas9 protein of claim 1, wherein the Cas9 protein further comprises at least one mutation at an amino acid residue selected from the group consisting of amino acid residues 122, 137, 182, 294, 409, 480, 543, 660, 694, 1219, and 1329 of the amino acid sequence provided in SEQ ID NO: 9.

19. The Cas9 protein of claim 1, wherein the Cas9 protein further comprises at least one mutation at an amino acid residue selected from the group consisting of amino acid residues 23, 108, 115, 141, 180, 230, 257, 267, 284, 294, 324, 409, 455, 466, 474, 480, 543, 554, 654, 694, 711, 727, 763, 1063, 1100, 1219, 1244, 1256, 1289, and 1323 of the amino acid sequence provided in SEQ ID NO: 9.

20. The Cas9 protein of claim 1, wherein the Cas9 protein comprises at least one amino acid substitution selected from the group consisting of D23N, E108G, R115H, K141Q, D180N, P230S, D257N, S267G, D284N, K294R, R324L, S409I, L455F, T466A, T474I, E480K, E543D, K554R, R654L, M694I, A711E, L727P, M763I, I1063V, V1100I, E1219V, K1244N, Q1256K, K1289Q, and A1323S in the amino acid sequence provided in SEQ ID NO: 9.

21. The Cas9 protein of claim 1, wherein the Cas9 protein further comprises at least one mutation at an amino acid residue selected from the group consisting of amino acid residues 108, 217, 324, 409, 480, 543, 673, 694, 1219, 1264, and 1365 of the amino acid sequence provided in SEQ ID NO: 9.

22. The Cas9 protein of claim 1, wherein the Cas9 protein comprises any one of the following groups of mutations:
   A262T, S409I, E480K, E543D, M694I, and E1219V;
   A262T, F405I, S409I, E480K, E543D, M694I, and E1219V;
   D23N, E108G, A262T, S409I, E480K, E543D, M694I, L727P, E1219V, and K1289Q;
   E108G, A262T, S409I, E480K, E543D, K673E, M694I, E1219V, and L1365I;
   E108G, S217A, A262T, S409I, E480K, E543D, M694I, E1219V, and L1365I;
   A262T, R324L, S409I, E480K, E543D, M694I, and E1219V;
   A262T, S409I, E480K, E543D, M694I, E1219V, and H1264Y;
   A262T, S409I, E480K, E543D, M694I, E1219V, and L1365I;
   E108G, A262T, S409I, E480K, E543D, K673E, and E1219V; and
   E108G, A262T, S409I, E480K, E543D, M694I, E1219V, and L1365I
of the amino acid sequence provided in SEQ ID NO: 9.

* * * * *

UNITED STATES PATENT AND TRADEMARK OFFICE
CERTIFICATE OF CORRECTION

| | | |
|---|---|---|
| PATENT NO. | : 12,043,852 B2 | Page 1 of 1 |
| APPLICATION NO. | : 15/770076 | |
| DATED | : July 23, 2024 | |
| INVENTOR(S) | : David R. Liu et al. | |

It is certified that error appears in the above-identified patent and that said Letters Patent is hereby corrected as shown below:

On the Title Page

Immediately following the "Primary Examiner" section, please insert the below section:
-- (74) *Attorney, Agent, or Firm* – Wolf, Greenfield & Sacks, P.C. --.

In the Claims

In Claim 1, at Column 651, Line 65, the text:
"E543D, M694I, E1219V, N1224K, 01256K, and"
Should be replaced with:
-- E543D, M694I, E1219V, N1224K, Q1256K, and --.

In Claim 20, at Column 653, Line 23, the text:
"R654L, M694I, A711E, L727P, M7631, 11063V, V1100I,"
Should be replaced with:
-- R654L, M694I, A711E, L727P, M763I, I1063V, V1100I, --.

Signed and Sealed this
Nineteenth Day of November, 2024

Katherine Kelly Vidal
*Director of the United States Patent and Trademark Office*